US007514209B2

(12) United States Patent
Dai et al.

(10) Patent No.: US 7,514,209 B2
(45) Date of Patent: Apr. 7, 2009

(54) DIAGNOSIS AND PROGNOSIS OF BREAST CANCER PATIENTS

(75) Inventors: HongYue Dai, Bothell, WA (US);
Yudong He, Kirkland, WA (US); Peter S. Linsley, Seattle, WA (US); Mao Mao, Kirkland, WA (US); Christopher J. Roberts, Seattle, WA (US); Laura Johanna Van't Veer, Amsterdam (NL); Marc J. Van de Vijver, Amsterdam (NL); Rene Bernards, Abcoude (NL); Augustinus A. M. Hart, Steenwijk (NL)

(73) Assignees: Rosetta Inpharmatics LLC, Seattle, WA (US); The Netherlands Cancer Institute, Amsterdam (NL)

( * ) Notice: Subject to any disclaimer, the term of this patent is extended or adjusted under 35 U.S.C. 154(b) by 866 days.

(21) Appl. No.: 10/172,118

(22) Filed: Jun. 14, 2002

(65) Prior Publication Data

US 2003/0224374 A1    Dec. 4, 2003

Related U.S. Application Data

(60) Provisional application No. 60/298,918, filed on Jun. 18, 2001, provisional application No. 60/380,710, filed on May 14, 2002.

(51) Int. Cl.
*C12Q 1/68* (2006.01)
*G01N 33/48* (2006.01)
*C07H 21/00* (2006.01)
(52) U.S. Cl. .............................. 435/6; 702/19; 536/23.1
(58) Field of Classification Search ................ 536/23.1; 435/6; 702/19
See application file for complete search history.

(56) References Cited

U.S. PATENT DOCUMENTS

| | | | |
|---|---|---|---|
| 5,510,270 | A | 4/1996 | Fodor et al. |
| 5,539,083 | A | 7/1996 | Cook et al. |
| 5,545,522 | A | 8/1996 | Van Gelder et al. |
| 5,556,752 | A | 9/1996 | Lockhart et al. |
| 5,578,832 | A | 11/1996 | Trulson et al. |
| 5,677,125 | A | 10/1997 | Holt et al. |
| 5,716,785 | A | 2/1998 | Van Gelder et al. |
| 5,891,636 | A | 4/1999 | Van Gelder et al. |
| 6,028,189 | A | 2/2000 | Blanchard |
| 6,057,105 | A | 5/2000 | Hoon et al. |
| 6,107,034 | A | 8/2000 | Wiegel |
| 6,203,987 | B1 | 3/2001 | Friend et al. |
| 6,218,122 | B1 | 4/2001 | Friend et al. |
| 6,271,002 | B1 | 8/2001 | Linsley et al. |
| 6,342,483 | B1 | 1/2002 | Holt et al. |
| 6,342,491 | B1 | 1/2002 | Dey et al. |
| 6,358,682 | B1 | 3/2002 | Jaffee et al. |
| 6,432,707 | B1 | 8/2002 | Reed et al. |
| 6,455,300 | B1 | 9/2002 | Htun et al. |
| 6,647,341 | B1 | 11/2003 | Golub et al. |
| 7,171,311 | B2 | 1/2007 | Dai et al. |
| 2003/0086934 | A1 | 5/2003 | Botstein et al. |
| 2003/0215805 | A1 | 11/2003 | Lillie et al. |
| 2003/0224374 | A1 | 12/2003 | Dai et al. |
| 2005/0048542 | A1 | 3/2005 | Baker |
| 2006/0040302 | A1 | 2/2006 | Botstein et al. |

FOREIGN PATENT DOCUMENTS

| | | |
|---|---|---|
| WO | WO98/33450 | 8/1998 |
| WO | WO00/55173 | 9/2000 |
| WO | WO01/05935 | 1/2001 |
| WO | WO01/06013 | 1/2001 |
| WO | WO01/46697 | 6/2001 |
| WO | WO01/51628 | 7/2001 |
| WO | WO02/16650 | 2/2002 |
| WO | WO02/18646 | 3/2002 |
| WO | WO02/085298 | 10/2002 |
| WO | PCT/US05/07894 | 3/2005 |
| WO | PCT/US05/27243 | 8/2005 |
| WO | WO 2006/084272 A2 | 2/2006 |

OTHER PUBLICATIONS

Nagase et al., DNA Research, vol. 7, pp. 347-355, 2000 (Abstract provided).*
Raemaekers et al., Journal of Cell Biology, vol. 162, pp. 1017-1029, 2003.*
NCBI, GenBank Database, NM_016359, pp. 1-2, 2005.*
NCBI, GenBank Database, KIAA1750, pp. 1, 2001.*
Beenken et al., 2001, "Molecurlar Biomarkers for Breast Cancer Prognosis: Coexpression of c-erbB-2 and p53", Annals of Surgery 233:630-638.
Bendat & Piersol, Random Data Analysis and Measurement Procedures, 2nd Edition., Wiley Interscience. Chapter 4: p. 74-108, 1996.
Blanchard et al., 1996, "High-Density oligonucleotide arrays", Biosensors and Bioelectronics 11:687-690.
Bonaldo et al., 1996, "Normalization and Subtraction: Two Approaches to Facilitate Gene Discovery", Genome Research 6:791-806.
Casey et al., 1997, "The BRCA1 and BRCA2 breast cancer genes", Curr Opin Oncol 9:88-93.
Chappuis et al., 2000, "Clinico-pathological characteristics of BRCA1- and BRCA2-related breast cancer", Semin Surg Oncol, 18:287-295.
Chirgwin et al., 1979, "Isolation of biologically active ribonucleic acid from sources enriched in ribionuclease", Biochemistry 18:5294-5299.

(Continued)

*Primary Examiner*—Lori A. Clow
*Assistant Examiner*—Anna Skibinsky
(74) *Attorney, Agent, or Firm*—Jones Day

(57) ABSTRACT

The present invention relates to genetic markers whose expression is correlated with breast cancer. Specifically, the invention provides sets of markers whose expression patterns can be used to differentiate clinical conditions associated with breast cancer, such as the presence or absence of the estrogen receptor ESR1, and BRCA1 and sporadic tumors, and to provide information on the likelihood of tumor distant metastases within five years of initial diagnosis. The invention relates to methods of using these markers to distinguish these conditions. The invention also relates to kits containing ready-to-use microarrays and computer software for data analysis using the statistical methods disclosed herein.

44 Claims, 32 Drawing Sheets

OTHER PUBLICATIONS

Figure 1:
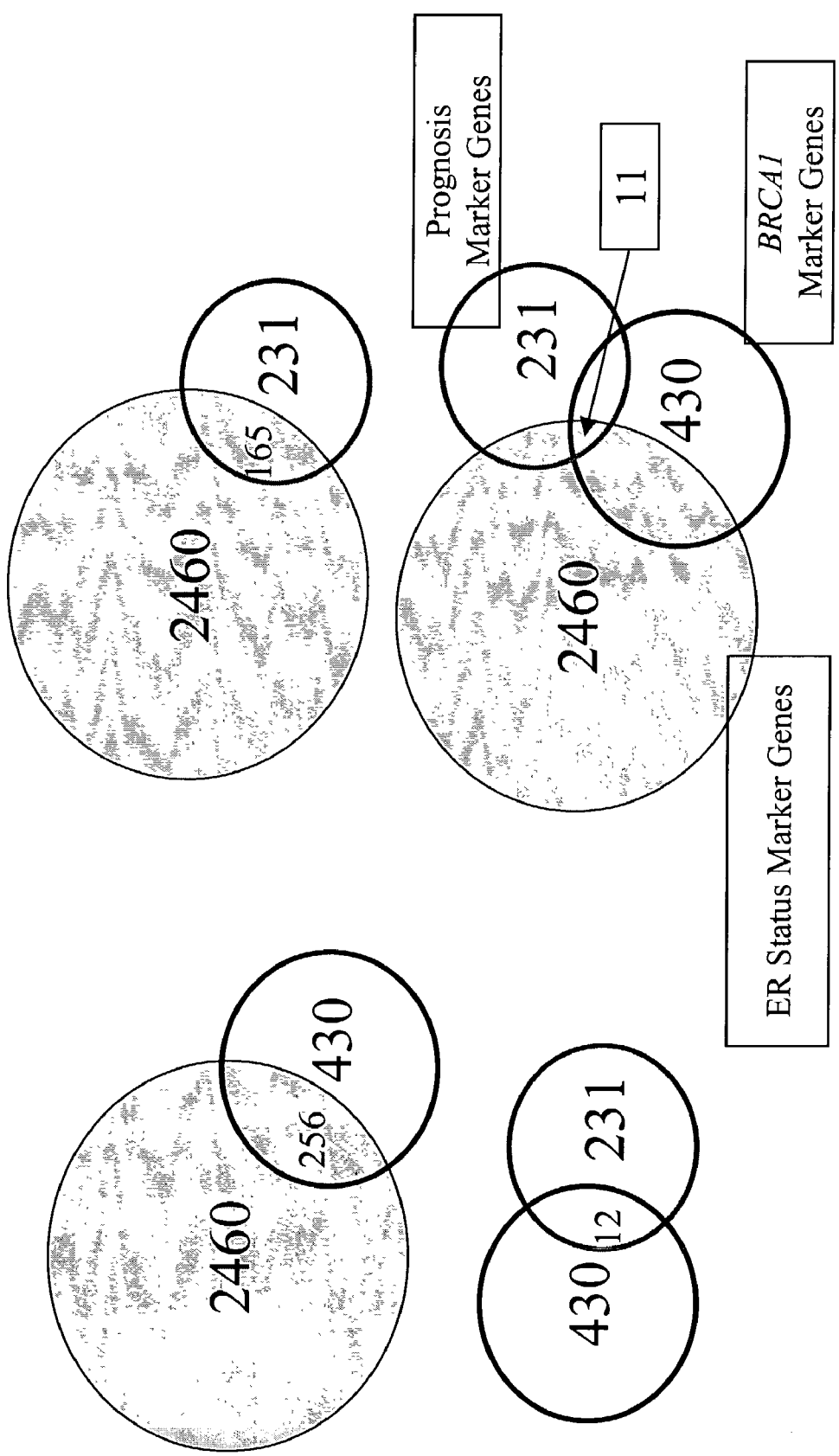

DeRisi et al., 1996, "Use of a cDNA microarray to analyse gene expression patterns in human cancer", Nature Genetics 14:457-460.

Egholm et al., 1993, "PNA hybridizes to complementary oligonucleotides obeying the Watson-Crick hydrogen-bonding rules", Nature 365:566-568.

Ewing et al., 2000, "Analysis of expressed sequence tags indicates 35,000 human genes", Nature Genetics 25:232-234.

Ferguson et al., 1996, "A fiber-optic DNA biosensor microarray for the analysis of gene expression", Nature Biotechnology 14:1681-1684.

Fodor et al., 1991, "Light-directed, spatially addressable parallel chemical synthesis", Science 251:767-773.

Froehler et al., 1986, "Synthesis of DNA via deoxynucleoside H-phosphonate intermediates", Nucleic Acids Research 14:5399-5407.

Hosmer & Lemeshow, Applied Logistic Regression, 2nd Edition. Chapter 5: p. 143-202.

Hughes et al., 2000, "Functional discovery via a compendium of expression profiles", Cell, 102:109-126.

Hughes et al., 2001, "Expression profiling using microarrays fabricated by an ink-jet oligonucleotide synthesizer", Nature Biotechnology 19:342-347.

Jatoi et al., 1999, "Breast Cancer Screening", The American Journal of Surgery 177:518-524.

Kononen et al., 1998, "Tissue microarrays for high-throughput molecular profiling of tumor specimens", Nature Medicine 4:844-847.

Laird et al., 1999 "Deficiency of Conexin 43 Gap Junctions Is an Independend Maker for Breast Tumors." Cancer Research 59:4104-4110.

Lander, 1996, "The new genomics: Global views of biology", Science 274:539-539.

Lockhart et al., 1996, "Expression monitoring by hybridization to high-density oligonucleotide arrays", Nature Biotechnology 14:1675-1680.

Lukas et al., 2001, "Alternative and aberrant messenger RNA splicing of the mdm2 oncogene in invasive breast cancer", Cancer Res, 61:3212-3219.

Marcus et al., 1996, "Hereditary breast cancer: pathobiology, prognosis, and BRCA1 and BRCA2 gene linkage", Cancer, 77:697-709.

Maskos and Southern, 1992, "Oligonucleotide hybridizations on glass supports: a novel linker for oligonucleotide synthesis and hybridisation properties of oligonucleotides synthesised in situ", Nucleic Acids Research 20:1679-1684.

McBride et al., 1983, "An investigation of several deoxynucleoside phosphoramidites useful for synthesizing deoxyoligonucleotides", Tetrahedron Letters 24;245-248.

Miki et al., 1994, "A strong candidate for the breast and ovarian cancer susceptibility gene BRCA1", Science, 266:66-71.

Nguyen et al., 1995, "Differential gene expression in the Murine Thymus Assayed by quantitative hybridization of arrayed cDNA clones", Genomics 29:207-216.

Parker et al., 1997, "Cancer statistics, 1997", CA Cancer J Clin, 47:5-27.

Pease et al., 1994, "Light-generated oligonucleotide arrays for rapid DNA sequence analysis", Proc. Natl. Acad. Sci. USA 91:5022-5026.

Rudolph et al., 2001, "Concurrent Overexpression of p53 and c-erbB-2 correlates with accelerated cycling and concomitant poor prognosis in node-negative breast cancer", Human Pathology 32:311-319.

Sagliocco et al, 1996, "Identification of proteins of the yeast protein map using genetically manipulated strains and peptide-mass fingerprinting", Yeast 12:1519-1533.

Schena et al., 1995, "Quantitative monitoring of gene expression patterns with a complementary DNA microarray", Science 270:467-470.

Schena et al., 1996, "Parallel human genome analysis; microarray-based expression of 1000 genes", Proc. Natl. Acad. Sci. USA 93:10614-10619.

Shalon et al., 1996, "A DNA microarray system for analyzing complex DNA samples using two-color fluorescent probe hybridization", Genome Research 6:639-645.

Shevchenko et al., 1996, "Linking genome and proteome by mass spectrometry: large-scale identification of yeast proteins from two dimensional gels", Proc. Natl. Acad. Sci. U.S.A 93:10869.

Sorlie et al. (2001) "Gene Expression Patterns of Breast Carcinomas Distinguish Tumor Subclasses with Clinical Implications." PNAS. 98:4104-4110.

S-Plus 2000 Guide to Statistics, MathSoft, vol. 2. Chapter 3:p. 43-66.

Perou et al., "Molecular Portraits of Human Breast Tumors," Nature, vol. 406, Aug. 17, 2000, www.nature.com, pp. 747-752.

Akiyama et al., GenBank Accession No. NM_020386 (Nov. 5, 2002).

Altieri, D.C., GenBank Accession No. NM_001168 (Oct. 31, 2000).

Amid et al., GenBank Accession No. NM_020974 (Dec. 3, 2002).

Andersson et al., GenBank Accession No. AF052159 (Aug. 5, 1998).

Andersson et al., GenBank Accession No. AF052162 (Aug. 5, 1998).

Andersson et al., GenBank Accession No. AF055033 (Apr. 5, 1998).

Andrulis et al., GenBank Accession No. NM_001673 (Oct. 31, 2000).

Ansorge et al., GenBank Accession No. NM_018410 (May 14, 2002).

Auffray et al., GenBank Accession No. AL355708 (May 10, 2000).

Austin et al., GenBank Accession No. NM_006681 (Dec. 23, 2002).

Bamshad et al., GenBank Accession No. NM_016569 (Aug. 4, 2001).

Belluoccio et al., GenBank Accession No. AJ224741 (Sep. 22, 1998).

Bennett et al., GenBank Accession No. NM_004603 (Nov. 5, 2002).

Bloecker et al., GenBank Accession No. AL133603 (Feb. 18, 2000).

Blum et al., GenBank Accession No. AL080079 (Feb. 18, 2000).

Blum et al., GenBank Accession No. AL133619 (Feb. 18, 2000).

Blum et al., GenBank Accession No. AL137718 (Feb. 18, 2000).

Boyd et al., GenBank Accession No. NM_004052 (May 7, 1999).

Bradshaw et al., GenBank Accession No. NM_003258 (Oct. 31, 2000).

Cadena et al., GenBank Accession No. NM_003676 (May 16, 2002).

Campbell et al., GenBank Accession No. NM_000849 (Oct. 31, 2000).

Cenciarelli et al., GenBank Accession No. NM_012177 (Jun. 15, 2001).

Chang et al., GenBank Accession No. NM_000286 (Nov. 5, 2002).

Chen et al., GenBank Accession No. NM_002916 (Nov. 5, 2002).

Chen et al., GenBank Accession No. NM_004163 (May 14, 2002).

Chen et al., GenBank Accession No. NM_006101 (Oct. 4, 2002).

Cheung et al., GenBank Accession No. NM_016448 (Jun. 14, 2001).

Chottiner et al., GenBank Accession No. NM_000788 (Oct. 31, 2000).

Cook et al., GenBank Accession No. NM_000127 (Jan. 15, 2003).

Creasy et al., GenBank Accession No. NM_006281 (Feb. 10, 2002).

Dahl et al., GenBank Accession No. NM_000320 (Jan. 15, 2003).

Dhar et al., GenBank Accession No. NM_014321 (Nov. 5, 2002).

Ding et al., GenBank Accession No. AF148505 (Oct. 31, 1999).

Duesterhoeft et al., GenBank Accession No. AL080059 (Feb. 18, 2000).

Fletcher et al., GenBank Accession No. NM_006763 (Nov. 2, 2000).

Fong et al., GenBank Accession No. NM_002073 (Nov. 5, 2002).

Fritz et al., GenBank Accession No. NM_004504 (May 7, 1999).

Frye, GenBank Accession No. NM_016539 (Feb. 6, 2003).

Geisbrecht et al., GenBank Accession No. NM_006117 (Nov. 5, 2002).

Gu et al., GenBank Accession No. NM_020188 (Dec. 23, 2002).

Hennenberry et al., GenBank Accession No. NM_020244 (Jan. 22, 2002).

Heyer et al., GenBank Accession No. NM_014791 (Apr. 7, 2003).

Hirosawa et al., GenBank Accession No. AB032973 (Nov. 11, 1999).

Hirosawa et al., GenBank Accession No. AB033007 (Nov. 11, 1999).

Hirosawa et al., GenBank Accession No. NM_012429 (Feb. 13, 2003).

Hirst et al., GenBank Accession No. NM_003875 (Nov. 1, 2000).

Holthoff et al., GenBank Accession No. NM_005915 (Aug. 27, 2002).

Hostikka et al., GenBank Accession No. X05610 (Jul. 13, 1995).

Hu et al., GenBank Accession No. NM_003748 (Apr. 10, 2002).
Huang et al., GenBank Accession No. NM_004911 (Nov. 1, 2000).
Ikeda et al., GenBank Accession No. NM_006115 (Jun. 19, 2001).
Isogai et al., GenBank Accession No. NM_015434 (Nov. 2, 2000).
Isogai et al., GenBank Accession No. NM_018004 (Dec. 23, 2002).
Isogai et al., GenBank Accession No. NM_018098 (Jun. 21, 2002).
Isogai et al., GenBank Accession No. NM_018120 (May 14, 2002).
Isogai et al., GenBank Accession No. NM_018136 (Sep. 30, 2002).
Isogai et al., GenBank Accession No. NM_018265 (Dec. 23, 2002).
Isogai et al., GenBank Accession No. NM_018354 (Nov. 5, 2002).
Isogai et al., GenBank Accession No. NM_019013 (May 14, 2002).
Jiang et al., GenBank Accession No. NM_003981 (Dec. 10, 2001).
Kassovska-Bratinova et al., GenBank Accession No. NM_000436 (Oct. 31, 2000).
Kawakami et al., GenBank Accession No. AK000745 (Feb. 22, 2000).
Kawakami et al., GenBank Accession No. NM_017779 (May 15, 2002).
Kayano et al., GenBank Accession No. NM_006931 (Nov. 2, 2000).
Kiefer et al., GenBank Accession No. L27560 (Jun. 27, 1994).
Kiefer et al., GenBank Accession No. NM_000599 (Oct. 31, 2000).
Kiefer et al., GenBank Accession No. NM_002570 (Oct. 31, 2000).
Kim et al., GenBank Accession No. NM_004701 (May 7, 1999).
Kimura et al., GenBank Accession No. NM_003158 (Oct. 31, 2000).
Kimura et al., GenBank Accession No. NM_003600 (Nov. 4, 2002).
Koehrer et al., GenBank Accession No. AL080110 (Feb. 18, 2000).
Koehrer et al., GenBank Accession No. AL137295 (Feb. 18, 2000).
Koehrer et al., GenBank Accession No. NM_015416 (May 14, 2002).
Kokame et al., GenBank Accession No. NM_006096 (Jan. 19, 2002).
Krane et al., GenBank Accession No. M21551 (Jan. 7, 1995).
Kuge et al., GenBank Accession No. NM_014754 (Mar. 31, 2001).
Lai et al., GenBank Accession No. NM_015984 (Nov. 12, 2002).
Laporte et al., GenBank Accession No. U58033 (Jun. 20, 1996).
Lassalle et al., GenBank Accession No. NM_007036 (Feb. 8, 2001).
Lauper et al., GenBank Accession No. NM_004702 (Aug. 21, 2001).
Leung et al., GenBank Accession No. NM_003376 (Nov. 1, 2000).
Li et al., GenBank Accession No. AF201951 (Jan. 24, 2000).
Li et al., GenBank Accession No. NM_002358 (Sep. 30, 1999).
Meyerson et al., GenBank Accession No. NM_006201 (Nov. 1, 2000).
Michelson et al., GenBank Accession No. NM_000291 (Oct. 31, 2000).
Mochizuki et al., GenBank Accession No. NM_013296 (May 14, 2002).
Mzhavia et al., GenBank Accession No. NM_014889 (Dec. 23, 2002).
Mzhavia et al., GenBank Accession No. NM_014968 (Dec. 23, 2002).
Nagase et al., GenBank Accession No. AB020689 (Jun. 16, 1999).
Nagase et al., GenBank Accession No. AB033043 (Nov. 11, 1999).
Nagase et al., GenBank Accession No. AB037745 (Mar. 14, 2000).
Nagase et al., GenBank Accession No. AB037863 (Mar. 14, 2000).
Nagase et al., GenBank Accession No. NM_014363 (Nov. 2, 2000).
Nagase et al., GenBank Accession No. NM_018104 (Dec. 10, 2001).
Nagata et al., GenBank Accession No. NM_004358 (Nov. 1, 2000).
Naito et al., GenBank Accession No. NM_000017 (May 3, 2002).
Nakagawa et al., GenBank Accession No. NM_014875 (Oct. 20, 2002).
Nishiyama et al., GenBank Accession No. NM_001280 (Dec. 19, 2001).
Nomura et al., GenBank Accession No. NM_006265 (Apr. 4, 2002).
Nomura et al., GenBank Accession No. NM_014750 (Apr. 10, 2002).
Nussbaum, R.L., GenBank Accession No. U45975 (Jun. 29, 1996).
Obata et al., GenBank Accession No. NM_020166 (Nov. 2, 2000).
Ohbayashi et al., GenBank Accession No. NM_003862 (Jan. 17, 2003).
Ohta et al., GenBank Accession No. NM_016337 (Jan. 13, 2003).
Olsson et al., GenBank Accession No. NM_013262 (May 4, 2000).
Opdam et al., GenBank Accession No. NM_016577 (Dec. 23, 2002).
Ottenwaelder et al., GenBank Accession No. AL137502 (Feb. 18, 2000).
Ottenwaelder et al., GenBank Accession No. AL137514 (Feb. 18, 2000).
Pangilinan et al., GenBank Accession No. NM_004336 (Nov. 5, 2002).
Pastorek et al., GenBank Accession No. NM_001216 (Jan. 17, 2003).
Pennica et al., GenBank Accession No. NM_003882 (Nov. 1, 2000).
Ponnambalam et al., GenBank Accession No. NM_001282 (Feb. 3, 2001).
Qing et al., GenBank Accession No. NM_013437 (Nov. 2, 2000).
Rattner et al., GenBank Accession No. NM_005196 (Feb. 3, 2001).
Redmond et al., GenBank Accession No. NM_002900 (Dec. 20, 2001).
Renner et al., GenBank Accession No. X94232 (Aug. 26, 1997).
Richardson et al., GenBank Accession No. NM_001827 (Jan. 15, 2003).
Romano et al., GenBank Accession No. NM_000224 (Nov. 5, 2002).
Ruiz-Perez et al., GenBank Accession No. NM_018401 (Dec. 10, 2001).
Santamarina et al., GenBank Accession No. NM_001333 (Oct. 31, 2000).
Satoh et al., GenBank Accession No. NM_002019 (Oct. 31, 2000).
Scanlan et al., GenBank Accession No. AF155117 (Jan. 5, 2000).
Scharf et al., GenBank Accession No. AF073519 (Jul. 12, 1999).
Schmiesing et al., GenBank Accession No. NM_005496 (Dec. 19, 2001).
Schneider et al., GenBank Accession No. NM_003234 (Oct. 31, 2000).
Schuetze, N., GenBank Accession No. NM_007203 (Apr. 4, 2002).
Simpson et al., GenBank Accession No. D25328 (Feb. 11, 2003).
Sobel et al., GenBank Accession No. NM_005563 (Nov. 1, 2000).
Solomon et al., GenBank Accession No. NM_000507 (Oct. 31, 2000).
Song et al., GenBank Accession No. NM_002808 (Apr. 15, 2002).
Stavrides et al., GenBank Accession No. NM_012261 (Nov. 5, 2002).
Strausberg, R., GenBank Accession No. AA555029 (Aug. 14, 1997).
Strausberg, R., GenBank Accession No. NM_004456 (Jun. 10, 2002).
Strausberg, R., GenBank Accession No. NM_006372 (Jun. 10, 2002).
Strausberg, R., GenBank Accession No. NM_020675 (Jun. 3, 2002).
Sullivan et al., GenBank Accession No. NM_001809 (Mar. 19, 1999).
Suzuki et al., GenBank Accession No. NM_014078 (Jul. 6, 2001).
ten Dijke et al., GenBank Accession No. NM_003239 (Oct. 31, 2000).
Thon et al., GenBank Accession No. NM_000158 (Jan. 15, 2003).
Tsurmi et al., GenBank Accession No. NM_002811 (Oct. 31, 2000).
van Heyningen et al., GenBank Accession No. NM_001124 (Jan. 15, 2003).
Wambutt et al., GenBank Accession No. AL050021 (Feb. 18, 2000).
Wambutt et al., GenBank Accession No. AL050090 (Feb. 18, 2000).
Wang et al., GenBank Accession No. AF257175 (Jul. 17, 2002).
Wendler et al., GenBank Accession No. NM_003662 (Dec. 23, 2002).
Wiemann et al., GenBank Accession No. NM_015417 (Jan. 19, 2002).
Wiles et al., GenBank Accession No. NM_001007 (Oct. 31, 2000).
Wilhelm et al., GenBank Accession No. NM_004994 (Jan. 15, 2003).
Wilke et al., GenBank Accession No. NM_005342 (Nov. 5, 2002).
Wilson, R.K., GenBank Accession No. R70506 (Jun. 1, 1995).
Yamauchi et al., GenBank Accession No. NM_001905 (Nov. 5, 2002).
Yamazaki et al., GenBank Accession No. NM_004798 (Nov. 5, 2002).
Yanagidani et al., GenBank Accession No. NM_04480 (Feb. 2, 2002).
Yang et al., GenBank Accession No. NM_000096 (Oct. 31, 2000).
Yao et al., GenBank Accession No. NM_003878 (Jan. 15, 2003).

Yasugi et al., GenBank Accession No. U96131 (Jul. 26, 1997).
Yin et al., GenBank Accession No. U82987 (Sep. 26, 2001).
Yoshida et al., GenBank Accession No. NM__012214 (Nov. 2, 2000).
Zhang et al., GenBank Accession No. AF161553 (May 22, 2001).
Zhang et al., GenBank Accession No. NM__014109 (Oct. 1, 2002).
Zhao et al., GenBank Accession No. NM__003607 (Dec. 30, 2002).
Zhao et al., GenBank Accession No. NM__018454 (Dec. 10, 2001).
Zhao et al., GenBank Accession No. NM__018455 (Feb. 10, 2002).
Contig753—Mar. 17, 2000—http://www.phrap.org/green__group/est__assembly/index.html.
Contig1778—Mar. 17, 2000—http://www.phrap.org/green__group/est__assembly/index.html.
Contig2399—Mar. 17, 2000—http://www.phrap.org/green__group/est__assembly/index.html.
Contig2504—Mar. 17, 2000—http://www.phrap.org/green__group/est__assembly/index.html.
Contig3902—Mar. 17, 2000—http://www.phrap.org/green__group/est__assembly/index.html.
Contig4595—Mar. 17, 2000—http://www.phrap.org/green__group/est__assembly/index.html.
Contig8581—Mar. 17, 2000—http://www.phrap.org/green__group/est__assembly/index.html.
Contig13480—Mar. 17, 2000—http://www.phrap.org/green__group/est__assembly/index.html.
Contig17359—Mar. 17, 2000—http://www.phrap.org/green__group/est__assembly/index.html.
Contig20217—Mar. 17, 2000—http://www.phrap.org/green__group/est__assembly/index.html.
Contig21812—Mar. 17, 2000—http://www.phrap.org/green__group/est__assembly/index.html.
Contig24252—Mar. 17, 2000—http://www.phrap.org/green__group/est__assembly/index.html.
Contig25055—Mar. 17, 2000—http://www.phrap.org/green__group/est__assembly/index.html.
Contig25343—Mar. 17, 2000—http://www.phrap.org/green__group/est__assembly/index.html.
Contig25991—Mar. 17, 2000—http://www.phrap.org/green__group/est__assembly/index.html.
Contig27312—Mar. 17, 2000—http://www.phrap.org/green__group/est__assembly/index.html.
Contig28552—Mar. 17, 2000—http://www.phrap.org/green__group/est__assembly/index.html.
Contig32125—Mar. 17, 2000—http://www.phrap.org/green__group/est__assembly/index.html.
Contig32185—Mar. 17, 2000—http://www.phrap.org/green__group/est__assembly/index.html.
Contig33814—Mar. 17, 2000—http://www.phrap.org/green__group/est__assembly/index.html.
Contig34634—Mar. 17, 2000—http://www.phrap.org/green__group/est__assembly/index.html.
Contig35251—Mar. 17, 2000—http://www.phrap.org/green__group/est__assembly/index.html.
Contig37063—Mar. 17, 2000—http://www.phrap.org/green__group/est__assembly/index.html.
Contig37598—Mar. 17, 2000—http://www.phrap.org/green__group/est__assembly/index.html.
Contig38288—Mar. 17, 2000—http://www.phrap.org/green__group/est__assembly/index.html.
Contig40128—Mar. 17, 2000—http://www.phrap.org/green__group/est__assembly/index.html.
Contig40831—Mar. 17, 2000—http://www.phrap.org/green__group/est__assembly/index.html.
Contig41413—Mar. 17, 2000—http://www.phrap.org/green__group/est__assembly/index.html.
Contig41887—Mar. 17, 2000—http://www.phrap.org/green__group/est__assembly/index.html.
Contig42421—Mar. 17, 2000—http://www.phrap.org/green__group/est__assembly/index.html.
Contig43747—Mar. 17, 2000—http://www.phrap.org/green__group/est__assembly/index.html.
Contig44064—Mar. 17, 2000—http://www.phrap.org/green__group/est__assembly/index.html.
Contig44289—Mar. 17, 2000—http://www.phrap.org/green__group/est__assembly/index.html.
Contig44799—Mar. 17, 2000—http://www.phrap.org/green__group/est__assembly/index.html.
Contig45347—Mar. 17, 2000—http://www.phrap.org/green__group/est__assembly/index.html.
Contig45816—Mar. 17, 2000—http://www.phrap.org/green__group/est__assembly/index.html.
Contig46218—Mar. 17, 2000—http://www.phrap.org/green__group/est__assembly/index.html.
Contig46223—Mar. 17, 2000—http://www.phrap.org/green__group/est__assembly/index.html.
Contig46653—Mar. 17, 2000—http://www.phrap.org/green__group/est__assembly/index.html.
Contig46802—Mar. 17, 2000—http://www.phrap.org/green__group/est__assembly/index.html.
Contig47405—Mar. 17, 2000—http://www.phrap.org/green__group/est__assembly/index.html.
Contig48328—Mar. 17, 2000—http://www.phrap.org/green__group/est__assembly/index.html.
Contig49670—Mar. 17, 2000—http://www.phrap.org/green__group/est__assembly/index.html.
Contig50106—Mar. 17, 2000—http://www.phrap.org/green__group/est__assembly/index.html.
Contig50410—Mar. 17, 2000—http://www.phrap.org/green__group/est__assembly/index.html.
Contig50802—Mar. 17, 2000—http://www.phrap.org/green__group/est__assembly/index.html.
Contig51464—Mar. 17, 2000—http://www.phrap.org/green__group/est__assembly/index.html.
Contig51519—Mar. 17, 2000—http://www.phrap.org/green__group/est__assembly/index.html.
Contig51749—Mar. 17, 2000—http://www.phrap.org/green__group/est__assembly/index.html.
Contig51963—Mar. 17, 2000—http://www.phrap.org/green__group/est__assembly/index.html.
Contig53226—Mar. 17, 2000—http://www.phrap.org/green__group/est__assembly/index.html.
Contig53268—Mar. 17, 2000—http://www.phrap.org/green__group/est__assembly/index.html.
Contig53646—Mar. 17, 2000—http://www.phrap.org/green__group/est__assembly/index.html.
Contig53742—Mar. 17, 2000—http://www.phrap.org/green__group/est__assembly/index.html.
Contig55188—Mar. 17, 2000—http://www.phrap.org/green__group/est__assembly/index.html.
Contig55313—Mar. 17, 2000—http://www.phrap.org/green__group/est__assembly/index.html.
Contig55377—Mar. 17, 2000—http://www.phrap.org/green__group/est__assembly/index.html.
Contig55725—Mar. 17, 2000—http://www.phrap.org/green__group/est__assembly/index.html.
Contig55813—Mar. 17, 2000—http://www.phrap.org/green__group/est__assembly/index.html.
Contig55829—Mar. 17, 2000—http://www.phrap.org/green__group/est__assembly/index.html.
Contig56457—Mar. 17, 2000—http://www.phrap.org/green__group/est__assembly/index.html.
Contig57595—Mar. 17, 2000—http://www.phrap.org/green__group/est__assembly/index.html.
Contig57864—Mar. 17, 2000—http://www.phrap.org/green__group/est__assembly/index.html.
Contig58368—Mar. 17, 2000—http://www.phrap.org/green__group/est__assembly/index.html.
Contig60864—Mar. 17, 2000—http://www.phrap.org/green__group/est__assembly/index.html.
Contig63102—Mar. 17, 2000—http://www.phrap.org/green__group/est__assembly/index.html.
Contig63649—Mar. 17, 2000—http://www.phrap.org/green__group/est__assembly/index.html.
Contig64688—Mar. 17, 2000—http://www.phrap.org/green__group/est__assembly/index.html.

Li et al., "Role of Transforming Growth Factor beta 3 in Lymphatic Metastasis in Breast Center. Int. J. Cancer," 1998, vol. 79, pp. 455-459.

Luparello et al., "Tissue Inhibitor Metalloprotease (TIMP)-1 and Proliferative behavious of Clonal Breast Cancer Cell," Breast Cancer Research and Treatment, 1999, vol. 54, pp. 235-244.

Van Hul et al., "Identification of a Third EXT-like Gene (EXTL3) Belonging to the EXT Gene Family, Genomics," 1998, vol. 47, pp. 230-237.

Singhal et al., "Elevated Deoxycytidine and Thymidine Kinase Activities in Human Breast Carcinoma Cells: Inhibition by Difluorodeoxycytidine and Azidodeoxythymidine," Proceedings of the International Cancer Congress, 16th, New Delhi, Oct. 1994, vol. 2.

Agendia BV press release dated Feb. 5, 2007, for the MammaPrint® breast cancer prognosis test, available at http://www.agendia.com/en/Agendia/Press-Releases/Press-Release.

Alexe et al., 2006, "Breast cancer prognosis by combinatorial analysis of gene expression data," Breast Cancer Research, Current Science 8: 1-20.

Alizadeh et al., 2000, "Distinct types of diffuse large B-cell lymphoma identified by gene expression profiling," Nature: 403: 503-511.

Cooper, 2001, "Applications of microarray technology in breast cancer research," Breast Cancer Research 3: 158-175.

Gruvberger et al., 2001, "Estrogen Receptor Status in Breast Cancer is Associated with Remarkably Distinct Gene Express Patterns," Cancer Research, American Association for Cancer Research: 61: 5979-5984.

Heldenfalk et al., 2001, "Gene-Expression Profiles in Hereditary Breast Cancer," New England Journal of Medicine, Massachusetts Medical Society: 344: 539-548.

Khan et al., 2001, "Classification and diagnostics prediction of cancers using gene expression profiling and artificial neural networks," Nature Medicine: 7: 673-679.

Office Action dated Oct. 19, 2005, in U.S. Appl. No. 10/342,887, filed Jan. 15, 2003, now U.S. patent No. 7,171,311 B2, issued on Jan. 30, 2007.

Perou et al., 1999, "Distinctive gene expression patterns in human mammary epithelial cells and breast cancers," Proceedings of the National Academy of Sciences of USA: 96: 9212-9217.

Supplementary Partial European Search Report dated Jul. 2, 2007, issued in European Patent Application No. 02746538.4-2204, the European regional phase of PCT/US02/018947.

U.S. Food and Drug Administration (FDA) press release dated Feb. 6, 2007, for the MammaPrint® test, available at http://www.fda.gov/bbs/topics/NEWS/2007/NEW01555.html.

Van't Veer et al., 2002, "Gene expression profiling predicts clinical outcome of breast cancer," Nature 415: 530-536.

West et al., 2001, "Predicting the clinical status of human breast cancer by using gene expression profiles," Proceedings of the National Academy of Sciences of USA: 98: 11462-11467.

Hosmer & Lemeshow, Applied Logistic Regression, $2^{nd}$ Edition. Chapter 5: p. 143-202, 2000.

Rudolph et al., 2001, "Concurrent Overexpression of p53 and c-erbB-2 correlates with accelerated cycling and concomitant poor prognosis in node-negative breast cancer", Human Pathology 32:311.

S-PLUS 2000 Guide to Statistics., MathSoft, vol. 2, Chapter 3:p. 43-66, May 1999.

Keys et al., 1983, "Clinical Oncology, Chapter 12 Breast Cancer," Edited by: Philip Rubin, 6th edition, American Cancer Society pp. 120-128, 133, and 506.

Jahkola et al., 1996, "Expression of Tenascin in Invasion Border of Early Breast Cancer Correlates with Higher Risk of Distant Metastasis," Int J Cancer 69(6):445-447.

Silvestrini et al., 1996, "Validation of P53 Accumulation as A Predictor of Distant Metastasis at 10 Years of Follow-Up in 1400 Node-Negative Breast Cancers," Clin Cancer Res. 2: 2007-2013.

* cited by examiner

DIAGNOSIS AND PROGNOSIS OF BREAST CANCER PATIENTS

This application claims benefit of U.S. Provisional Application No. 60/298,918, filed Jun. 18, 2001, and U.S. Provisional Application No. 60/380,710, filed on May 14, 2002, each of which is incorporated by reference herein in its entirety.

This application includes a Sequence Listing submitted on compact disc, recorded on two compact discs, including one duplicate, containing Filename 9301175999.txt, of size 6,766,592 bytes, created Jun. 13, 2002. The sequence listing on the compact discs is incorporated by reference herein in its entirety.

1. FIELD OF THE INVENTION

The present invention relates to the identification of marker genes useful in the diagnosis and prognosis of breast cancer. More particularly, the invention relates to the identification of a set of marker genes associated with breast cancer, a set of marker genes differentially expressed in estrogen receptor (+) versus estrogen receptor (−) tumors, a set of marker genes differentially expressed in BRCA1 versus sporadic tumors, and a set of marker genes differentially expressed in sporadic tumors from patients with good clinical prognosis (i.e., metastasis- or disease-free >5 years) versus patients with poor clinical prognosis (i.e., metastasis- or disease-free <5 years). For each of the marker sets above, the invention further relates to methods of distinguishing the breast cancer-related conditions. The invention further provides methods for determining the course of treatment of a patient with breast cancer.

2. BACKGROUND OF THE INVENTION

The increased number of cancer cases reported in the United States, and, indeed, around the world, is a major concern. Currently there are only a handful of treatments available for specific types of cancer, and these provide no guarantee of success. In order to be most effective, these treatments require not only an early detection of the malignancy, but a reliable assessment of the severity of the malignancy.

The incidence of breast cancer, a leading cause of death in women, has been gradually increasing in the United States over the last thirty years. Its cumulative risk is relatively high; 1 in 8 women are expected to develop some type of breast cancer by age 85 in the United States. In fact, breast cancer is the most common cancer in women and the second most common cause of cancer death in the United States. In 1997, it was estimated that 181,000 new cases were reported in the U.S., and that 44,000 people would die of breast cancer (Parker et al., CA Cancer J. Clin. 47:5-27 (1997); Chu et al., J. Nat. Cancer Inst. 88:1571-1579 (1996)). While mechanism of tumorigenesis for most breast carcinomas is largely unknown, there are genetic factors that can predispose some women to developing breast cancer (Miki et al., Science, 266:66-71(1994)). The discovery and characterization of BRCA1 and BRCA2 has recently expanded our knowledge of genetic factors which can contribute to familial breast cancer. Germ-line mutations within these two loci are associated with a 50 to 85% lifetime risk of breast and/or ovarian cancer (Casey, Curr. Opin. Oncol. 9:88-93 (1997); Marcus et al., Cancer 77:697-709 (1996)). Only about 5% to 10% of breast cancers are associated with breast cancer susceptibility genes, BRCA1 and BRCA2. The cumulative lifetime risk of breast cancer for women who carry the mutant BRCA1 is predicted to be approximately 92%, while the cumulative lifetime risk for the non-carrier majority is estimated to be approximately 10%. BRCA1 is a tumor suppressor gene that is involved in DNA repair anc cell cycle control, which are both important for the maintenance of genomic stability. More than 90% of all mutations reported so far result in a premature truncation of the protein product with abnormal or abolished function. The histology of breast cancer in BRCA1 mutation carriers differs from that in sporadic cases, but mutation analysis is the only way to find the carrier. Like BRCA1, BRCA2 is involved in the development of breast cancer, and like BRCA1 plays a role in DNA repair. However, unlike BRCA1, it is not involved in ovarian cancer.

Other genes have been linked to breast cancer, for example c-erb-2 (HER2) and p53 (Beenken et al., Ann. Surg. 233(5): 630-638 (2001). Overexpression of c-erb-2 (HER2) and p53 have been correlated with poor prognosis (Rudolph et al., Hum. Pathol. 32(3):311-319 (2001), as has been aberrant expression products of mdm2 (Lukas et al., Cancer Res. 61(7):3212-3219 (2001) and cyclin1 and p27 (Porter & Roberts, International Publication WO98/33450, published Aug. 6, 1998). However, no other clinically useful markers consistently associated with breast cancer have been identified.

Sporadic tumors, those not currently associated with a known germline mutation, constitute the majority of breast cancers. It is also likely that other, non-genetic factors also have a significant effect on the etiology of the disease. Regardless of the cancer's origin, breast cancer morbidity and mortality increases significantly if it is not detected early in its progression. Thus, considerable effort has focused on the early detection of cellular transformation and tumor formation in breast tissue.

A marker-based approach to tumor identification and characterization promises improved diagnostic and prognostic reliability. Typically, the diagnosis of breast cancer requires histopathological proof of the presence of the tumor. In addition to diagnosis, histopathological examinations also provide information about prognosis and selection of treatment regimens. Prognosis may also be established based upon clinical parameters such as tumor size, tumor grade, the age of the patient, and lymph node metastasis.

Diagnosis and/or prognosis may be determined to varying degrees of effectiveness by direct examination of the outside of the breast, or through mammography or other X-ray imaging methods (Jatoi, Am. J. Surg. 177:518-524 (1999)). The latter approach is not without considerable cost, however. Every time a mammogram is taken, the patient incurs a small risk of having a breast tumor induced by the ionizing properties of the radiation used during the test. In addition, the process is expensive and the subjective interpretations of a technician can lead to imprecision. For example, one study showed major clinical disagreements for about one-third of a set of mammograms that were interpreted individually by a surveyed group of radiologists. Moreover, many women find that undergoing a mammogram is a painful experience. Accordingly, the National Cancer Institute has not recommended mammograms for women under fifty years of age, since this group is not as likely to develop breast cancers as are older women. It is compelling to note, however, that while only about 22% of breast cancers occur in women under fifty, data suggests that breast cancer is more aggressive in pre-menopausal women.

In clinical practice, accurate diagnosis of various subtypes of breast cancer is important because treatment options, prognosis, and the likelihood of therapeutic response all vary broadly depending on the diagnosis. Accurate prognosis, or determination of distant metastasis-free survival could allow the oncologist to tailor the administration of adjuvant chemotherapy, with women having poorer prognoses being given the most aggressive treatment. Furthermore, accurate prediction of poor prognosis would greatly impact clinical trials for new breast cancer therapies, because potential study patients could then be stratified according to prognosis. Trials could then be limited to patients having poor prognosis, in turn making it easier to discern if an experimental therapy is efficacious.

To date, no set of satisfactory predictors for prognosis based on the clinical information alone has been identified. The detection of BRCA1 or BRCA2 mutations represents a step towards the design of therapies to better control and prevent the appearance of these tumors. However, there is no equivalent means for the diagnosis of patients with sporadic tumors, the most common type of breast cancer tumor, nor is there a means of differentiating subtypes of breast cancer.

3. SUMMARY OF THE INVENTION

The invention provides gene marker sets that distinguish various types and subtypes of breast cancer, and methods of use therefor. In one embodiment, the invention provides a method for classifying a cell sample as ER(+) or ER(−) comprising detecting a difference in the expression of a first plurality of genes relative to a control, said first plurality of genes consisting of at least 5 of the genes corresponding to the markers listed in Table 1. In specific embodiments, said plurality of genes consists of at least 50, 100, 200, 500, 1000, up to 2,460 of the gene markers listed in Table 1. In another specific embodiment, said plurality of genes consists of each of the genes corresponding to the 2,460 markers listed in Table 2. In another specific embodiment, said plurality consists of the 550 markers listed in Table 2. In another specific embodiment, said control comprises nucleic acids derived from a pool of tumors from individual sporadic patients. In another specific embodiment, said detecting comprises the steps of: (a) generating an ER(+) template by hybridization of nucleic acids derived from a plurality of ER(+) patients within a plurality of sporadic patients against nucleic acids derived from a pool of tumors from individual sporadic patients; (b) generating an ER(−) template by hybridization of nucleic acids derived from a plurality of ER(−) patients within said plurality of sporadic patients against nucleic acids derived from said pool of tumors from individual sporadic patients within said plurality; (c) hybridizing nucleic acids derived from an individual sample against said pool; and (d) determining the similarity of marker gene expression in the individual sample to the ER(+) template and the ER(−) template, wherein if said expression is more similar to the ER(+) template, the sample is classified as ER(+), and if said expression is more similar to the ER(−) template, the sample is classified as ER(−).

The invention further provides the above methods, applied to the classification of samples as BRCA1 or sporadic, and classifying patients as having good prognosis or poor prognosis. For the BRCA1/sporadic gene markers, the invention provides that the method may be used wherein the plurality of genes is at least 5, 20, 50, 100, 200 or 300 of the BRCA1/sporadic markers listed in Table 3. In a specific embodiment, the optimum 100 markers listed in Table 4 are used. For the prognostic markers, the invention provides that at least 5, 20, 50, 100, or 200 gene markers listed in Table 5 may be used. In a specific embodiment, the optimum 70 markers listed in Table 6 are used.

The invention further provides that markers may be combined. Thus, in one embodiment, at least 5 markers from Table 1 are used in conjunction with at least 5 markers from Table 3. In another embodiment, at least 5 markers from Table 5 are used in conjunction with at least 5 markers from Table 3. In another embodiment, at least 5 markers from Table 1 are used in conjunction with at least 5 markers from Table 5. In another embodiment, at least 5 markers from each of Tables 1, 3, and 5 are used simultaneously.

The invention further provides a method for classifying a sample as ER(+) or ER(−) by calculating the similarity between the expression of at least 5 of the markers listed in Table 1 in the sample to the expression of the same markers in an ER(−) nucleic acid pool and an ER(+) nucleic acid pool, comprising the steps of: (a) labeling nucleic acids derived from a sample, with a first fluorophore to obtain a first pool of fluorophore-labeled nucleic acids; (b) labeling with a second fluorophore a first pool of nucleic acids derived from two or more ER(+) samples, and a second pool of nucleic acids derived from two or more ER(−) samples; (c) contacting said first fluorophore-labeled nucleic acid and said first pool of second fluorophore-labeled nucleic acid with said first microarray under conditions such that hybridization can occur, and contacting said first fluorophore-labeled nucleic acid and said second pool of second fluorophore-labeled nucleic acid with said second microarray under conditions such that hybridization can occur, detecting at each of a plurality of discrete loci on the first microarray a first flourescent emission signal from said first fluorophore-labeled nucleic acid and a second fluorescent emission signal from said first pool of second fluorophore-labeled genetic matter that is bound to said first microarray under said conditions, and detecting at each of the marker loci on said second microarray said first fluorescent emission signal from said first fluorophore-labeled nucleic acid and a third fluorescent emission signal from said second pool of second fluorophore-labeled nucleic acid; (d) determining the similarity of the sample to the ER(−) and ER(+) pools by comparing said first fluorescence emission signals and said second fluorescence emission signals, and said first emission signals and said third fluorescence emission signals; and (e) classifying the sample as ER(+) where the first fluorescence emission signals are more similar to said second fluorescence emission signals than to said third fluorescent emission signals, and classifying the sample as ER(−) where the first fluorescence emission signals are more similar to said third fluorescence emission signals than to said second fluorescent emission signals, wherein said similarity is defined by a statistical method. The invention further provides that the other disclosed marker sets may be used in the above method to distinguish BRCA1 from sporadic tumors, and patients with poor prognosis from patients with good prognosis.

In a specific embodiment, said similarity is calculated by determining a first sum of the differences of expression levels for each marker between said first fluorophore-labeled nucleic acid and said first pool of second fluorophore-labeled nucleic acid, and a second sum of the differences of expression levels for each marker between said first fluorophore-labeled nucleic acid and said second pool of second fluorophore-labeled nucleic acid, wherein if said first sum is greater than said second sum, the sample is classified as ER(−), and if said second sum is greater than said first sum, the sample is classified as ER(+). In another specific embodiment, said similarity is calculated by computing a first classifier parameter $P_1$ between an ER(+) template and the expression of said markers in said sample, and a second classifier parameter $P_2$ between an ER(−) template and the expression of said markers in said sample, wherein said $P_1$ and $P_2$ are calculated according to the formula:

$$P_i = (\vec{z}_i \bullet \vec{y})/(\|\vec{z}_i\| \cdot \|\vec{y}\|), \qquad \text{Equation (1)}$$

wherein $\vec{z}_1$ and $\vec{z}_2$ are ER(−) and ER(+) templates, respectively, and are calculated by averaging said second fluorescence emission signal for each of said markers in said first pool of second fluorophore-labeled nucleic acid and said third fluorescence emission signal for each of said markers in said second pool of second fluorophore-labeled nucleic acid, respectively, and wherein $\vec{y}$ is said first fluorescence emission signal of each of said markers in the sample to be classified as ER(+) or ER(−), wherein the expression of the markers in the sample is similar to ER(+) if $P_1 < P_2$, and similar to ER(−) if $P_1 > P_2$.

The invention further provides a method for identifying marker genes the expression of which is associated with a particular phenotype. In one embodiment, the invention provides a method for determining a set of marker genes whose expression is associated with a particular phenotype, comprising the steps of: (a) selecting the phenotype having two or more phenotype categories; (b) identifying a plurality of genes wherein the expression of said genes is correlated or anticorrelated with one of the phenotype categories, and wherein the correlation coefficient for each gene is calculated according to the equation $$\rho = (\vec{c} \bullet \vec{r})/(\|\vec{c}\| \cdot \|\vec{r}\|) \quad \text{Equation (2)}$$

wherein $\vec{c}$ is a number representing said phenotype category and $\vec{r}$ is the logarithmic expression ratio across all the samples for each individual gene, wherein if the correlation coefficient has an absolute value of a threshold value or greater, said expression of said gene is associated with the phenotype category, and wherein said plurality of genes is a set of marker genes whose expression is associated with a particular phenotype. The threshold depends upon the number of samples used; the threshold can be calculated as $3 \times 1/\sqrt{n-3}$, where $1/\sqrt{n-3}$ is the distribution width and n=the number of samples. In a specific embodiment where n=98, said threshold value is 0.3. In a specific embodiment, said set of marker genes is validated by: (a) using a statistical method to randomize the association between said marker genes and said phenotype category, thereby creating a control correlation coefficient for each marker gene; (b) repeating step (a) one hundred or more times to develop a frequency distribution of said control correlation coefficients for each marker gene; (c) determining the number of marker genes having a control correlation coefficient of a threshold value or above, thereby creating a control marker gene set; and (d) comparing the number of control marker genes so identified to the number of marker genes, wherein if the p value of the difference between the number of marker genes and the number of control genes is less than 0.01, said set of marker genes is validated. In another specific embodiment, said set of marker genes is optimized by the method comprising: (a) rank-ordering the genes by amplitude of correlation or by significance of the correlation coefficients, and (b) selecting an arbitrary number of marker genes from the top of the rank-ordered list. The threshold value depends upon the number of samples tested.

The invention further provides a method for assigning a person to one of a plurality of categories in a clinical trial, comprising determining for each said person the level of expression of at least five of the prognosis markers listed in Table 6, determining therefrom whether the person has an expression pattern that correlates with a good prognosis or a poor prognosis, and assigning said person to one category in a clinical trial if said person is determined to have a good prognosis, and a different category if that person is determined to have a poor prognosis. The invention further provides a method for assigning a person to one of a plurality of categories in a clinical trial, where each of said categories is associated with a different phenotype, comprising determining for each said person the level of expression of at least five markers from a set of markers, wherein said set of markers includes markers associated with each of said clinical categories, determining therefrom whether the person has an expression pattern that correlates with one of the clinical categories, an assigning said person to one of said categories if said person is determined to have a phenotype associated with that category.

The invention further provides a method of classifying a first cell or organism as having one of at least two different phenotypes, said at least two different phenotypes comprising a first phenotype and a second phenotype, said method comprising: (a) comparing the level of expression of each of a plurality of genes in a first sample from the first cell or organism to the level of expression of each of said genes, respectively, in a pooled sample from a plurality of cells or organisms, said plurality of cells or organisms comprising different cells or organisms exhibiting said at least two different phenotypes, respectively, to produce a first compared value; (b) comparing said first compared value to a second compared value, wherein said second compared value is the product of a method comprising comparing the level of expression of each of said genes in a sample from a cell or organism characterized as having said first phenotype to the level of expression of each of said genes, respectively, in said pooled sample; (c) comparing said first compared value to a third compared value, wherein said third compared value is the product of a method comprising comparing the level of expression of each of said genes in a sample from a cell or organism characterized as having said second phenotype to the level of expression of each of said genes, respectively, in said pooled sample, (d) optionally carrying out one or more times a step of comparing said first compared value to one or more additional compared values, respectively, each additional compared value being the product of a method comprising comparing the level of expression of each of said genes in a sample from a cell or organism characterized as having a phenotype different from said first and second phenotypes but included among said at least two different phenotypes, to the level of expression of each of said genes, respectively, in said pooled sample; and (e) determining to which of said second, third and, if present, one or more additional compared values, said first compared value is most similar, wherein said first cell or organism is determined to have the phenotype of the cell or organism used to produce said compared value most similar to said first compared value.

In a specific embodiment of the above method, said compared values are each ratios of the levels of expression of each of said genes. In another specific embodiment, each of said levels of expression of each of said genes in said pooled sample are normalized prior to any of said comparing steps. In another specific embodiment, normalizing said levels of expression is carried out by dividing each of said levels of expression by the median or mean level of expression of each of said genes or dividing by the mean or median level of expression of one or more housekeeping genes in said pooled sample. In a more specific embodiment, said normalized levels of expression are subjected to a log transform and said comparing steps comprise subtracting said log transform from the log of said levels of expression of each of said genes in said sample from said cell or organism. In another specific embodiment, said at least two different phenotypes are different stages of a disease or disorder. In another specific embodiment, said at least two different phenotypes are different prognoses of a disease or disorder. In yet another specific embodiment, said levels of expression of each of said genes, respectively, in said pooled sample or said levels of expression of each of said genes in a sample from said cell or organism characterized as having said first phenotype, said second phenotype, or said phenotype different from said first and second phenotypes, respectively, are stored on a computer.

The invention further provides microarrays comprising the disclosed marker sets. In one embodiment, the invention provides a microarray comprising at least 5 markers derived from any one of Tables 1-6, wherein at least 50% of the probes on the microarray are present in any one of Tables 1-6. In more specific embodiments, at least 60%, 70%, 80%, 90%, 95% or 98% of the probes on said microarray are present in any one of Tables 1-6.

In another embodiment, the invention provides a microarray for distinguishing ER(+) and ER(−) cell samples comprising a positionally-addressable array of polynucleotide probes bound to a support, said polynucleotide probes comprising a plurality of polynucleotide probes of different nucleotide sequences, each of said different nucleotide sequences comprising a sequence complementary and hybridizable to a plurality of genes, said plurality consisting of at least 5 of the genes corresponding to the markers listed in Table 1 or Table 2, wherein at least 50% of the probes on the microarray are present in any one of Table 1 or Table 2. In yet another embodiment, the invention provides a microarray for distinguishing BRCA1-type and sporadic tumor-type cell samples comprising a positionally-addressable array of polynucleotide probes bound to a support, said polynucleotide probes comprising a plurality of polynucleotide probes of different nucleotide sequences, each of said different nucleotide sequences comprising a sequence complementary and hybridizable to a plurality of genes, said plurality consisting of at least 5 of the genes corresponding to the markers listed in Table 3 or Table 4, wherein at least 50% of the probes on the microarray are present in any one of Table 3 or Table 4. In still another embodiment, the invention provides a microarray for distinguishing cell samples from patients having a good prognosis and cell samples from patients having a poor prognosis comprising a positionally-addressable array of polynucleotide probes bound to a support, said polynucleotide probes comprising a plurality of polynucleotide probes of different nucleotide sequences, each of said different nucleotide sequences comprising a sequence complementary and hybridizable to a plurality of genes, said plurality consisting of at least 5 of the genes corresponding to the markers listed in Table 5 or Table 6, wherein at least 50% of the probes on the microarray are present in any one of Table 5 or Table 6. The invention further provides for microarrays comprising at least 5, 20, 50, 100, 200, 500, 100, 1,250, 1,500, 1,750, or 2,000 of the ER-status marker genes listed in Table 1, at least 5, 20, 50, 100, 200, or 300 of the BRCA1 sporadic marker genes listed in Table 3, or at least 5, 20, 50, 100 or 200 of the prognostic marker genes listed in Table 5, in any combination, wherein at least 50%, 60%, 70%, 80%, 90%, 95% or 98% of the probes on said microarrays are present in Table 1, Table 3 and/or Table 5.

The invention further provides a kit for determining the ER-status of a sample, comprising at least two microarrays each comprising at least 5 of the markers listed in Table 1, and a computer system for determining the similarity of the level of nucleic acid derived from the markers listed in Table 1 in a sample to that in an ER(−) pool and an ER(+) pool, the computer system comprising a processor, and a memory encoding one or more programs coupled to the processor, wherein the one or more programs cause the processor to perform a method comprising computing the aggregate differences in expression of each marker between the sample and ER(−) pool and the aggregate differences in expression of each marker between the sample and ER(+) pool, or a method comprising determining the correlation of expression of the markers in the sample to the expression in the ER(−) and ER(+) pools, said correlation calculated according to Equation (4). The invention provides for kits able to distinguish BRCA1 and sporadic tumors, and samples from patients with good prognosis from samples from patients with poor prognosis, by inclusion of the appropriate marker gene sets. The invention further provides a kit for determining whether a sample is derived from a patient having a good prognosis or a poor prognosis, comprising at least one microarray comprising probes to at least 5 of the genes corresponding to the markers listed in Table 5, and a computer readable medium having recorded thereon one or more programs for determining the similarity of the level of nucleic acid derived from the markers listed in Table 5 in a sample to that in a pool of samples derived from individuals having a good prognosis and a pool of samples derived from individuals having a good prognosis, wherein the one or more programs cause a computer to perform a method comprising computing the aggregate differences in expression of each marker between the sample and the good prognosis pool and the aggregate differences in expression of each marker between the sample and the poor prognosis pool, or a method comprising determining the correlation of expression of the markers in the sample to the expression in the good prognosis and poor prognosis pools, said correlation calculated according to Equation (3).

4. BRIEF DESCRIPTION OF THE FIGURES

FIG. 1 is a Venn-type diagram showing the overlap between the marker sets disclosed herein, including the 2,460 ER markers, the 430 BRCA1/sporadic markers, and the 231 prognosis reporters.

Figure 2:
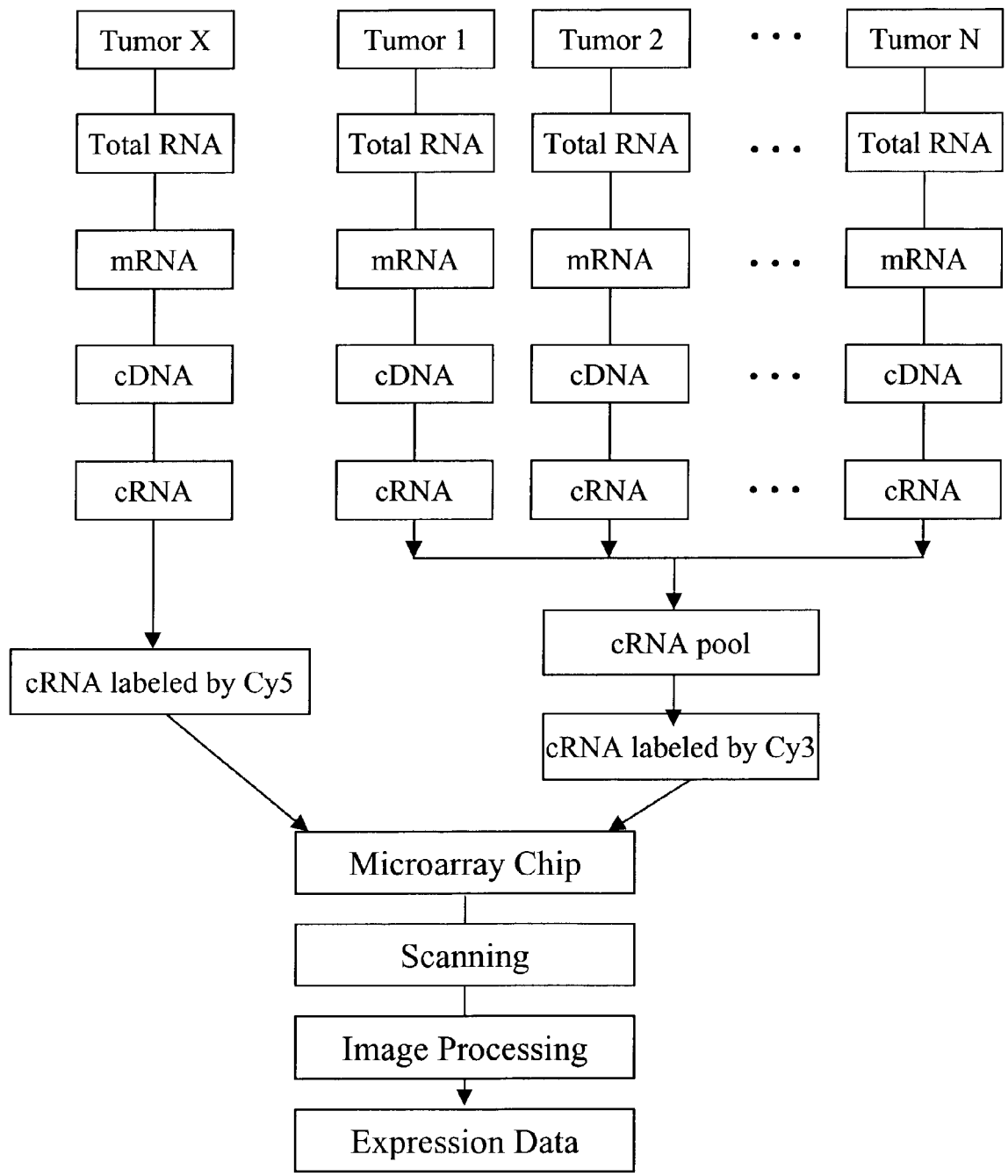

FIG. 2 shows the experimental procedures for measuring differential changes in mRNA transcript abundance in breast cancer tumors used in this study. In each experiment, Cy5-labeled cRNA from one tumor X is hybridized on a 25 k human microarray together with a Cy3-labeled cRNA pool made of cRNA samples from tumors 1, 2, . . . N. The digital expression data were obtained by scanning and image processing. The error modeling allowed us to assign a p-value to each transcript ratio measurement.

Figure 3:
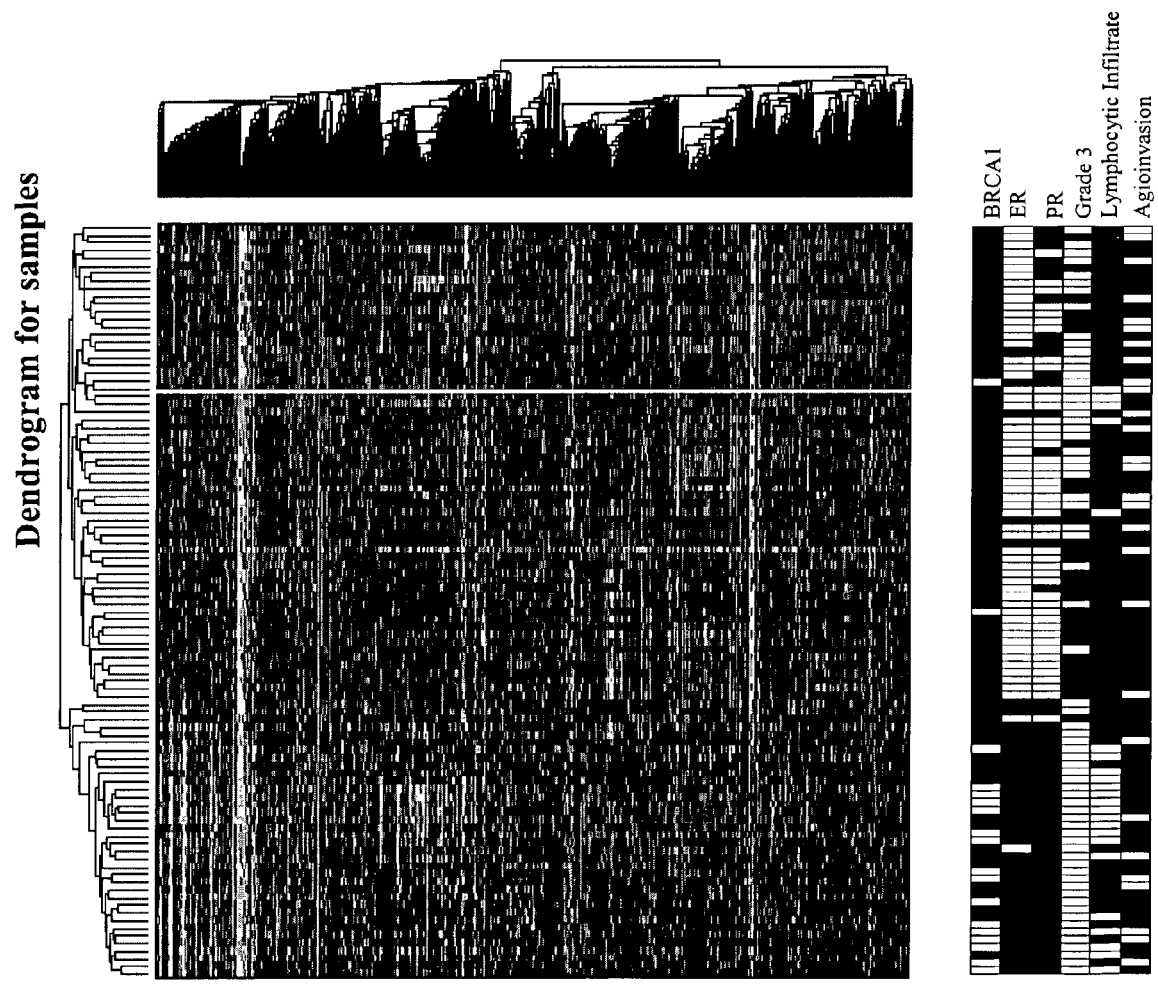

FIG. 3 Two-dimensional clustering reveals two distinctive types of tumors. The clustering was based on the gene expression data of 98 breast cancer tumors over 4986 significant genes. Dark gray (red) presents up-regulation, light gray (green) represents down-regulation, black indicates no change in expression, and gray indicates that data is not available. 4986 genes were selected that showed a more than two fold change in expression ratios in more than five experiments. Selected clinical data for test results of BRCA1 mutations, estrogen receptor (ER), and proestrogen receptor (PR), tumor grade, lymphocytic infiltrate, and angioinvasion are shown at right. Black denotes negative and white denotes positive. The dominant pattern in the lower part consists of 36 patients, out of which 34 are ER-negative (total 39), and 16 are BR CA1-mutation carriers (total 18).

Figure 4:
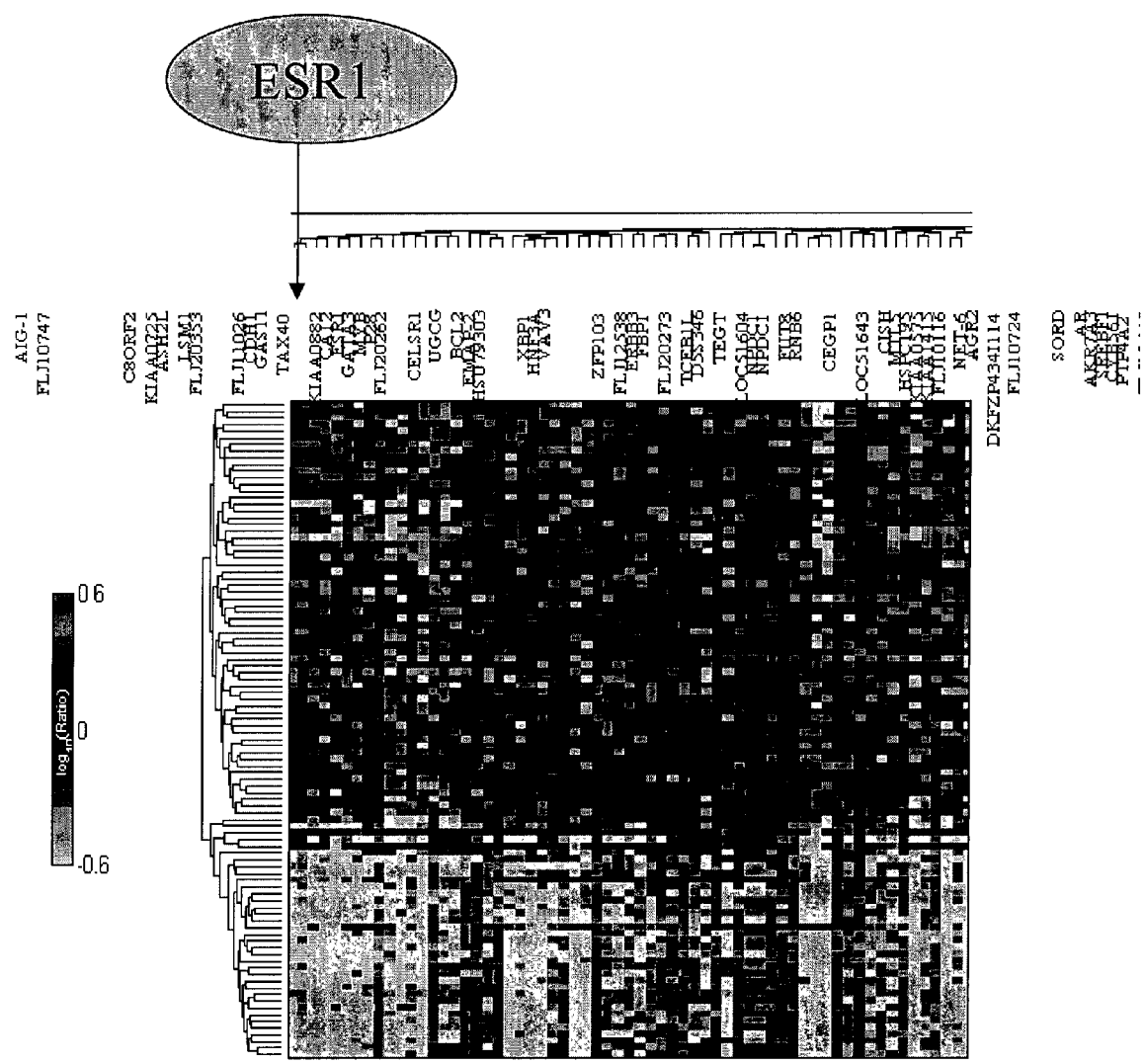

FIG. 4 A portion of unsupervised clustered results as shown in FIG. 3. ESR1 (the estrogen receptor gene) is coregulated with a set of genes that are strongly coregulated to form a dominant pattern.

Figure 5:
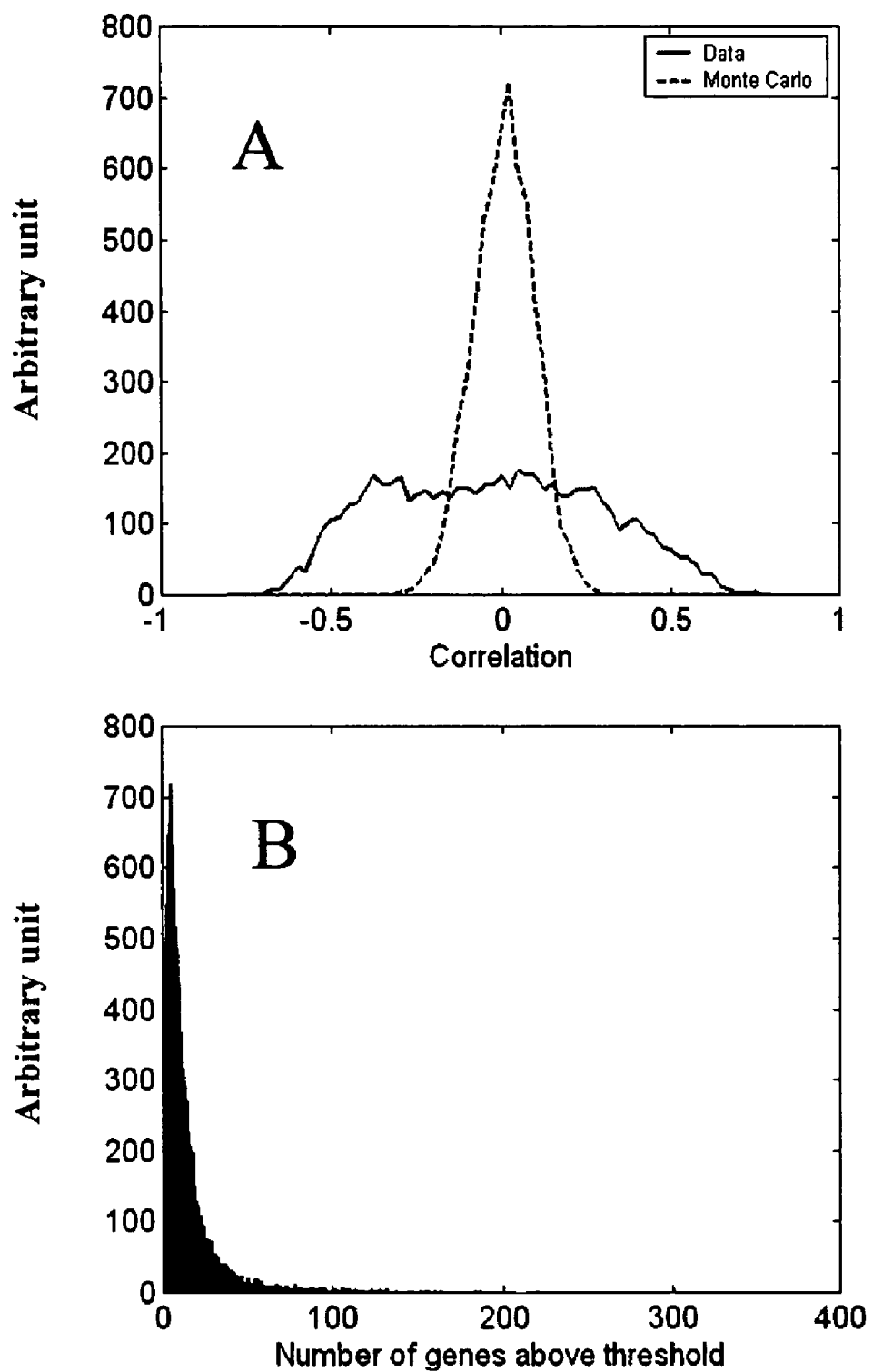

FIG. 5A Histogram of correlation coefficients of significant genes between their expression ratios and estrogen-receptor (ER) status (i.e., ER level). The histogram for experimental data is shown as a gray line. The results of one Monte-Carlo trial is shown in solid black. There are 2,460 genes whose expression data correlate with ER status at a level higher than 0.3 or anti-correlated with ER status at a level lower than −0.3.

FIG. 5B The distribution of the number of genes that satisfied the same selection criteria (amplitude of correlation above 0.3) from 10,000 Monte-Carlo runs. It is estimated that this set of 2,460 genes reports ER status at a confidence level of $p>99.99\%$.

Figure 6:
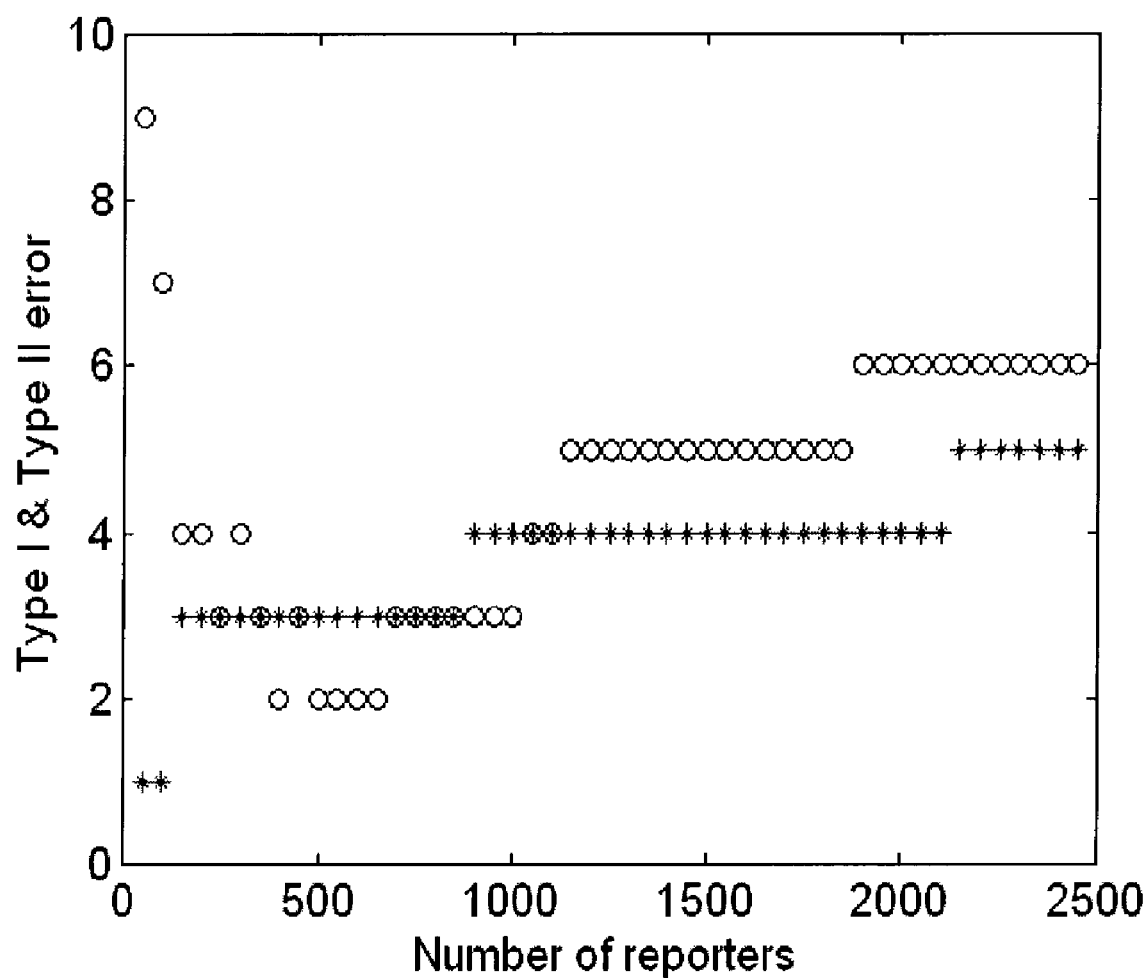

FIG. 6 Classification Type 1 and Type 2 error rates as a function of the number (out of 2,460) marker genes used in the classifier. The combined error rate is lowest when approximately 550 marker genes are used.

Figure 7:
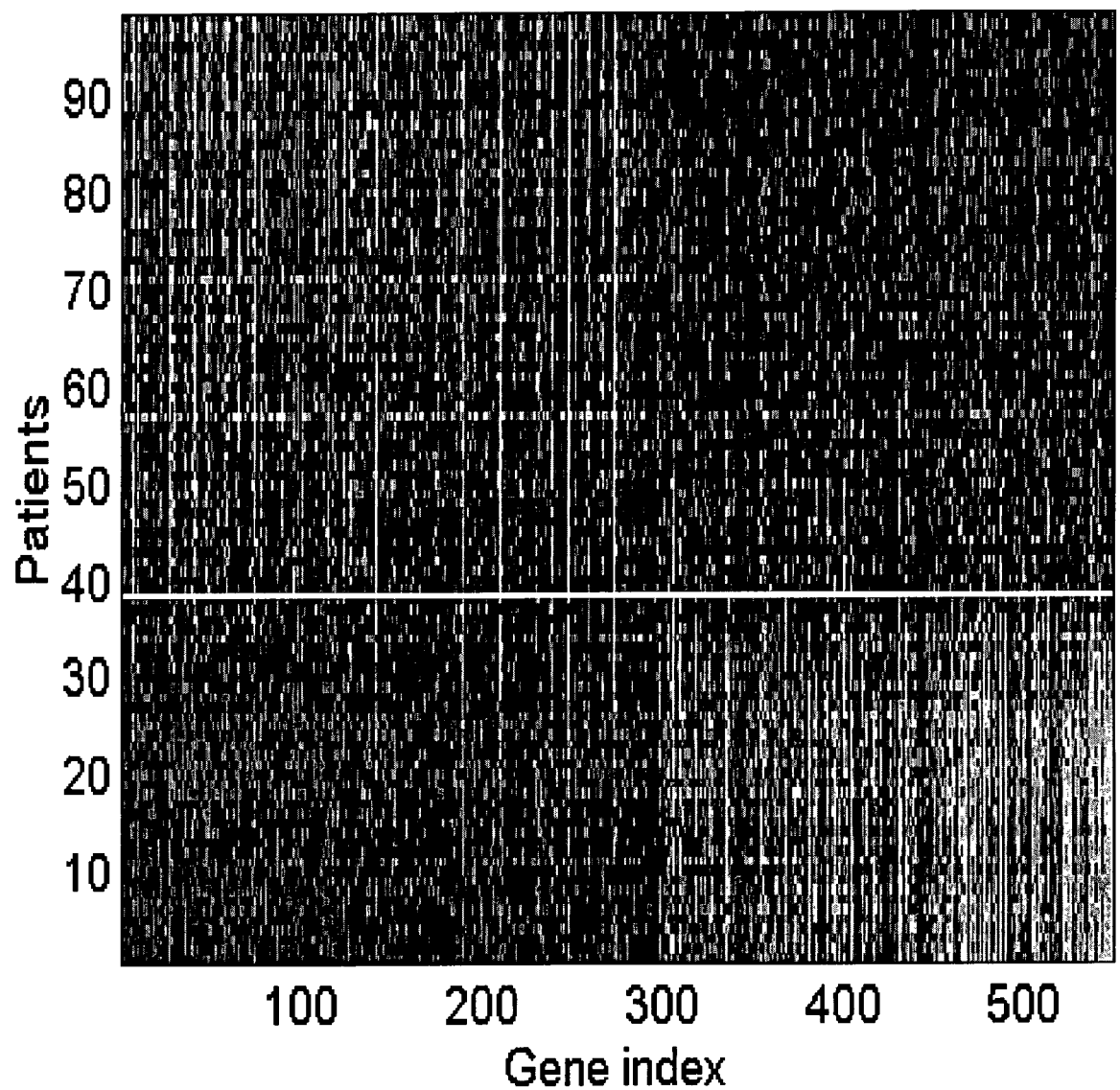

FIG. 7 Classification of 98 tumor samples as ER(+) or ER(−) based on expression levels of the 550 optimal marker genes. ER(+) samples (above white line) exhibit a clearly different expression pattern that ER(−) samples (below white line).

Figure 8:
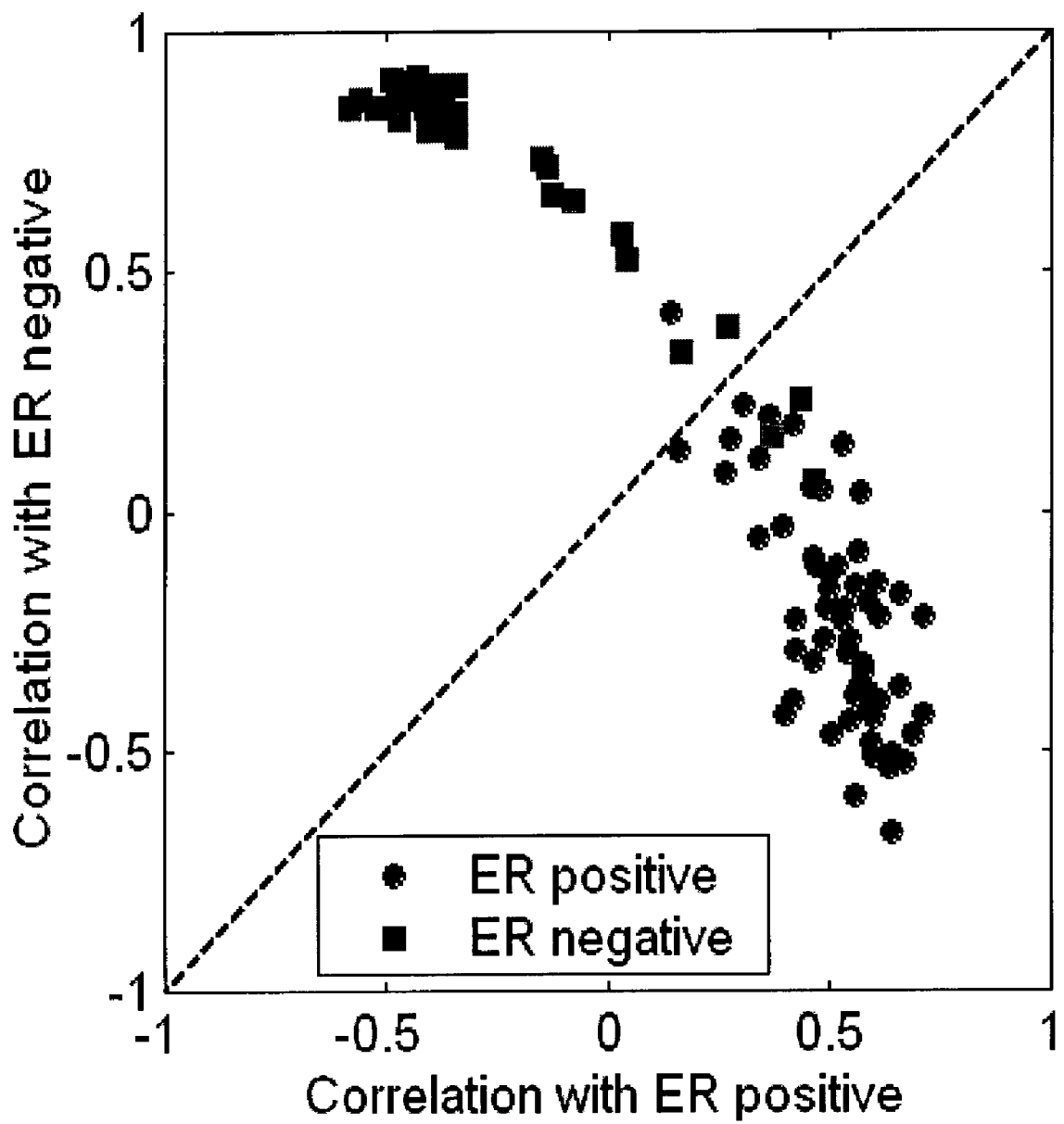

FIG. 8 Correlation between expression levels in samples from each patient and the average profile of the ER(−) group vs. correlation with the ER(+) group. Squares represent samples from clinically ER(−) patients; dots represent samples from clinically ER(+) patients.

Figure 9:
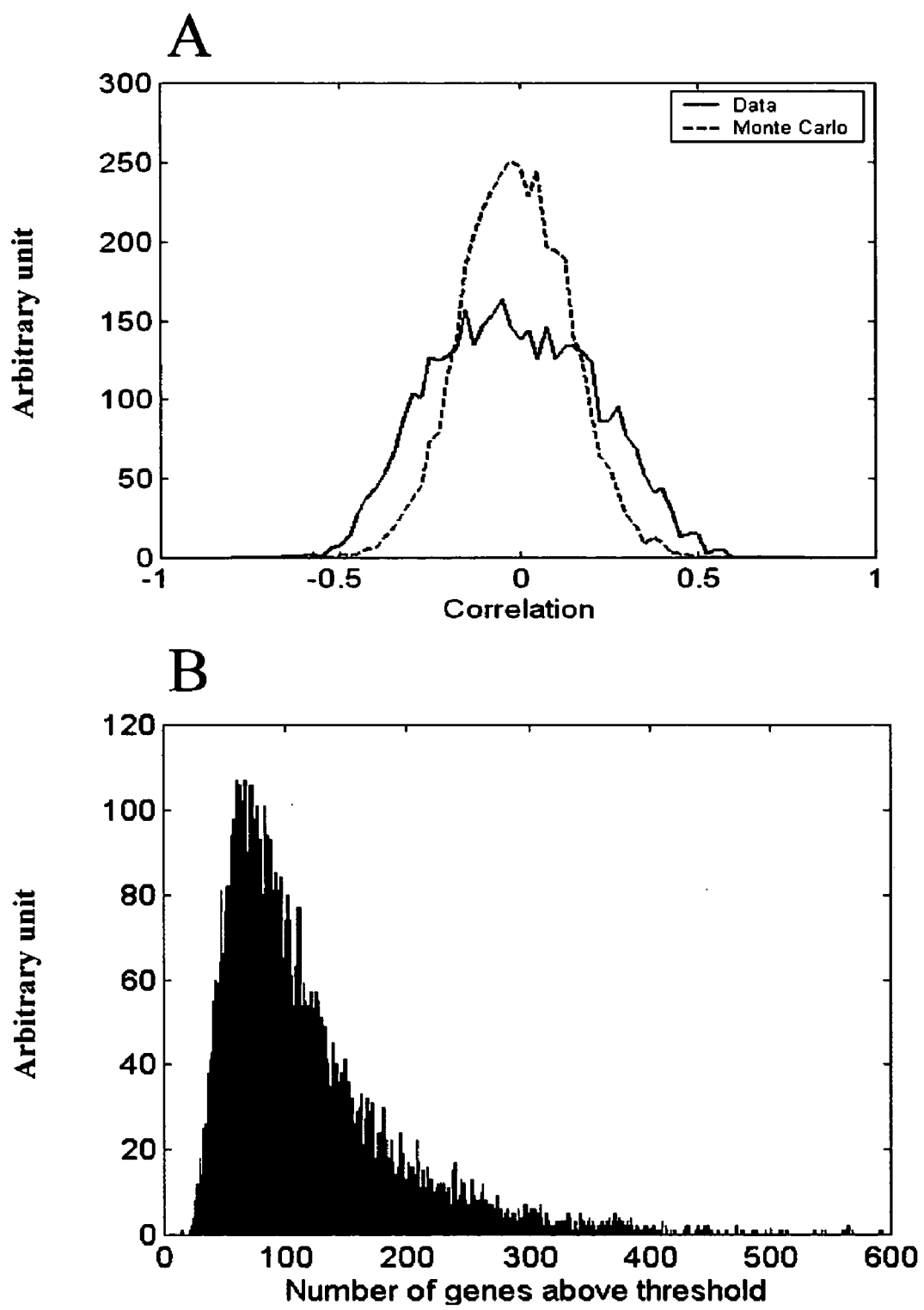

FIG. 9A Histogram of correlation coefficients of gene expression ratio of each significant gene with the BRCA1 mutation status is shown as a solid line. The dashed line indicates a frequency distribution obtained from one Monte-Carlo run. 430 genes exhibited an amplitude of correlation or anti-correlation greater than 0.35.

FIG. 9B Frequency distribution of the number of genes that exhibit an amplitude of correlation or anti-correlation greater than 0.35 for the 10,000 Monte-Carlo run control. Mean=115. $p(n>430)=0.48\%$ and $p(>430/2)=9.0\%$.

Figure 10:
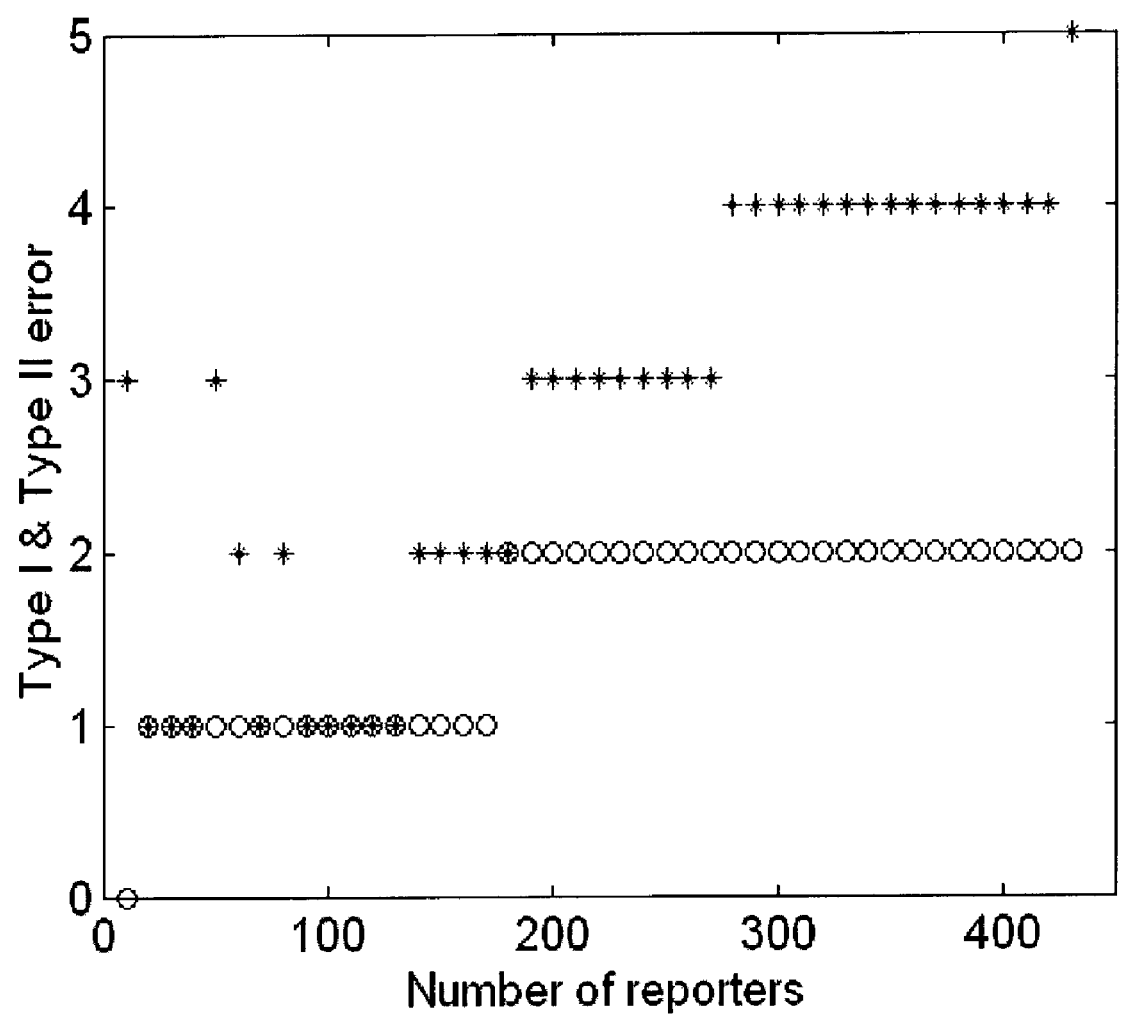

FIG. 10 Classification type 1 and type 2 error rates as a function of the number of discriminating genes used in the classifier (template). The combined error rate is lowest when approximately 100 discriminating marker genes are used.

Figure 11A:
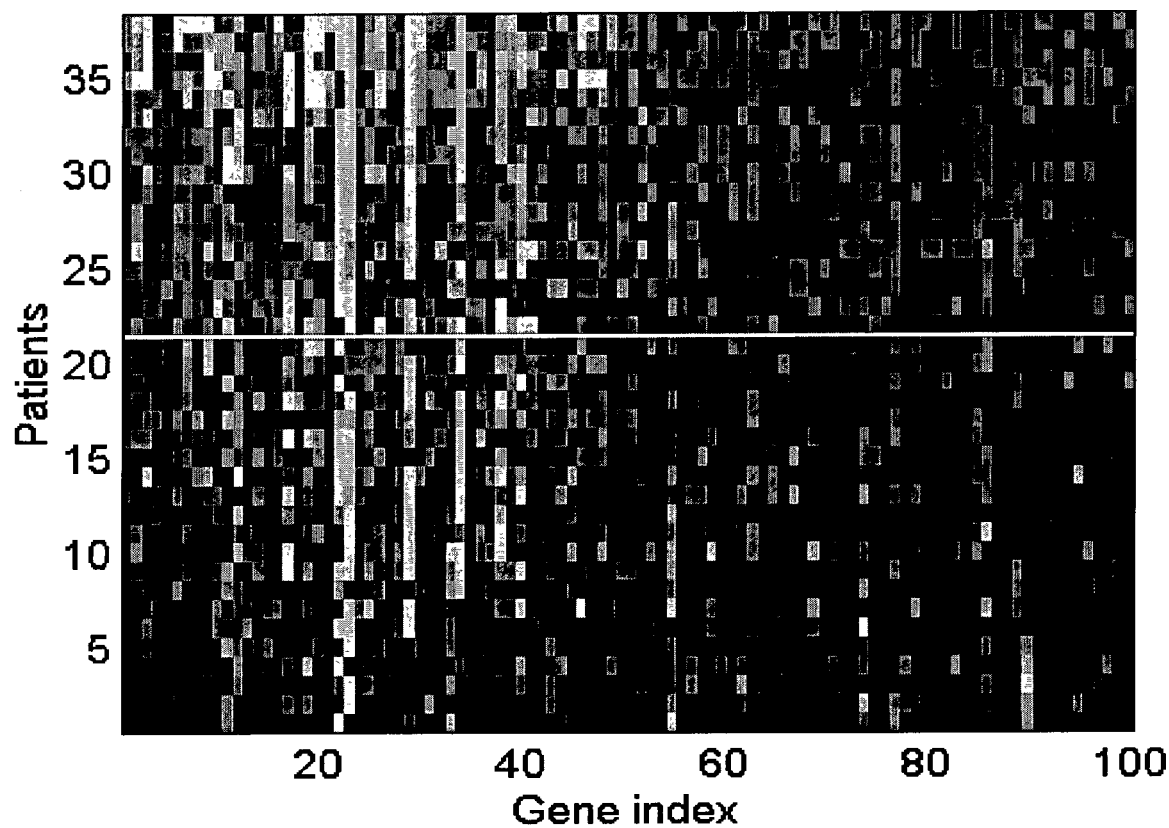

FIG. 11A The classification of 38 tumors in the ER(−) group into two subgroups, BRCA1 and sporadic, by using the optimal set of 100 discriminating marker genes. Patients above the white line are characterized by BRCA1-related patterns.

Figure 11B:
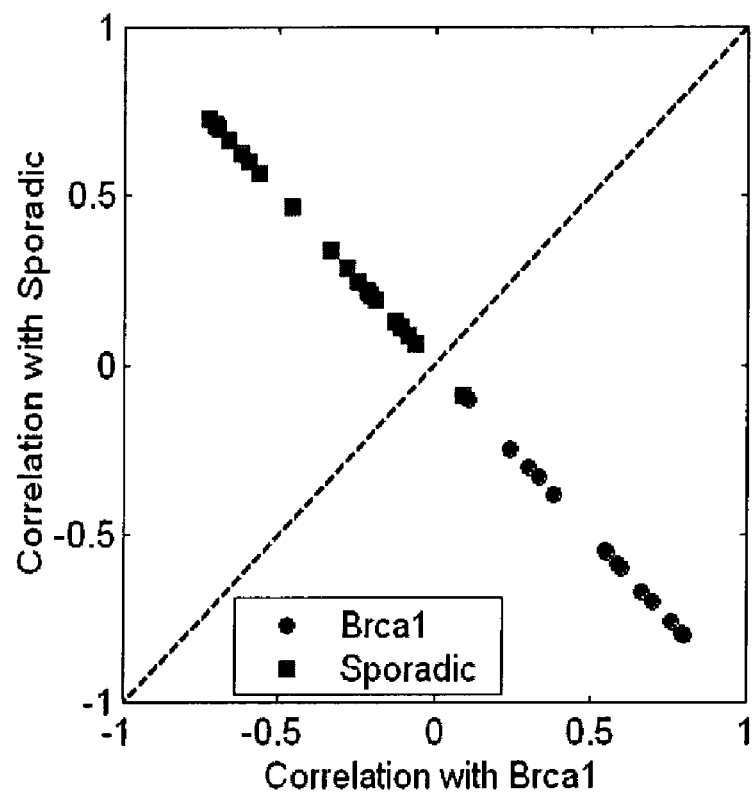

FIG. 11B Correlation between expression levels in samples from each ER(−) patient and the average profile of the BRCA1 group vs. correlation with the sporadic group. Squares represent samples from patients with sporadic-type tumors; dots represent samples from patients carrying the BRCA1 mutation.

Figure 12:
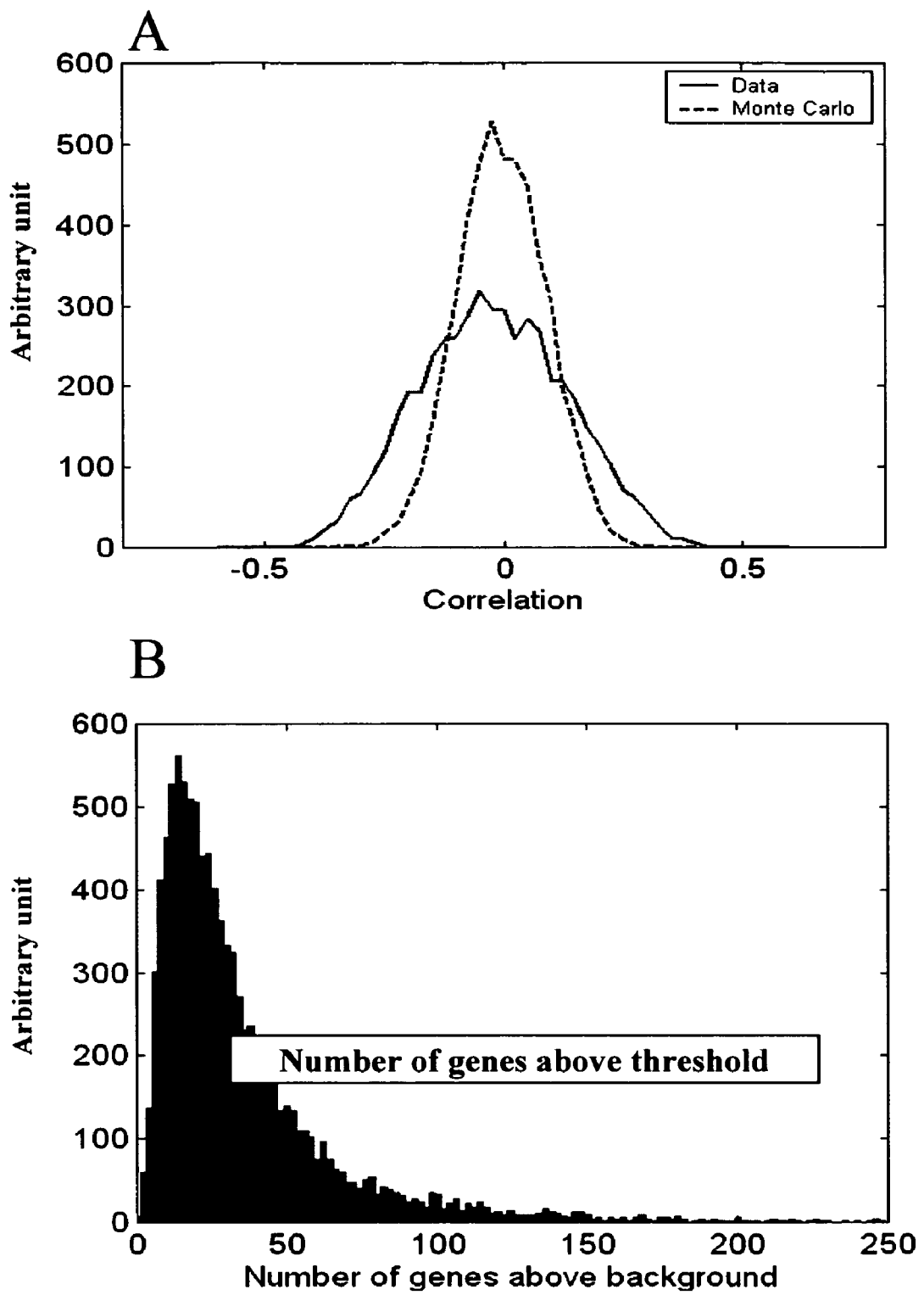

FIG. 12A Histogram of correlation coefficients of gene expression ratio of each significant gene with the prognostic category (distant metastases group and no distant metastases group) is shown as a solid line. The distribution obtained from one Monte-Carlo run is shown as a dashed line. The amplitude of correlation or anti-correlation of 231 marker genes is greater than 0.3.

FIG. 12B Frequency distribution of the number of genes whose amplitude of correlation or anti-correlation was greater than 0.3 for 10,000 Monte-Carlo runs.

Figure 13:
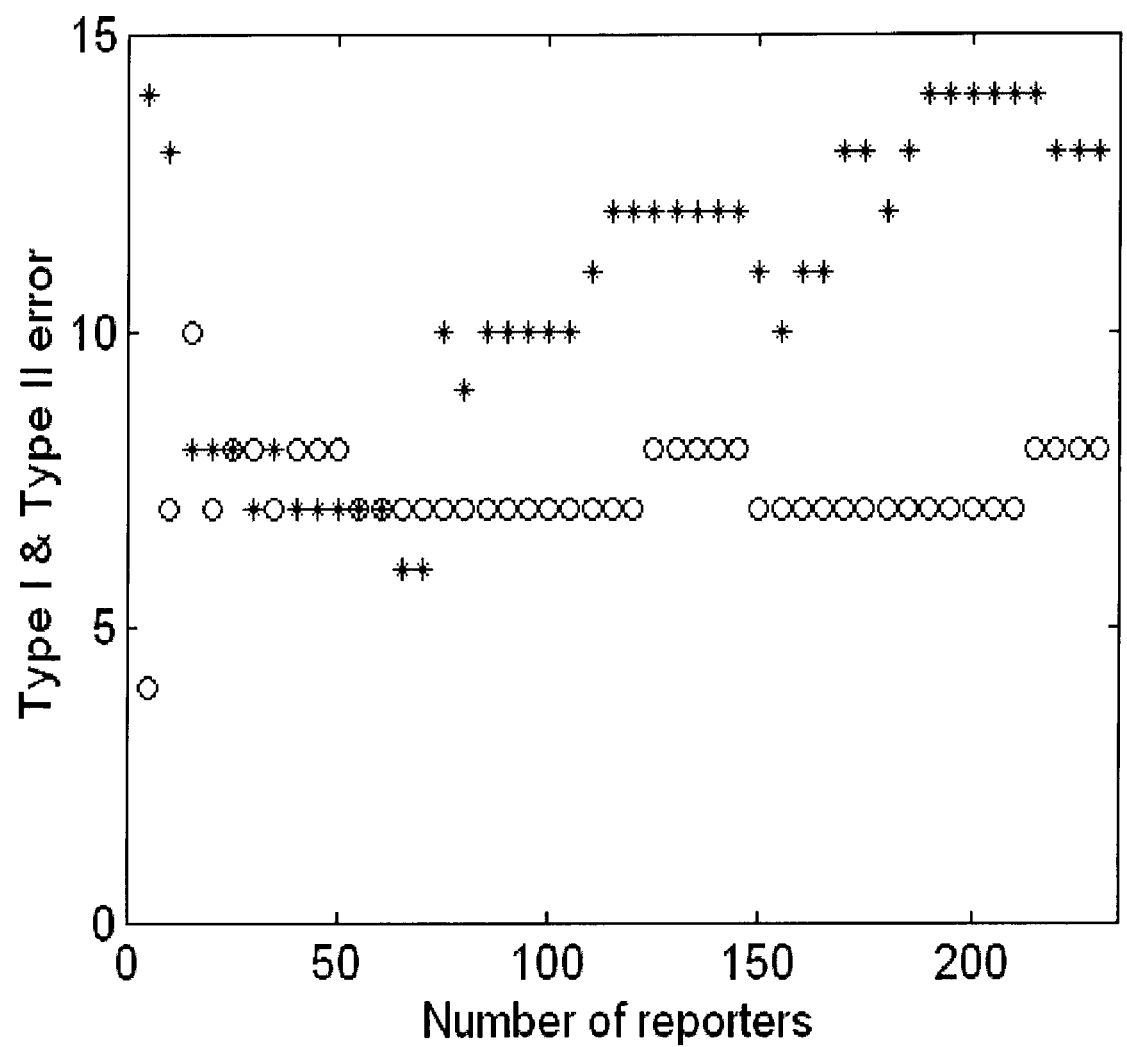

FIG. 13 The distant metastases group classification error rate for type 1 and type 2 as a function of the number of discriminating genes used in the classifier. The combined error rate is lowest when approximately 70 discriminating marker genes are used.

Figure 14:
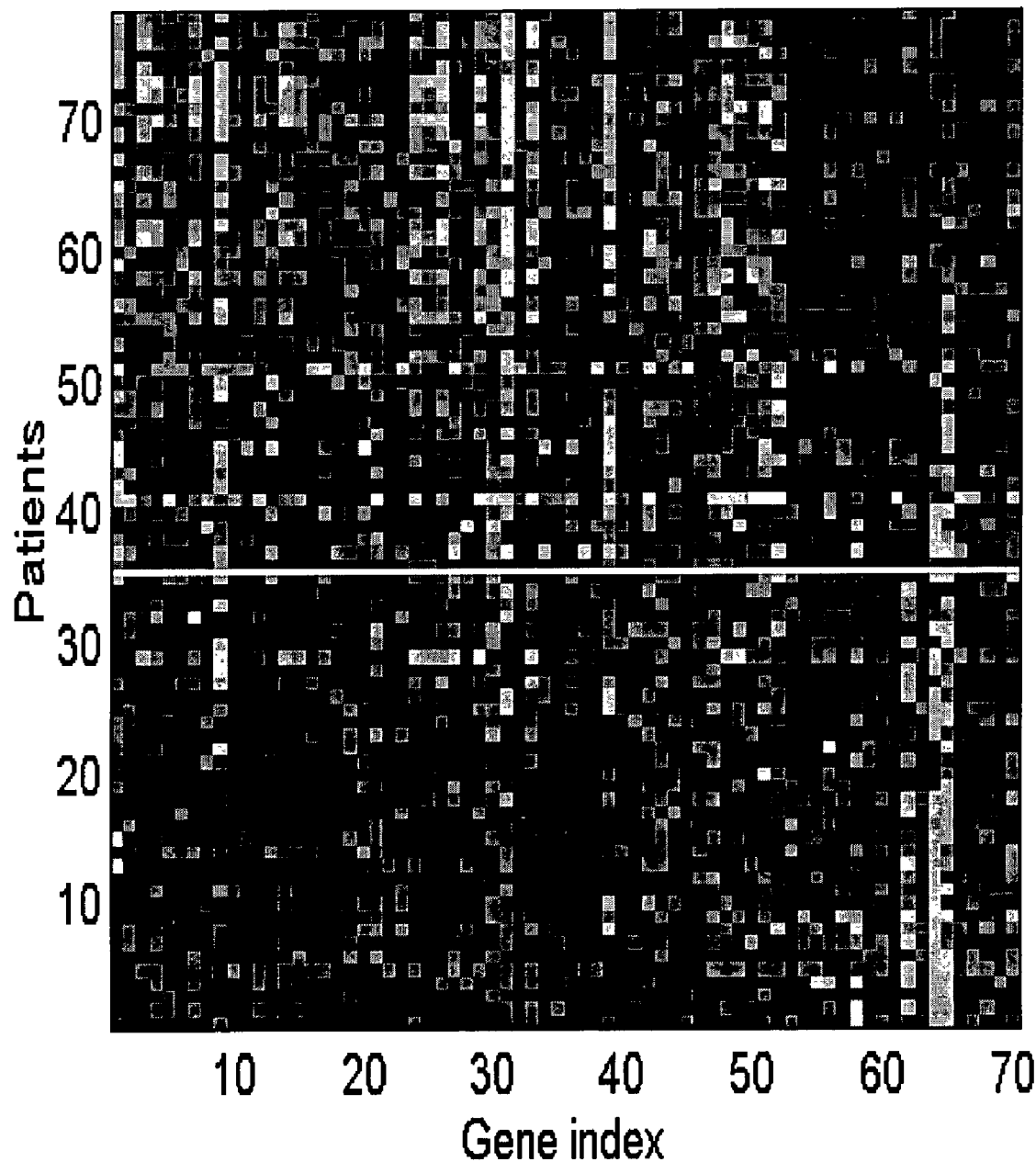

FIG. 14 Classification of 78 sporadic tumors into two prognostic groups, distant metastases (poor prognosis) and no distant metastases (good prognosis) using the optimal set of 70 discriminating marker genes. Patients above the white line are characterized by good prognosis. Patients below the white line are characterized by poor prognosis.

Figure 15:
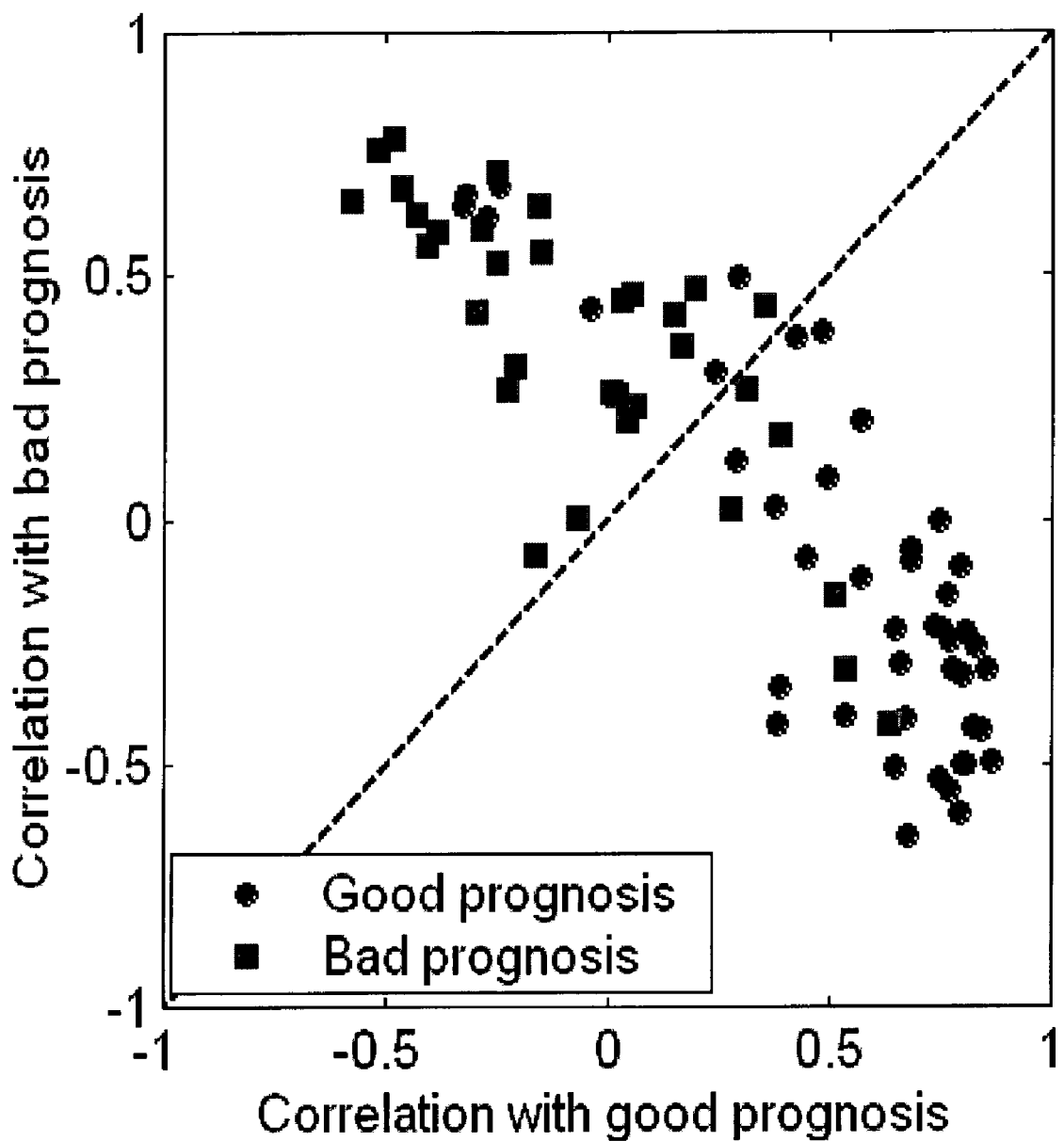

FIG. 15 Correlation between expression levels in samples from each patient and the average profile of the good prognosis group vs. correlation with the poor prognosis group. Squares represent samples from patients having a poor prognosis; dots represent samples from patients having a good prognosis. Red squares represent the 'reoccurred' patients and the blue dots represent the 'non-reoccurred'. A total of 13 out of 78 were mis-classified.

Figure 16:
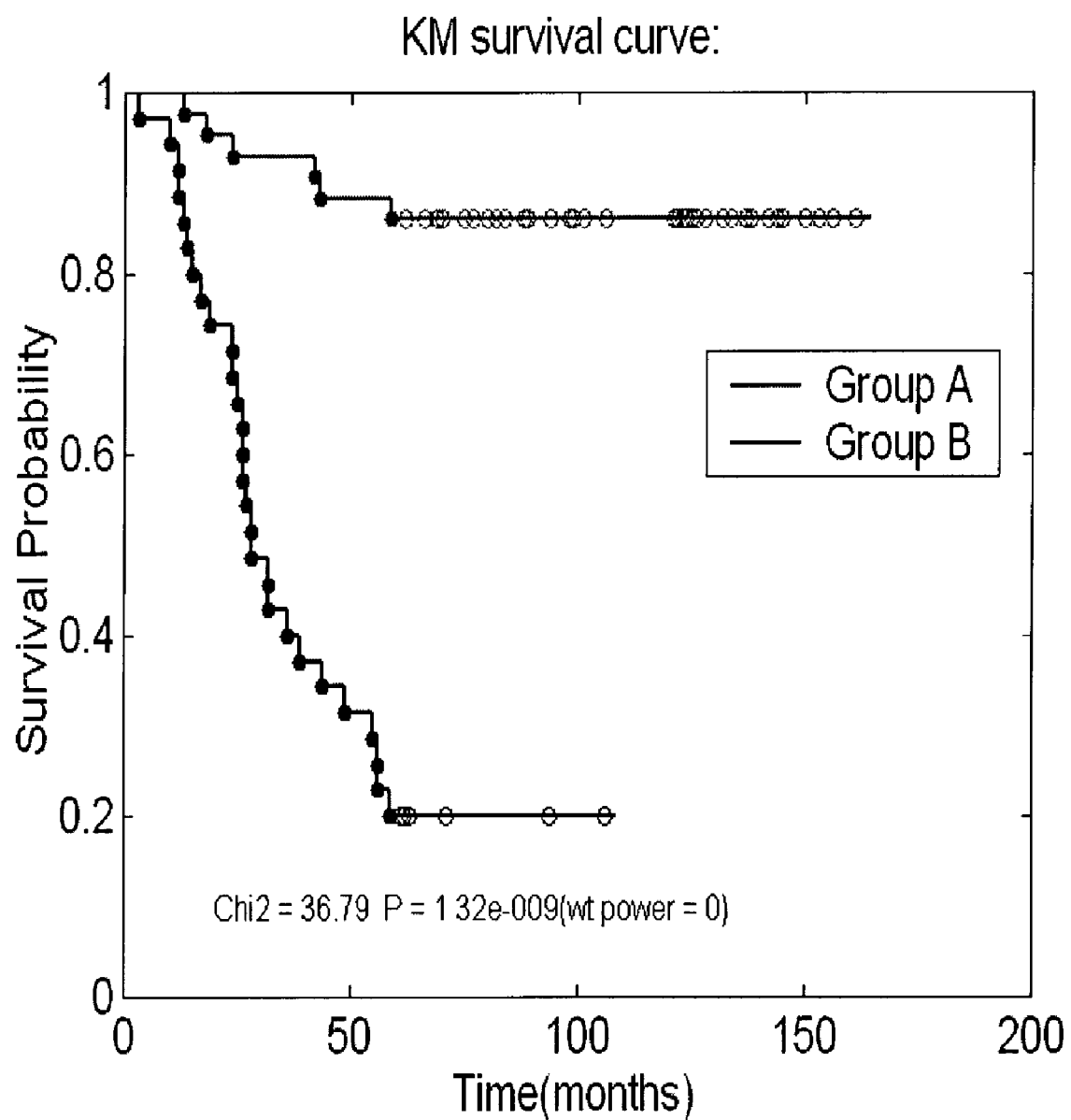

FIG. 16 The reoccurrence probability as a function of time since diagnosis. Group A and group B were predicted by using a leave-one-out method based on the optimal set of 70 discriminating marker genes. The 43 patients in group A consists of 37 patients from the no distant metastases group and 6 patients from the distant metastases group. The 35 patients in group B consists of 28 patients from the distant metastases group and 7 patients from the no distant metastases group.

Figure 17:
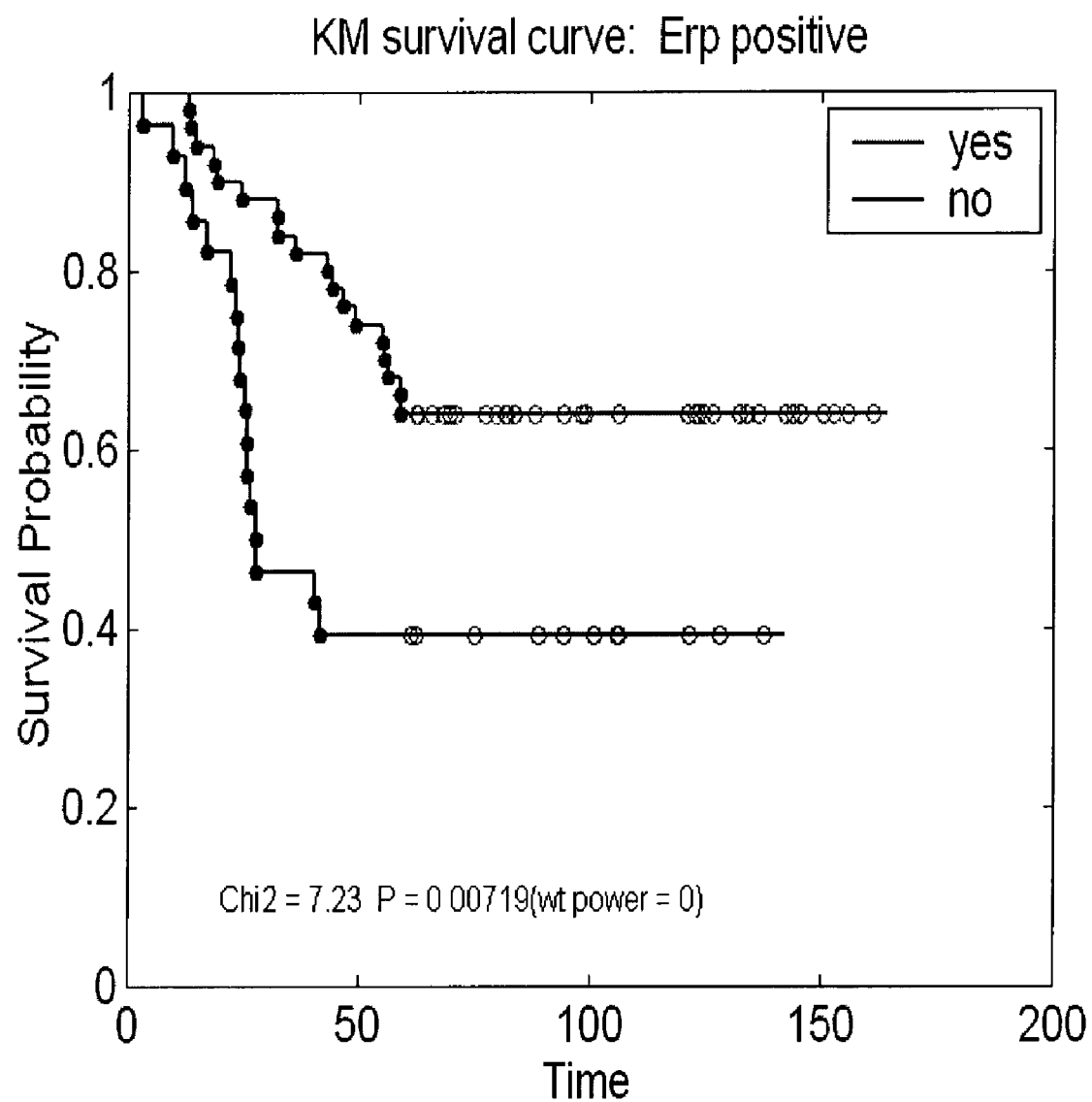

FIG. 17 The distant metastases probability as a function of time since diagnosis for ER(+) (yes) or ER(−) (no) individuals.

Figure 18:
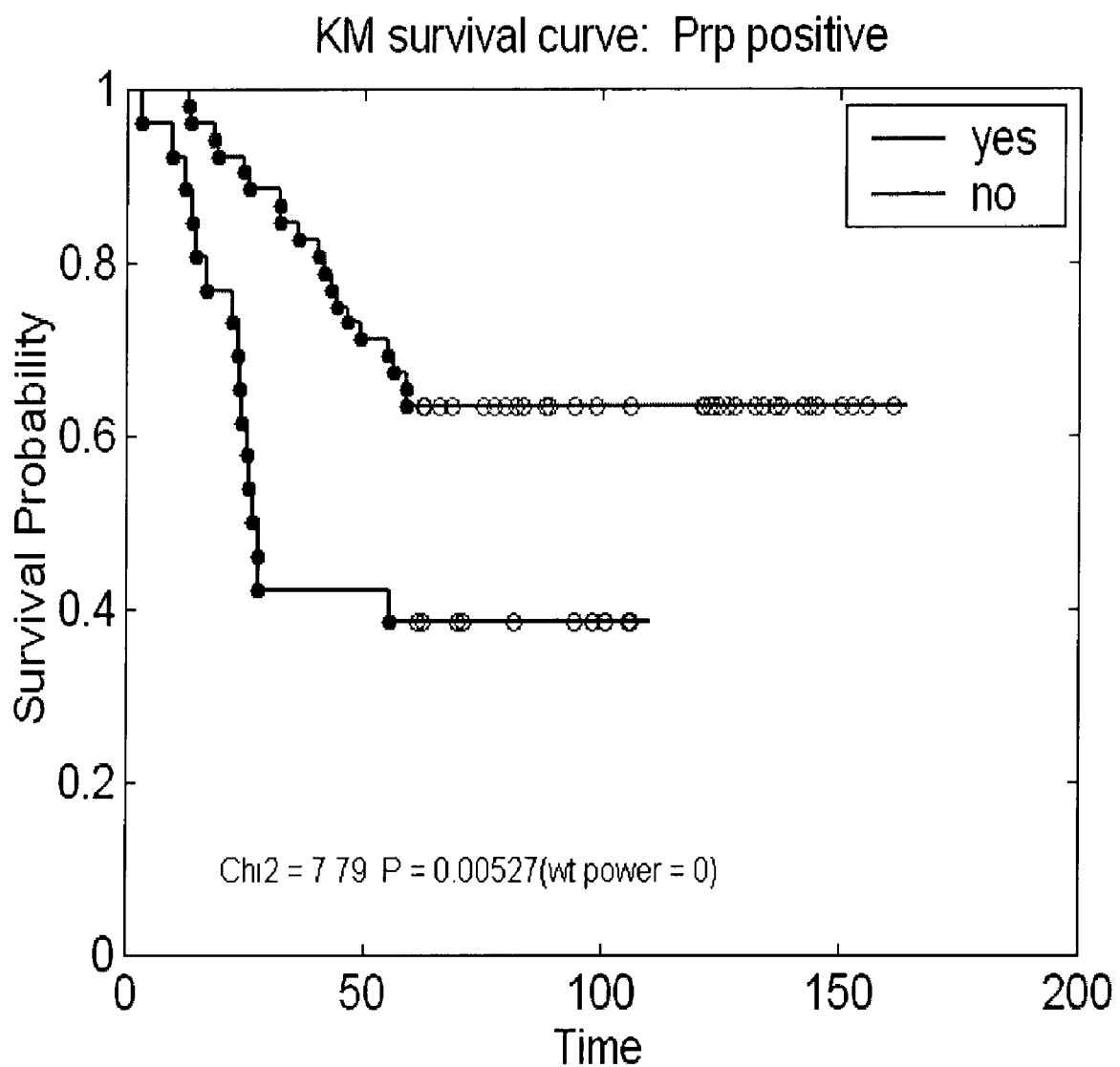

FIG. 18 The distant metastases probability as a function of time since diagnosis for progesterone receptor (PR)(+) (yes) or PR(−) (no) individuals.

Figure 19A:
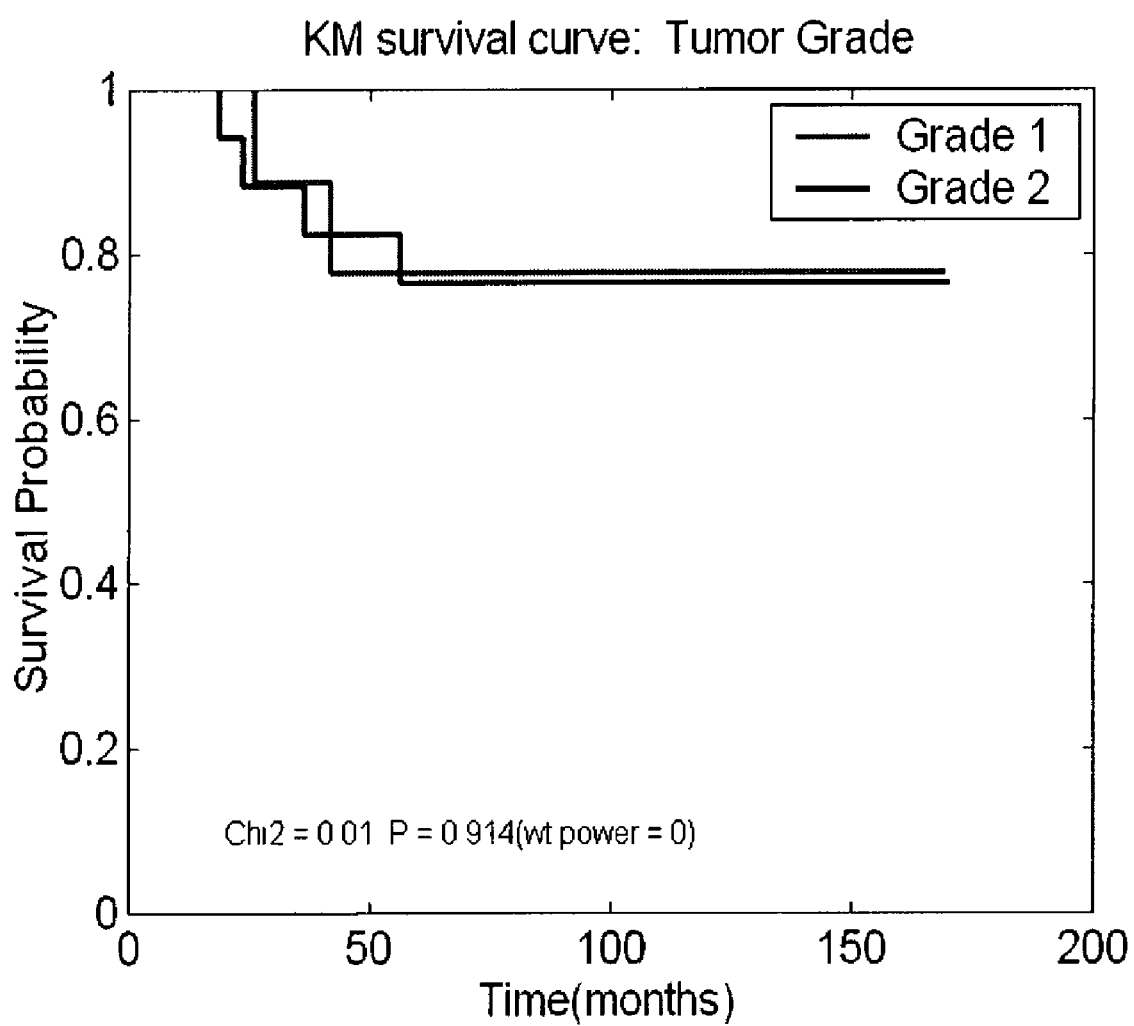

FIG. 19A, B The distant metastases probability as a function of time since diagnosis. Groups were defined by the tumor grades.

Figure 20A:
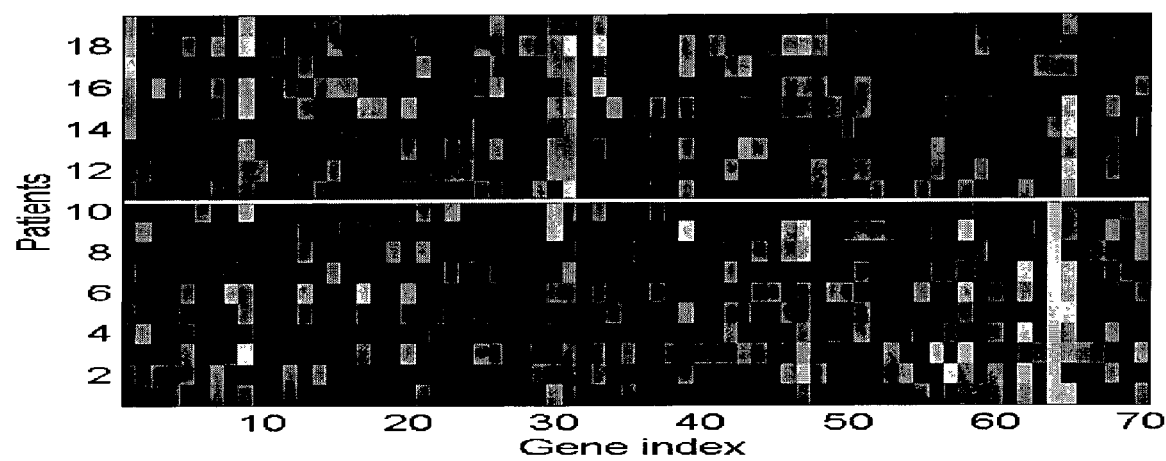

FIG. 20A Classification of 19 independent sporadic tumors into two prognostic groups, distant metastases and no distant metastases, using the 70 optimal marker genes. Patients above the white line have a good prognosis. Patients below the white line have a poor prognosis.

Figure 20B:
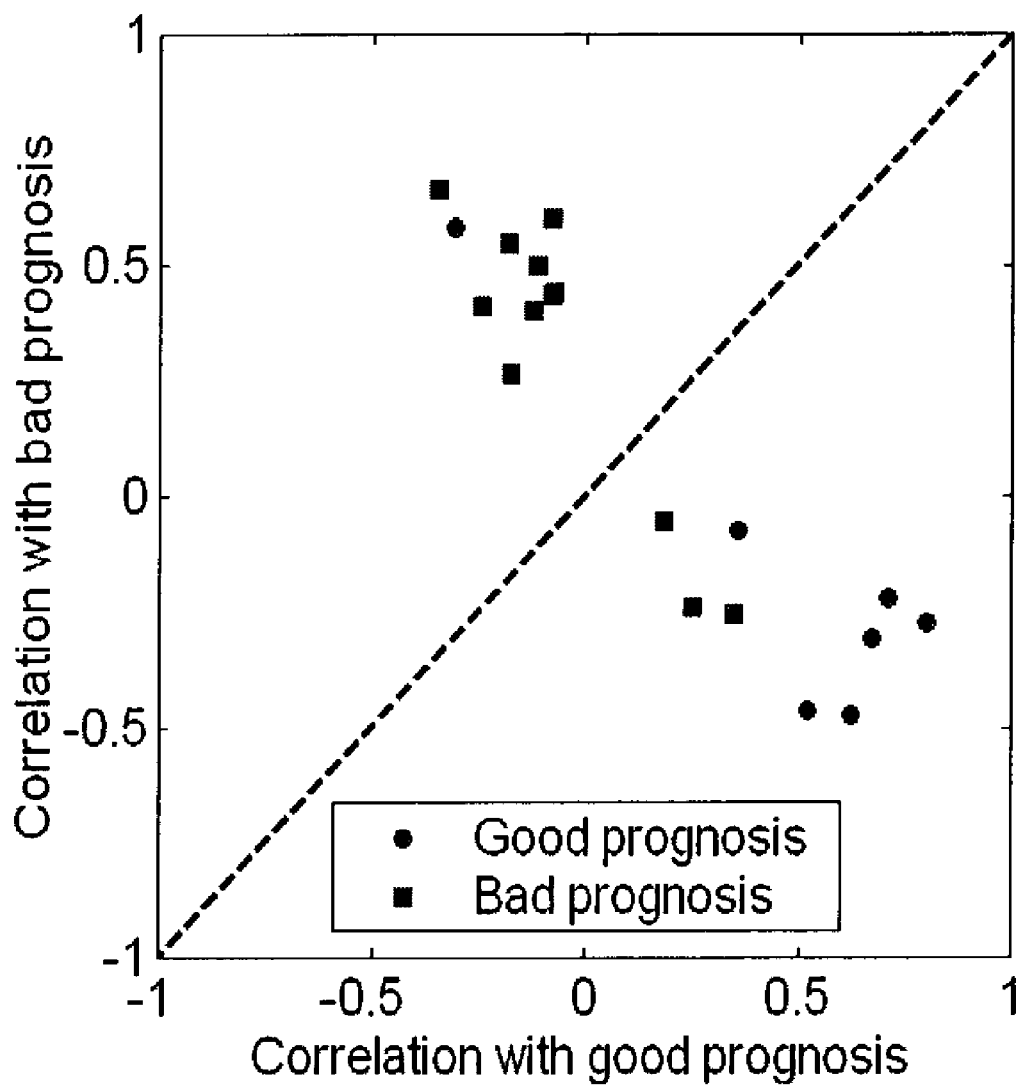

FIG. 20B Correlation between expression ratios of each patient and the average expression ratio of the good prognosis group is defined by the training set versus the correlation between expression ratios of each patient and the average expression ratio of the poor prognosis training set. Of nine patients in the good prognosis group, three are from the "distant metastases group"; of ten patients in the good prognosis group, one patient is from the "no distant metastases group". This error rate of 4 out of 19 is consistent with 13 out of 78 for the initial 78 patients.

Figure 20C:
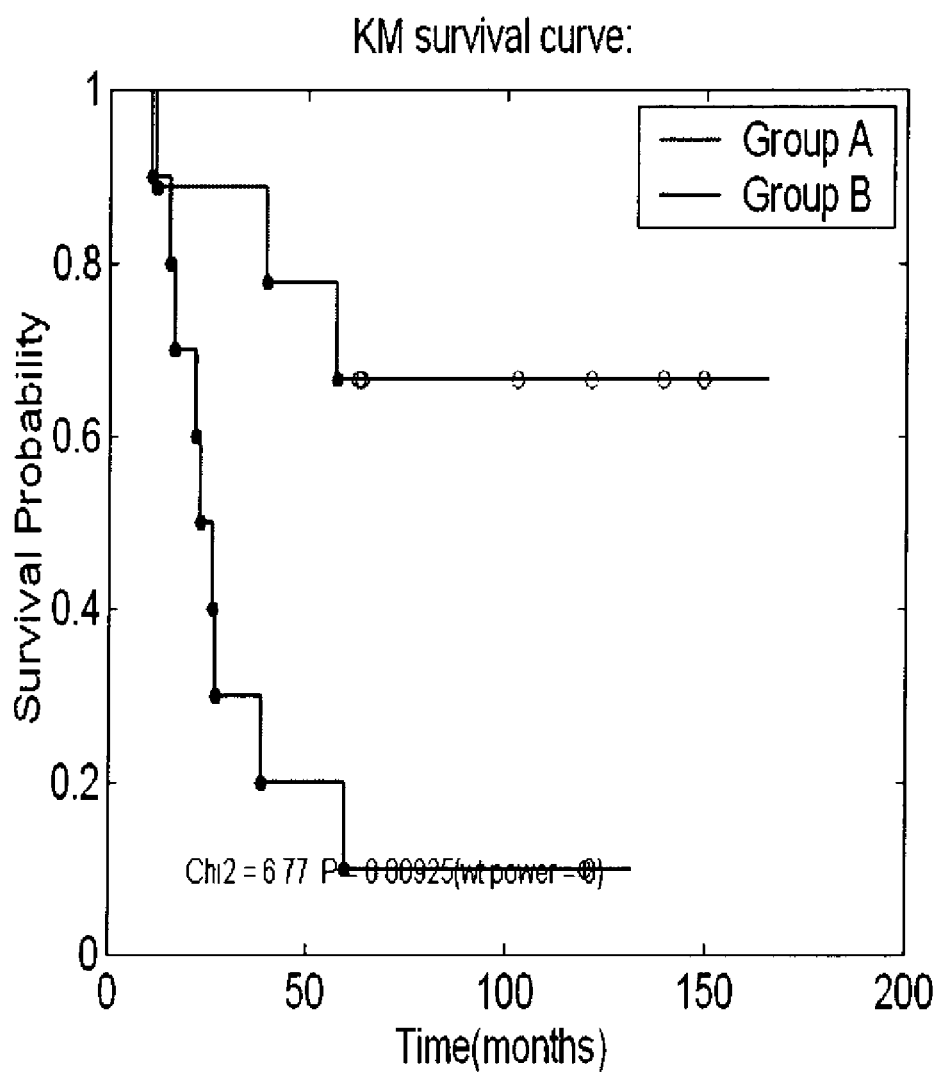

FIG. 20C The reoccurrence probability as a function of time since diagnosis for two groups predicted based on expression of the optimal 70 marker genes.

Figure 21A:
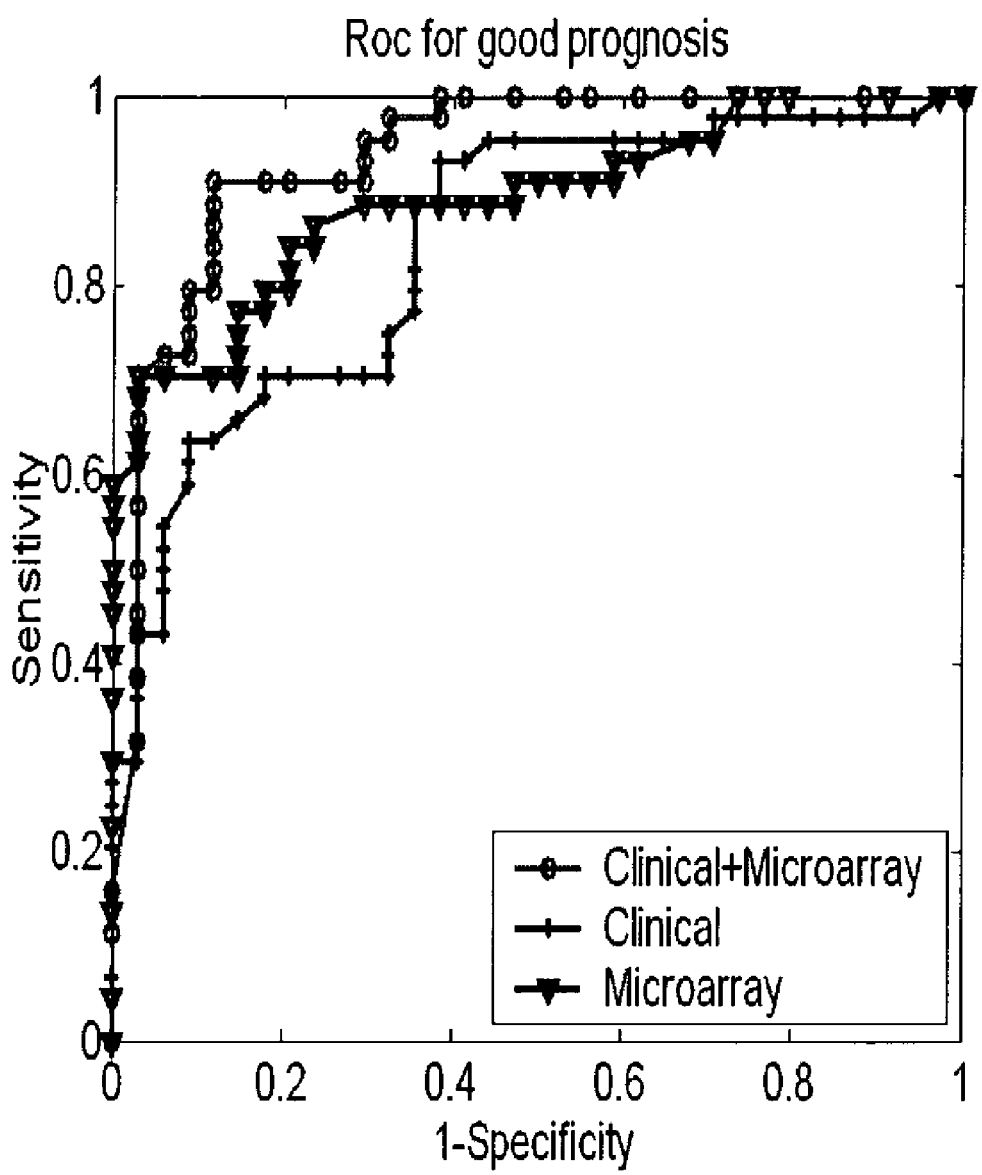

FIG. 21A Sensitivity vs. 1-specificity for good prognosis classification.

Figure 21B:
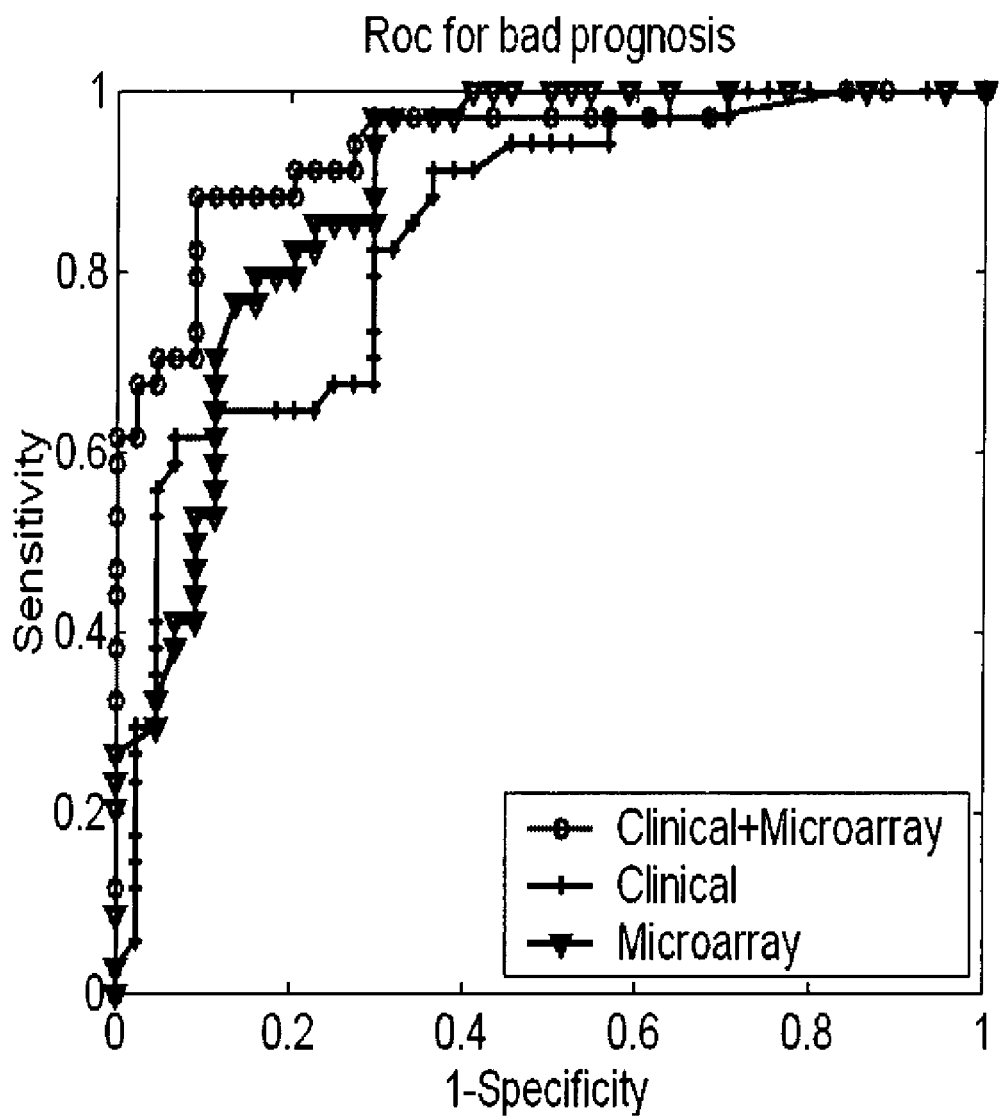

FIG. 21B Sensitivity vs. 1-specificity for poor prognosis classification.

Figure 21C:
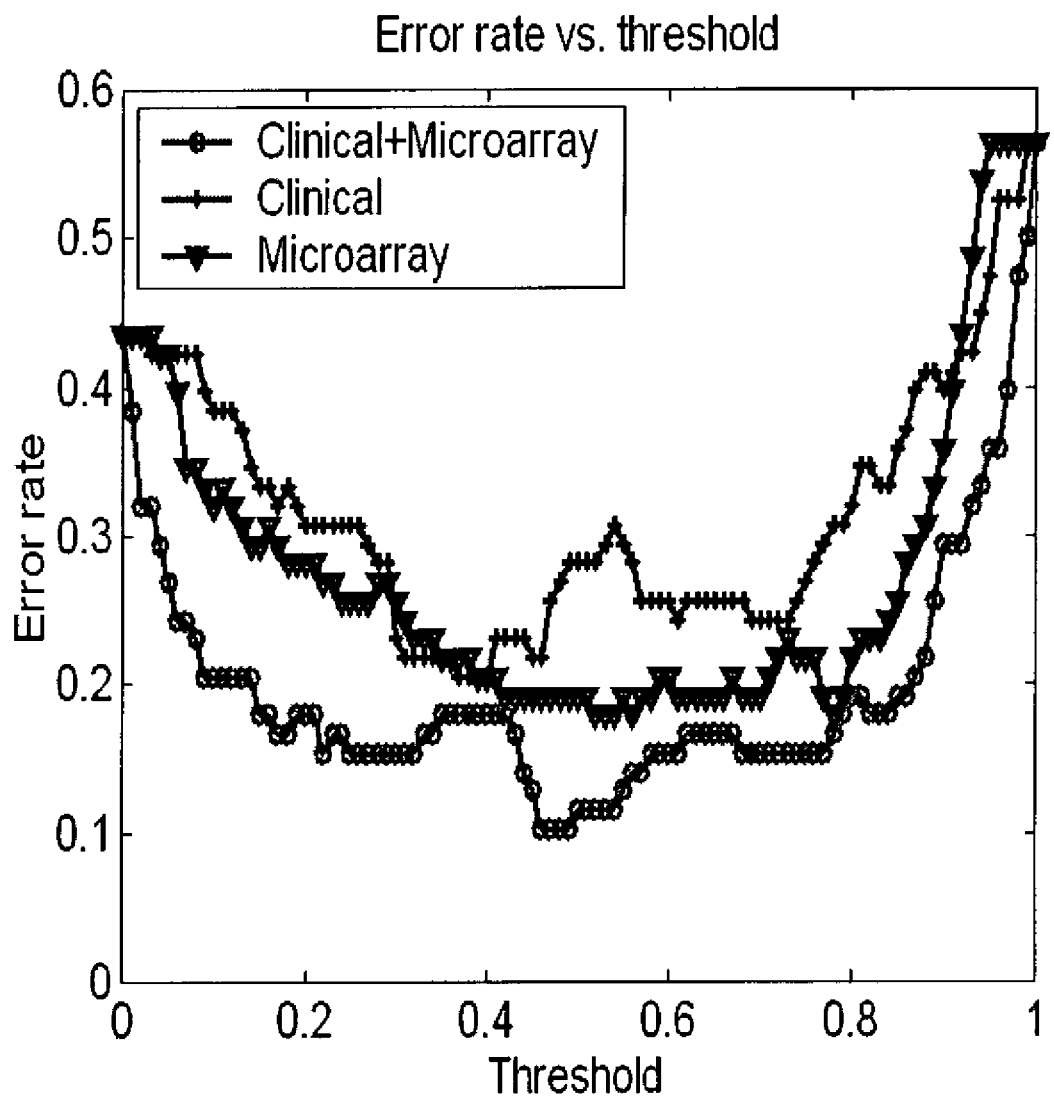

FIG. 21C Total error rate as a function of threshold on the modeled likelihood. Six clinical parameters (ER status, PR status, tumor grade, tumor size, patient age, and presence or absence of angioinvasion) were used to perform the clinical modeling.

Figure 22:
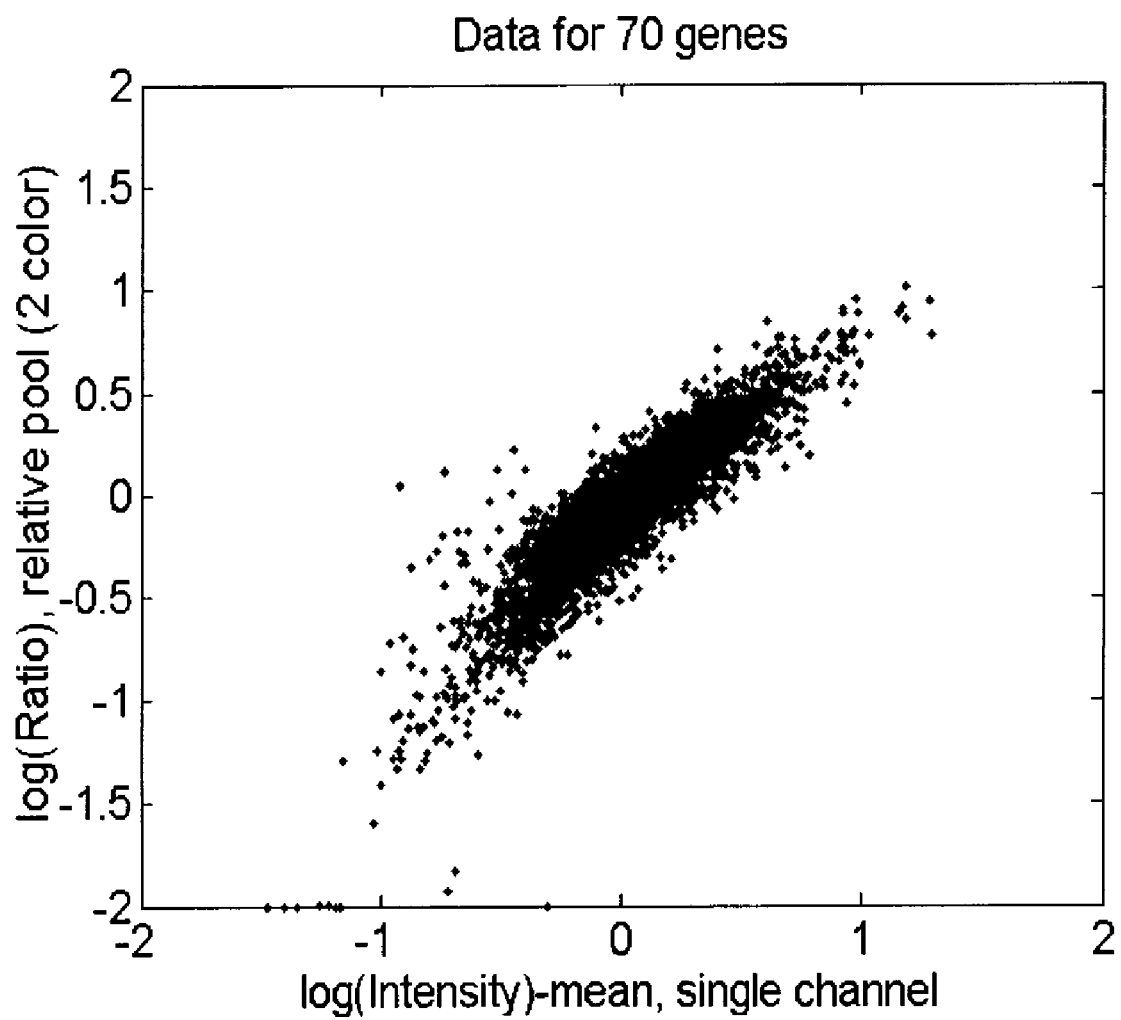

FIG. 22 Comparison of the log(ratio) of individual samples using the "material sample pool" vs. mean subtracted log (intensity) using the "mathematical sample pool" for 70 reporter genes in the 78 sporadic tumor samples. The "material sample pool" was constructed from the 78 sporadic tumor samples.

Figure 23A:
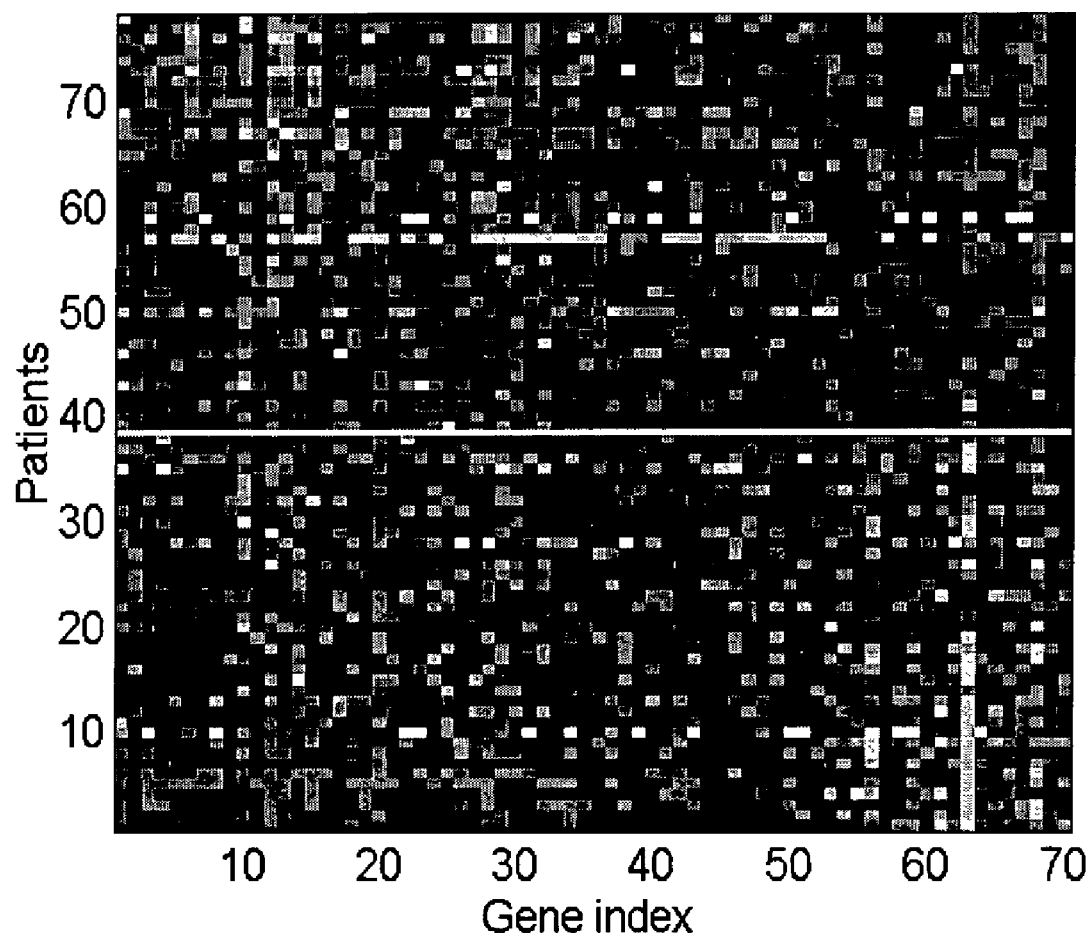

FIG. 23A Results of the "leave one out" cross validation based on single channel data. Samples are grouped according to each sample's coefficient of correlation to the average "good prognosis" profile and "poor prognosis" profile for the 70 genes examined. The white line separates samples from patients classified as having poor prognoses (below) and good prognoses (above).

Figure 23B:
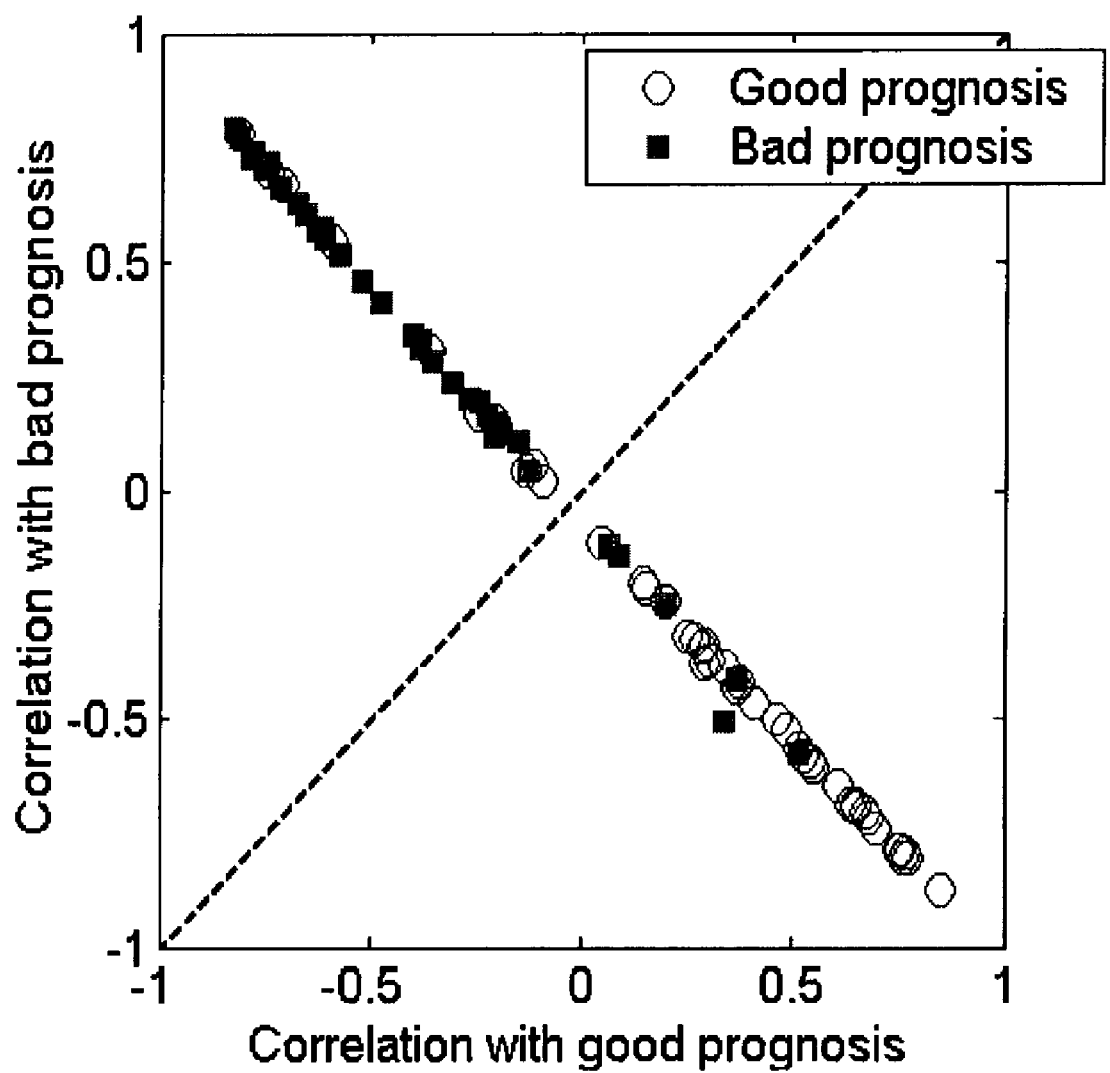

FIG. 23B Scatter plot of coefficients of correlation to the average expression in "good prognosis" samples and "poor prognosis" samples. The false positive rate (i.e., rate of incorrectly classifying a sample as being from a patient having a good prognosis as being one from a patient having a poor prognosis) was 10 out of 44, and the false negative rate is 6 out of 34.

Figure 24A:
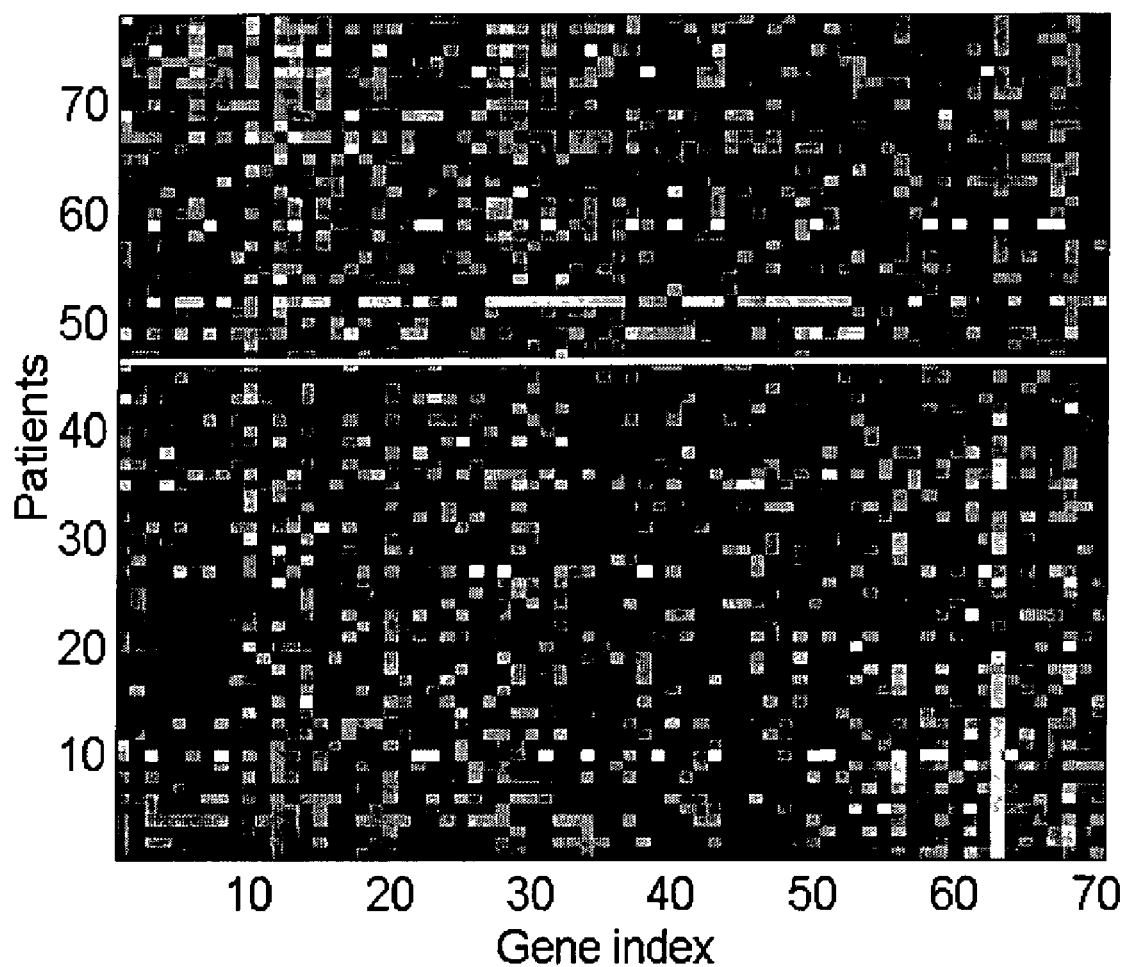

FIG. 24A Single-channel hybridization data for samples ranked according to the coefficients of correlation with the good prognosis classifier. Samples classified as "good prognosis" lie above the white line, and those classified as "poor prognosis" lie below.

Figure 24B:
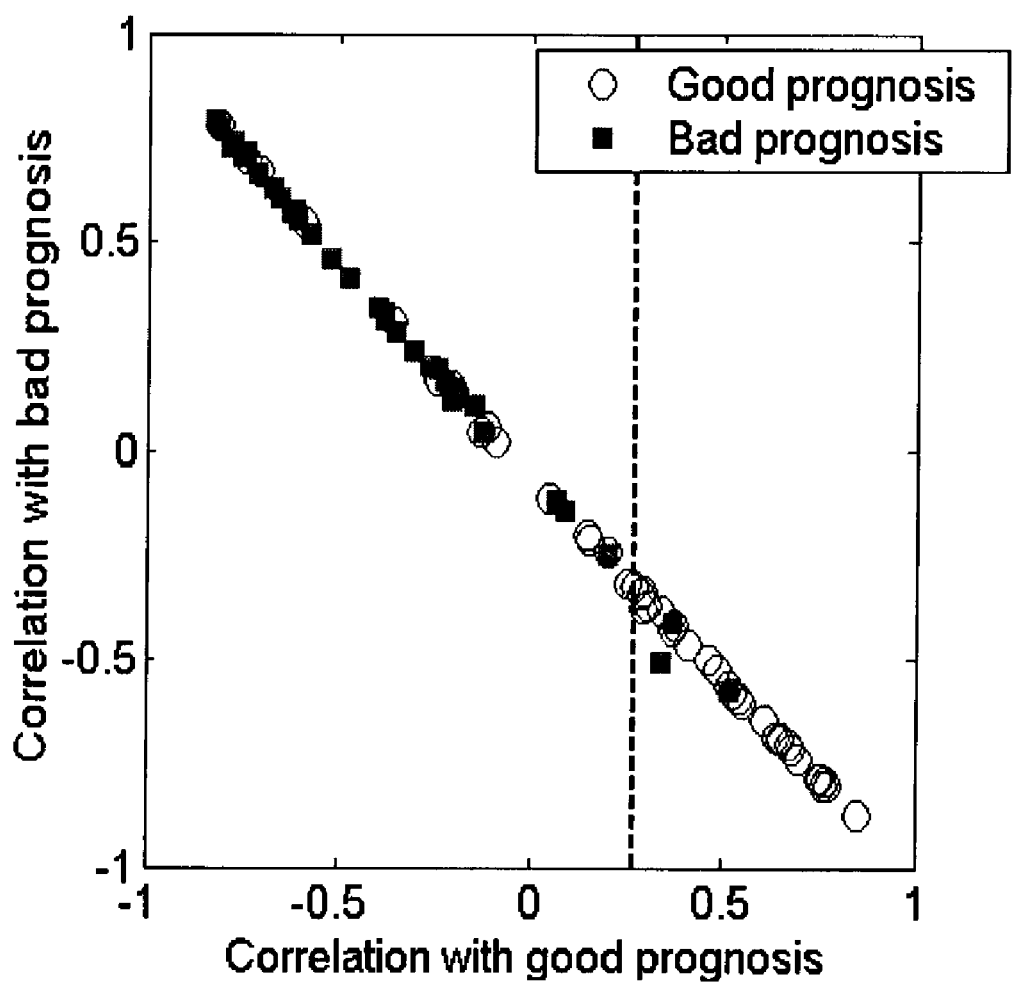

FIG. 24B Scatterplot of sample correlation coefficients, with three incorrectly classified samples lying to the right of the threshold correlation coefficient value. The threshold correlation value was set at 0.2727 to limit the false negatives to approximately 10% of the samples.

5. DETAILED DESCRIPTION OF THE INVENTION

5.1 Introduction

The invention relates to sets of genetic markers whose expression patterns correlate with important characteristics of breast cancer tumors, i.e., estrogen receptor (ER) status, BRCA1 status, and the likelihood of relapse (i.e., distant metastasis or poor prognosis). More specifically, the invention provides for sets of genetic markers that can distinguish the following three clinical conditions. First, the invention relates to sets of markers whose expression correlates with the ER status of a patient, and which can be used to distinguish ER(+) from ER(-) patients. ER status is a useful prognostic indicator, and an indicator of the likelihood that a patient will respond to certain therapies, such as tamoxifen. Also, among women who are ER positive the response rate (over 50%) to hormonal therapy is much higher than the response rate (less 10%) in patients whose ER status is negative. In patients with ER positive tumors the possibility of achieving a hormonal response is directly proportional to the level ER (P. Clabresi and P. S. Schein, MEDICAL ONCOLOGY (2ND ED.), McGraw-Hill, Inc., New York (1993)). Second, the invention further relates to sets of markers whose expression correlates with the presence of BRCA1 mutations, and which can be used to distinguish BRCA1-type tumors from sporadic tumors. Third, the invention relates to genetic markers whose expression correlates with clinical prognosis, and which can be used to distinguish patients having good prognoses (i.e., no distant metastases of a tumor within five years) from poor prognoses (i.e., distant metastases of a tumor within five years). Methods are provided for use of these markers to distinguish between these patient groups, and to determine general courses of treatment. Microarrays comprising these markers are also provided, as well as methods of constructing such microarrays. Each marker corresponds to a gene in the human genome, i.e., such marker is identifiable as all or a portion of a gene. Finally, because each of the above markers correlates with a certain breast cancer-related conditions, the markers, or the proteins they encode, are likely to be targets for drugs against breast cancer.

5.2 Definitions

As used herein, "BRCA1 tumor" means a tumor having cells containing a mutation of the BRCA1 locus.

The "absolute amplitude" of correlation expressions means the distance, either positive or negative, from a zero value; i.e., both correlation coefficients −0.35 and 0.35 have an absolute amplitude of 0.35.

"Status" means a state of gene expression of a set of genetic markers whose expression is strongly correlated with a particular phenotype. For example, "ER status" means a state of gene expression of a set of genetic markers whose expression is strongly correlated with that of ESR1 (estrogen receptor gene), wherein the pattern of these genes' expression differs detectably between tumors expressing the receptor and tumors not expressing the receptor.

"Good prognosis" means that a patient is expected to have no distant metastases of a breast tumor within five years of initial diagnosis of breast cancer.

"Poor prognosis" means that a patient is expected to have distant metastases of a breast tumor within five years of initial diagnosis of breast cancer.

"Marker" means an entire gene, or an EST derived from that gene, the expression or level of which changes between certain conditions. Where the expression of the gene correlates with a certain condition, the gene is a marker for that condition.

"Marker-derived polynucleotides" means the RNA transcribed from a marker gene, any cDNA or cRNA produced therefrom, and any nucleic acid derived therefrom, such as synthetic nucleic acid having a sequence derived from the gene corresponding to the marker gene.

5.3 Markers Useful in Diagnosis and Prognosis of Breast Cancer 5.3.1 Marker Sets The invention provides a set of 4,986 genetic markers whose expression is correlated with the existence of breast cancer by clustering analysis. A subset of these markers identified as useful for diagnosis or prognosis is listed as SEQ ID NOS: 1-2,699. The invention also provides a method of using these markers to distinguish tumor types in diagnosis or prognosis.

In one embodiment, the invention provides a set of 2,460 genetic markers that can classify breast cancer patients by estrogen receptor (ER) status; i.e., distinguish between ER(+) and ER(−) patients or tumors derived from these patients. ER status is an important indicator of the likelihood of a patient's response to some chemotherapies (i.e., tamoxifen). These markers are listed in Table 1. The invention also provides subsets of at least 5, 10, 25, 50, 100, 200, 300, 400, 500, 750, 1,000, 1,250, 1,500, 1,750 or 2,000 genetic markers, drawn from the set of 2,460 markers, which also distinguish ER(+) and ER(−) patients or tumors. Preferably, the number of markers is 550. The invention further provides a set of 550 of the 2,460 markers that are optimal for distinguishing ER status (Table 2). The invention also provides a method of using these markers to distinguish between ER(+) and ER(−) patients or tumors derived therefrom.

In another embodiment, the invention provides a set of 430 genetic markers that can classify ER(−) breast cancer patients by BRCA1 status; i.e., distinguish between tumors containing a BRCA1 mutation and sporadic tumors. These markers are listed in Table 3. The invention further provides subsets of at least 5, 10 20, 30, 40, 50, 75, 100, 150, 200, 250, 300 or 350 markers, drawn from the set of 430 markers, which also distinguish between tumors containing a BRCA1 mutation and sporadic tumors. Preferably, the number of markers is 100. A preferred set of 100 markers is provided in Table 4. The invention also provides a method of using these markers to distinguish between BRCA1 and sporadic patients or tumors derived therefrom.

In another embodiment, the invention provides a set of 231 genetic markers that can distinguish between patients with a good breast cancer prognosis (no breast cancer tumor distant metastases within five years) and patients with a poor breast cancer prognosis (tumor distant metastases within five years). These markers are listed in Table 5. The invention also provides subsets of at least 5, 10, 20, 30, 40, 50, 75, 100, 150 or 200 markers, drawn from the set of 231, which also distinguish between patients with good and poor prognosis. A preferred set of 70 markers is provided in Table 6. In a specific embodiment, the set of markers consists of the twelve kinase-related markers and the seven cell division- or mitosis-related markers listed. The invention also provides a method of using the above markers to distinguish between patients with good or poor prognosis.

TABLE 1

2,460 gene markers that distinguish ER(+) and ER(−) cell samples.

| GenBank Accession Number | SEQ ID NO |
|---|---|
| AA555029_RC | SEQ ID NO 1 |
| AB000509 | SEQ ID NO 2 |
| AB001451 | SEQ ID NO 3 |
| AB002301 | SEQ ID NO 4 |
| AB002308 | SEQ ID NO 5 |
| AB002351 | SEQ ID NO 6 |
| AB002448 | SEQ ID NO 7 |
| AB006628 | SEQ ID NO 9 |
| AB006630 | SEQ ID NO 10 |
| AB006746 | SEQ ID NO 11 |
| AB007458 | SEQ ID NO 12 |
| AB007855 | SEQ ID NO 13 |
| AB007857 | SEQ ID NO 14 |
| AB007863 | SEQ ID NO 15 |
| AB007883 | SEQ ID NO 16 |
| AB007896 | SEQ ID NO 17 |
| AB007899 | SEQ ID NO 18 |
| AB007916 | SEQ ID NO 19 |
| AB007950 | SEQ ID NO 20 |
| AB011087 | SEQ ID NO 21 |
| AB011089 | SEQ ID NO 22 |
| AB011104 | SEQ ID NO 23 |
| AB011105 | SEQ ID NO 24 |
| AB011121 | SEQ ID NO 25 |
| AB011132 | SEQ ID NO 26 |
| AB011152 | SEQ ID NO 27 |
| AB011179 | SEQ ID NO 28 |
| AB014534 | SEQ ID NO 29 |
| AB014568 | SEQ ID NO 30 |
| AB018260 | SEQ ID NO 31 |
| AB018268 | SEQ ID NO 32 |
| AB018289 | SEQ ID NO 33 |
| AB018345 | SEQ ID NO 35 |
| AB020677 | SEQ ID NO 36 |
| AB020689 | SEQ ID NO 37 |
| AB020695 | SEQ ID NO 38 |
| AB020710 | SEQ ID NO 39 |
| AB023139 | SEQ ID NO 40 |
| AB023151 | SEQ ID NO 41 |
| AB023152 | SEQ ID NO 42 |

TABLE 1-continued 2,460 gene markers that distinguish ER(+) and ER(−) cell samples.

| GenBank Accession Number | SEQ ID NO |
|---|---|
| AB023163 | SEQ ID NO 43 |
| AB023173 | SEQ ID NO 44 |
| AB023211 | SEQ ID NO 45 |
| AB024704 | SEQ ID NO 46 |
| AB028985 | SEQ ID NO 47 |
| AB028986 | SEQ ID NO 48 |
| AB028998 | SEQ ID NO 49 |
| AB029031 | SEQ ID NO 51 |
| AB032951 | SEQ ID NO 52 |
| AB032966 | SEQ ID NO 53 |
| AB032969 | SEQ ID NO 54 |
| AB032977 | SEQ ID NO 56 |
| AB033007 | SEQ ID NO 58 |
| AB033034 | SEQ ID NO 59 |
| AB033035 | SEQ ID NO 60 |
| AB033040 | SEQ ID NO 61 |
| AB033049 | SEQ ID NO 63 |
| AB033050 | SEQ ID NO 64 |
| AB033053 | SEQ ID NO 65 |
| AB033055 | SEQ ID NO 66 |
| AB033058 | SEQ ID NO 67 |
| AB033073 | SEQ ID NO 68 |
| AB033092 | SEQ ID NO 69 |
| AB033111 | SEQ ID NO 70 |
| AB036063 | SEQ ID NO 71 |
| AB037720 | SEQ ID NO 72 |
| AB037743 | SEQ ID NO 74 |
| AB037745 | SEQ ID NO 75 |
| AB037756 | SEQ ID NO 76 |
| AB037765 | SEQ ID NO 77 |
| AB037778 | SEQ ID NO 78 |
| AB037791 | SEQ ID NO 79 |
| AB037793 | SEQ ID NO 80 |
| AB037802 | SEQ ID NO 81 |
| AB037806 | SEQ ID NO 82 |
| AB037809 | SEQ ID NO 83 |
| AB037836 | SEQ ID NO 84 |
| AB037844 | SEQ ID NO 85 |
| AB037845 | SEQ ID NO 86 |
| AB037848 | SEQ ID NO 87 |
| AB037863 | SEQ ID NO 88 |
| AB037864 | SEQ ID NO 89 |
| AB040881 | SEQ ID NO 90 |
| AB040900 | SEQ ID NO 91 |
| AB040914 | SEQ ID NO 92 |
| AB040926 | SEQ ID NO 93 |
| AB040955 | SEQ ID NO 94 |
| AB040961 | SEQ ID NO 95 |
| AF000974 | SEQ ID NO 97 |
| AF005487 | SEQ ID NO 98 |
| AF007153 | SEQ ID NO 99 |
| AF007155 | SEQ ID NO 100 |
| AF015041 | SEQ ID NO 101 |
| AF016004 | SEQ ID NO 102 |
| AF016495 | SEQ ID NO 103 |
| AF020919 | SEQ ID NO 104 |
| AF026941 | SEQ ID NO 105 |
| AF035191 | SEQ ID NO 106 |
| AF035284 | SEQ ID NO 107 |
| AF035318 | SEQ ID NO 108 |
| AF038182 | SEQ ID NO 109 |
| AF038193 | SEQ ID NO 110 |
| AF042838 | SEQ ID NO 111 |
| AF044127 | SEQ ID NO 112 |
| AF045229 | SEQ ID NO 113 |
| AF047002 | SEQ ID NO 114 |
| AF047826 | SEQ ID NO 115 |
| AF049460 | SEQ ID NO 116 |
| AF052101 | SEQ ID NO 117 |
| AF052117 | SEQ ID NO 118 |
| AF052155 | SEQ ID NO 119 |
| AF052159 | SEQ ID NO 120 |
| AF052176 | SEQ ID NO 122 |

TABLE 1-continued 2,460 gene markers that distinguish ER(+) and ER(−) cell samples.

| GenBank Accession Number | SEQ ID NO |
|---|---|
| AF052185 | SEQ ID NO 123 |
| AF055270 | SEQ ID NO 126 |
| AF058075 | SEQ ID NO 127 |
| AF061034 | SEQ ID NO 128 |
| AF063725 | SEQ ID NO 129 |
| AF063936 | SEQ ID NO 130 |
| AF065241 | SEQ ID NO 131 |
| AF067972 | SEQ ID NO 132 |
| AF070536 | SEQ ID NO 133 |
| AF070552 | SEQ ID NO 134 |
| AF070617 | SEQ ID NO 135 |
| AF073770 | SEQ ID NO 138 |
| AF076612 | SEQ ID NO 139 |
| AF079529 | SEQ ID NO 140 |
| AF090913 | SEQ ID NO 142 |
| AF095719 | SEQ ID NO 143 |
| AF098641 | SEQ ID NO 144 |
| AF099032 | SEQ ID NO 145 |
| AF100756 | SEQ ID NO 146 |
| AF101051 | SEQ ID NO 147 |
| AF103375 | SEQ ID NO 148 |
| AF103458 | SEQ ID NO 149 |
| AF103530 | SEQ ID NO 150 |
| AF103804 | SEQ ID NO 151 |
| AF111849 | SEQ ID NO 152 |
| AF112213 | SEQ ID NO 153 |
| AF113132 | SEQ ID NO 154 |
| AF116682 | SEQ ID NO 156 |
| AF118224 | SEQ ID NO 157 |
| AF118274 | SEQ ID NO 158 |
| AF119256 | SEQ ID NO 159 |
| AF119665 | SEQ ID NO 160 |
| AF121255 | SEQ ID NO 161 |
| AF131748 | SEQ ID NO 162 |
| AF131753 | SEQ ID NO 163 |
| AF131760 | SEQ ID NO 164 |
| AF131784 | SEQ ID NO 165 |
| AF131828 | SEQ ID NO 166 |
| AF135168 | SEQ ID NO 167 |
| AF141882 | SEQ ID NO 168 |
| AF148505 | SEQ ID NO 169 |
| AF149785 | SEQ ID NO 170 |
| AF151810 | SEQ ID NO 171 |
| AF152502 | SEQ ID NO 172 |
| AF155120 | SEQ ID NO 174 |
| AF159092 | SEQ ID NO 175 |
| AF161407 | SEQ ID NO 176 |
| AF161553 | SEQ ID NO 177 |
| AF164104 | SEQ ID NO 178 |
| AF167706 | SEQ ID NO 179 |
| AF175387 | SEQ ID NO 180 |
| AF176012 | SEQ ID NO 181 |
| AF186780 | SEQ ID NO 182 |
| AF217508 | SEQ ID NO 184 |
| AF220492 | SEQ ID NO 185 |
| AF224266 | SEQ ID NO 186 |
| AF230904 | SEQ ID NO 187 |
| AF234532 | SEQ ID NO 188 |
| AF257175 | SEQ ID NO 189 |
| AF257659 | SEQ ID NO 190 |
| AF272357 | SEQ ID NO 191 |
| AF279865 | SEQ ID NO 192 |
| AI497657_RC | SEQ ID NO 193 |
| AJ012755 | SEQ ID NO 194 |
| AJ223353 | SEQ ID NO 195 |
| AJ224741 | SEQ ID NO 196 |
| AJ224864 | SEQ ID NO 197 |
| AJ225092 | SEQ ID NO 198 |
| AJ225093 | SEQ ID NO 199 |
| AJ249377 | SEQ ID NO 200 |
| AJ270996 | SEQ ID NO 202 |
| AJ272057 | SEQ ID NO 203 |
| AJ275978 | SEQ ID NO 204 |
| AJ276429 | SEQ ID NO 205 |
| AK000004 | SEQ ID NO 206 |
| AK000005 | SEQ ID NO 207 |
| AK000106 | SEQ ID NO 208 |
| AK000142 | SEQ ID NO 209 |
| AK000168 | SEQ ID NO 210 |
| AK000345 | SEQ ID NO 212 |
| AK000543 | SEQ ID NO 213 |
| AK000552 | SEQ ID NO 214 |
| AK000643 | SEQ ID NO 216 |
| AK000660 | SEQ ID NO 217 |
| AK000689 | SEQ ID NO 218 |
| AK000770 | SEQ ID NO 220 |
| AK000933 | SEQ ID NO 221 |
| AK001100 | SEQ ID NO 223 |
| AK001164 | SEQ ID NO 224 |
| AK001166 | SEQ ID NO 225 |
| AK001295 | SEQ ID NO 226 |
| AK001380 | SEQ ID NO 227 |
| AK001423 | SEQ ID NO 228 |
| AK001438 | SEQ ID NO 229 |
| AK001492 | SEQ ID NO 230 |
| AK001499 | SEQ ID NO 231 |
| AK001630 | SEQ ID NO 232 |
| AK001872 | SEQ ID NO 234 |
| AK001890 | SEQ ID NO 235 |
| AK002016 | SEQ ID NO 236 |
| AK002088 | SEQ ID NO 237 |
| AK002206 | SEQ ID NO 240 |
| AL035297 | SEQ ID NO 241 |
| AL049265 | SEQ ID NO 242 |
| AL049365 | SEQ ID NO 244 |
| AL049370 | SEQ ID NO 245 |
| AL049381 | SEQ ID NO 246 |
| AL049397 | SEQ ID NO 247 |
| AL049415 | SEQ ID NO 248 |
| AL049667 | SEQ ID NO 249 |
| AL049801 | SEQ ID NO 250 |
| AL049932 | SEQ ID NO 251 |
| AL049935 | SEQ ID NO 252 |
| AL049943 | SEQ ID NO 253 |
| AL049949 | SEQ ID NO 254 |
| AL049963 | SEQ ID NO 255 |
| AL049987 | SEQ ID NO 256 |
| AL050021 | SEQ ID NO 257 |
| AL050024 | SEQ ID NO 258 |
| AL050090 | SEQ ID NO 259 |
| AL050148 | SEQ ID NO 260 |
| AL050151 | SEQ ID NO 261 |
| AL050227 | SEQ ID NO 262 |
| AL050367 | SEQ ID NO 263 |
| AL050370 | SEQ ID NO 264 |
| AL050371 | SEQ ID NO 265 |
| AL050372 | SEQ ID NO 266 |
| AL050388 | SEQ ID NO 267 |
| AL079276 | SEQ ID NO 268 |
| AL079298 | SEQ ID NO 269 |
| AL080079 | SEQ ID NO 271 |
| AL080192 | SEQ ID NO 273 |
| AL080199 | SEQ ID NO 274 |
| AL080209 | SEQ ID NO 275 |
| AL080234 | SEQ ID NO 277 |
| AL080235 | SEQ ID NO 278 |
| AL096737 | SEQ ID NO 279 |
| AL110126 | SEQ ID NO 280 |
| AL110139 | SEQ ID NO 281 |
| AL110202 | SEQ ID NO 283 |
| AL110212 | SEQ ID NO 284 |
| AL110260 | SEQ ID NO 285 |
| AL117441 | SEQ ID NO 286 |
| AL117452 | SEQ ID NO 287 |
| AL117477 | SEQ ID NO 288 |
| AL117502 | SEQ ID NO 289 |

TABLE 1-continued 2,460 gene markers that distinguish ER(+) and ER(−) cell samples.

| GenBank Accession Number | SEQ ID NO |
|---|---|
| AL117523 | SEQ ID NO 290 |
| AL117595 | SEQ ID NO 291 |
| AL117599 | SEQ ID NO 292 |
| AL117600 | SEQ ID NO 293 |
| AL117609 | SEQ ID NO 294 |
| AL117617 | SEQ ID NO 295 |
| AL117666 | SEQ ID NO 296 |
| AL122055 | SEQ ID NO 297 |
| AL133033 | SEQ ID NO 298 |
| AL133035 | SEQ ID NO 299 |
| AL133074 | SEQ ID NO 301 |
| AL133096 | SEQ ID NO 302 |
| AL133105 | SEQ ID NO 303 |
| AL133108 | SEQ ID NO 304 |
| AL133572 | SEQ ID NO 305 |
| AL133619 | SEQ ID NO 307 |
| AL133622 | SEQ ID NO 308 |
| AL133623 | SEQ ID NO 309 |
| AL133624 | SEQ ID NO 310 |
| AL133632 | SEQ ID NO 311 |
| AL133644 | SEQ ID NO 312 |
| AL133645 | SEQ ID NO 313 |
| AL133651 | SEQ ID NO 314 |
| AL137310 | SEQ ID NO 316 |
| AL137316 | SEQ ID NO 317 |
| AL137332 | SEQ ID NO 318 |
| AL137342 | SEQ ID NO 319 |
| AL137362 | SEQ ID NO 321 |
| AL137381 | SEQ ID NO 322 |
| AL137407 | SEQ ID NO 323 |
| AL137448 | SEQ ID NO 324 |
| AL137502 | SEQ ID NO 326 |
| AL137514 | SEQ ID NO 327 |
| AL137540 | SEQ ID NO 328 |
| AL137566 | SEQ ID NO 330 |
| AL137615 | SEQ ID NO 331 |
| AL137673 | SEQ ID NO 335 |
| AL137718 | SEQ ID NO 336 |
| AL137736 | SEQ ID NO 337 |
| AL137751 | SEQ ID NO 338 |
| AL137761 | SEQ ID NO 339 |
| AL157431 | SEQ ID NO 340 |
| AL157432 | SEQ ID NO 341 |
| AL157454 | SEQ ID NO 342 |
| AL157476 | SEQ ID NO 343 |
| AL157480 | SEQ ID NO 344 |
| AL157482 | SEQ ID NO 345 |
| AL157484 | SEQ ID NO 346 |
| AL157492 | SEQ ID NO 347 |
| AL157505 | SEQ ID NO 348 |
| AL157851 | SEQ ID NO 349 |
| AL160131 | SEQ ID NO 350 |
| AL161960 | SEQ ID NO 351 |
| AL162049 | SEQ ID NO 352 |
| AL355708 | SEQ ID NO 353 |
| D13643 | SEQ ID NO 355 |
| D14678 | SEQ ID NO 356 |
| D25328 | SEQ ID NO 357 |
| D26070 | SEQ ID NO 358 |
| D26488 | SEQ ID NO 359 |
| D31887 | SEQ ID NO 360 |
| D38521 | SEQ ID NO 361 |
| D38553 | SEQ ID NO 362 |
| D42043 | SEQ ID NO 363 |
| D42047 | SEQ ID NO 364 |
| D43950 | SEQ ID NO 365 |
| D50402 | SEQ ID NO 366 |
| D50914 | SEQ ID NO 367 |
| D55716 | SEQ ID NO 368 |
| D80001 | SEQ ID NO 369 |
| D80010 | SEQ ID NO 370 |
| D82345 | SEQ ID NO 371 |
| D83781 | SEQ ID NO 372 |

TABLE 1-continued 2,460 gene markers that distinguish ER(+) and ER(−) cell samples.

| GenBank Accession Number | SEQ ID NO |
|---|---|
| D86964 | SEQ ID NO 373 |
| D86978 | SEQ ID NO 374 |
| D86985 | SEQ ID NO 375 |
| D87076 | SEQ ID NO 376 |
| D87453 | SEQ ID NO 377 |
| D87469 | SEQ ID NO 378 |
| D87682 | SEQ ID NO 379 |
| G26403 | SEQ ID NO 380 |
| J02639 | SEQ ID NO 381 |
| J04162 | SEQ ID NO 382 |
| K02403 | SEQ ID NO 384 |
| L05096 | SEQ ID NO 385 |
| L10333 | SEQ ID NO 386 |
| L11645 | SEQ ID NO 387 |
| L21934 | SEQ ID NO 388 |
| L22005 | SEQ ID NO 389 |
| L48692 | SEQ ID NO 391 |
| M12758 | SEQ ID NO 392 |
| M15178 | SEQ ID NO 393 |
| M21551 | SEQ ID NO 394 |
| M24895 | SEQ ID NO 395 |
| M26383 | SEQ ID NO 396 |
| M27749 | SEQ ID NO 397 |
| M28170 | SEQ ID NO 398 |
| M29873 | SEQ ID NO 399 |
| M29874 | SEQ ID NO 400 |
| M30448 | SEQ ID NO 401 |
| M30818 | SEQ ID NO 402 |
| M31932 | SEQ ID NO 403 |
| M37033 | SEQ ID NO 404 |
| M55914 | SEQ ID NO 405 |
| M63438 | SEQ ID NO 406 |
| M65254 | SEQ ID NO 407 |
| M68874 | SEQ ID NO 408 |
| M73547 | SEQ ID NO 409 |
| M77142 | SEQ ID NO 410 |
| M80899 | SEQ ID NO 411 |
| M83822 | SEQ ID NO 412 |
| M90657 | SEQ ID NO 413 |
| M93718 | SEQ ID NO 414 |
| M96577 | SEQ ID NO 415 |
| NM_000022 | SEQ ID NO 417 |
| NM_000044 | SEQ ID NO 418 |
| NM_000050 | SEQ ID NO 419 |
| NM_000057 | SEQ ID NO 420 |
| NM_000060 | SEQ ID NO 421 |
| NM_000064 | SEQ ID NO 422 |
| NM_000073 | SEQ ID NO 424 |
| NM_000077 | SEQ ID NO 425 |
| NM_000086 | SEQ ID NO 426 |
| NM_000087 | SEQ ID NO 427 |
| NM_000095 | SEQ ID NO 429 |
| NM_000096 | SEQ ID NO 430 |
| NM_000100 | SEQ ID NO 431 |
| NM_000101 | SEQ ID NO 432 |
| NM_000104 | SEQ ID NO 433 |
| NM_000109 | SEQ ID NO 434 |
| NM_000125 | SEQ ID NO 435 |
| NM_000127 | SEQ ID NO 436 |
| NM_000135 | SEQ ID NO 437 |
| NM_000137 | SEQ ID NO 438 |
| NM_000146 | SEQ ID NO 439 |
| NM_000149 | SEQ ID NO 440 |
| NM_000154 | SEQ ID NO 441 |
| NM_000161 | SEQ ID NO 443 |
| NM_000165 | SEQ ID NO 444 |
| NM_000168 | SEQ ID NO 445 |
| NM_000169 | SEQ ID NO 446 |
| NM_000175 | SEQ ID NO 447 |
| NM_000191 | SEQ ID NO 448 |
| NM_000201 | SEQ ID NO 450 |
| NM_000211 | SEQ ID NO 451 |
| NM_000213 | SEQ ID NO 452 |

TABLE 1-continued 2,460 gene markers that distinguish ER(+) and ER(−) cell samples.

| GenBank Accession Number | SEQ ID NO |
|---|---|
| NM_000224 | SEQ ID NO 453 |
| NM_000239 | SEQ ID NO 454 |
| NM_000251 | SEQ ID NO 455 |
| NM_000268 | SEQ ID NO 456 |
| NM_000270 | SEQ ID NO 458 |
| NM_000271 | SEQ ID NO 459 |
| NM_000283 | SEQ ID NO 460 |
| NM_000284 | SEQ ID NO 461 |
| NM_000286 | SEQ ID NO 462 |
| NM_000291 | SEQ ID NO 463 |
| NM_000299 | SEQ ID NO 464 |
| NM_000300 | SEQ ID NO 465 |
| NM_000310 | SEQ ID NO 466 |
| NM_000311 | SEQ ID NO 467 |
| NM_000317 | SEQ ID NO 468 |
| NM_000320 | SEQ ID NO 469 |
| NM_000342 | SEQ ID NO 470 |
| NM_000346 | SEQ ID NO 471 |
| NM_000352 | SEQ ID NO 472 |
| NM_000355 | SEQ ID NO 473 |
| NM_000358 | SEQ ID NO 474 |
| NM_000359 | SEQ ID NO 475 |
| NM_000362 | SEQ ID NO 476 |
| NM_000365 | SEQ ID NO 477 |
| NM_000381 | SEQ ID NO 478 |
| NM_000397 | SEQ ID NO 480 |
| NM_000399 | SEQ ID NO 481 |
| NM_000414 | SEQ ID NO 482 |
| NM_000416 | SEQ ID NO 483 |
| NM_000422 | SEQ ID NO 484 |
| NM_000424 | SEQ ID NO 485 |
| NM_000433 | SEQ ID NO 486 |
| NM_000436 | SEQ ID NO 487 |
| NM_000450 | SEQ ID NO 488 |
| NM_000462 | SEQ ID NO 489 |
| NM_000495 | SEQ ID NO 490 |
| NM_000507 | SEQ ID NO 491 |
| NM_000526 | SEQ ID NO 492 |
| NM_000557 | SEQ ID NO 493 |
| NM_000560 | SEQ ID NO 494 |
| NM_000576 | SEQ ID NO 495 |
| NM_000579 | SEQ ID NO 496 |
| NM_000584 | SEQ ID NO 497 |
| NM_000591 | SEQ ID NO 498 |
| NM_000592 | SEQ ID NO 499 |
| NM_000593 | SEQ ID NO 500 |
| NM_000594 | SEQ ID NO 501 |
| NM_000597 | SEQ ID NO 502 |
| NM_000600 | SEQ ID NO 504 |
| NM_000607 | SEQ ID NO 505 |
| NM_000612 | SEQ ID NO 506 |
| NM_000627 | SEQ ID NO 507 |
| NM_000633 | SEQ ID NO 508 |
| NM_000636 | SEQ ID NO 509 |
| NM_000639 | SEQ ID NO 510 |
| NM_000647 | SEQ ID NO 511 |
| NM_000655 | SEQ ID NO 512 |
| NM_000662 | SEQ ID NO 513 |
| NM_000663 | SEQ ID NO 514 |
| NM_000666 | SEQ ID NO 515 |
| NM_000676 | SEQ ID NO 516 |
| NM_000685 | SEQ ID NO 517 |
| NM_000693 | SEQ ID NO 518 |
| NM_000699 | SEQ ID NO 519 |
| NM_000700 | SEQ ID NO 520 |
| NM_000712 | SEQ ID NO 521 |
| NM_000727 | SEQ ID NO 522 |
| NM_000732 | SEQ ID NO 523 |
| NM_000734 | SEQ ID NO 524 |
| NM_000767 | SEQ ID NO 525 |
| NM_000784 | SEQ ID NO 526 |
| NM_000802 | SEQ ID NO 528 |
| NM_000824 | SEQ ID NO 529 |
| NM_000849 | SEQ ID NO 530 |
| NM_000852 | SEQ ID NO 531 |
| NM_000874 | SEQ ID NO 532 |
| NM_000878 | SEQ ID NO 533 |
| NM_000884 | SEQ ID NO 534 |
| NM_000908 | SEQ ID NO 537 |
| NM_000909 | SEQ ID NO 538 |
| NM_000926 | SEQ ID NO 539 |
| NM_000930 | SEQ ID NO 540 |
| NM_000931 | SEQ ID NO 541 |
| NM_000947 | SEQ ID NO 542 |
| NM_000949 | SEQ ID NO 543 |
| NM_000950 | SEQ ID NO 544 |
| NM_000954 | SEQ ID NO 545 |
| NM_000964 | SEQ ID NO 546 |
| NM_001003 | SEQ ID NO 549 |
| NM_001016 | SEQ ID NO 551 |
| NM_001047 | SEQ ID NO 553 |
| NM_001066 | SEQ ID NO 555 |
| NM_001071 | SEQ ID NO 556 |
| NM_001078 | SEQ ID NO 557 |
| NM_001085 | SEQ ID NO 558 |
| NM_001089 | SEQ ID NO 559 |
| NM_001109 | SEQ ID NO 560 |
| NM_001122 | SEQ ID NO 561 |
| NM_001124 | SEQ ID NO 562 |
| NM_001161 | SEQ ID NO 563 |
| NM_001165 | SEQ ID NO 564 |
| NM_001166 | SEQ ID NO 565 |
| NM_001168 | SEQ ID NO 566 |
| NM_001179 | SEQ ID NO 567 |
| NM_001185 | SEQ ID NO 569 |
| NM_001203 | SEQ ID NO 570 |
| NM_001207 | SEQ ID NO 573 |
| NM_001216 | SEQ ID NO 574 |
| NM_001218 | SEQ ID NO 575 |
| NM_001223 | SEQ ID NO 576 |
| NM_001225 | SEQ ID NO 577 |
| NM_001233 | SEQ ID NO 578 |
| NM_001236 | SEQ ID NO 579 |
| NM_001237 | SEQ ID NO 580 |
| NM_001251 | SEQ ID NO 581 |
| NM_001255 | SEQ ID NO 582 |
| NM_001262 | SEQ ID NO 583 |
| NM_001263 | SEQ ID NO 584 |
| NM_001267 | SEQ ID NO 585 |
| NM_001276 | SEQ ID NO 587 |
| NM_001280 | SEQ ID NO 588 |
| NM_001282 | SEQ ID NO 589 |
| NM_001295 | SEQ ID NO 590 |
| NM_001305 | SEQ ID NO 591 |
| NM_001310 | SEQ ID NO 592 |
| NM_001312 | SEQ ID NO 593 |
| NM_001321 | SEQ ID NO 594 |
| NM_001327 | SEQ ID NO 595 |
| NM_001329 | SEQ ID NO 596 |
| NM_001333 | SEQ ID NO 597 |
| NM_001338 | SEQ ID NO 598 |
| NM_001360 | SEQ ID NO 599 |
| NM_001363 | SEQ ID NO 600 |
| NM_001381 | SEQ ID NO 601 |
| NM_001394 | SEQ ID NO 602 |
| NM_001395 | SEQ ID NO 603 |
| NM_001419 | SEQ ID NO 604 |
| NM_001424 | SEQ ID NO 605 |
| NM_001428 | SEQ ID NO 606 |
| NM_001436 | SEQ ID NO 607 |
| NM_001444 | SEQ ID NO 608 |
| NM_001446 | SEQ ID NO 609 |
| NM_001453 | SEQ ID NO 611 |
| NM_001456 | SEQ ID NO 612 |
| NM_001457 | SEQ ID NO 613 |
| NM_001463 | SEQ ID NO 614 |

TABLE 1-continued 2,460 gene markers that distinguish ER(+) and ER(−) cell samples.

| GenBank Accession Number | SEQ ID NO |
|---|---|
| NM_001465 | SEQ ID NO 615 |
| NM_001481 | SEQ ID NO 616 |
| NM_001493 | SEQ ID NO 617 |
| NM_001494 | SEQ ID NO 618 |
| NM_001500 | SEQ ID NO 619 |
| NM_001504 | SEQ ID NO 620 |
| NM_001511 | SEQ ID NO 621 |
| NM_001513 | SEQ ID NO 622 |
| NM_001527 | SEQ ID NO 623 |
| NM_001529 | SEQ ID NO 624 |
| NM_001530 | SEQ ID NO 625 |
| NM_001540 | SEQ ID NO 626 |
| NM_001550 | SEQ ID NO 627 |
| NM_001551 | SEQ ID NO 628 |
| NM_001552 | SEQ ID NO 629 |
| NM_001554 | SEQ ID NO 631 |
| NM_001558 | SEQ ID NO 632 |
| NM_001560 | SEQ ID NO 633 |
| NM_001565 | SEQ ID NO 634 |
| NM_001569 | SEQ ID NO 635 |
| NM_001605 | SEQ ID NO 636 |
| NM_001609 | SEQ ID NO 637 |
| NM_001615 | SEQ ID NO 638 |
| NM_001623 | SEQ ID NO 639 |
| NM_001627 | SEQ ID NO 640 |
| NM_001628 | SEQ ID NO 641 |
| NM_001630 | SEQ ID NO 642 |
| NM_001634 | SEQ ID NO 643 |
| NM_001656 | SEQ ID NO 644 |
| NM_001673 | SEQ ID NO 645 |
| NM_001675 | SEQ ID NO 647 |
| NM_001679 | SEQ ID NO 648 |
| NM_001689 | SEQ ID NO 649 |
| NM_001703 | SEQ ID NO 650 |
| NM_001710 | SEQ ID NO 651 |
| NM_001725 | SEQ ID NO 652 |
| NM_001730 | SEQ ID NO 653 |
| NM_001733 | SEQ ID NO 654 |
| NM_001734 | SEQ ID NO 655 |
| NM_001740 | SEQ ID NO 656 |
| NM_001745 | SEQ ID NO 657 |
| NM_001747 | SEQ ID NO 658 |
| NM_001756 | SEQ ID NO 659 |
| NM_001757 | SEQ ID NO 660 |
| NM_001758 | SEQ ID NO 661 |
| NM_001762 | SEQ ID NO 662 |
| NM_001767 | SEQ ID NO 663 |
| NM_001770 | SEQ ID NO 664 |
| NM_001777 | SEQ ID NO 665 |
| NM_001778 | SEQ ID NO 666 |
| NM_001781 | SEQ ID NO 667 |
| NM_001786 | SEQ ID NO 668 |
| NM_001793 | SEQ ID NO 669 |
| NM_001803 | SEQ ID NO 671 |
| NM_001806 | SEQ ID NO 672 |
| NM_001809 | SEQ ID NO 673 |
| NM_001814 | SEQ ID NO 674 |
| NM_001826 | SEQ ID NO 675 |
| NM_001830 | SEQ ID NO 677 |
| NM_001838 | SEQ ID NO 678 |
| NM_001839 | SEQ ID NO 679 |
| NM_001853 | SEQ ID NO 681 |
| NM_001859 | SEQ ID NO 682 |
| NM_001861 | SEQ ID NO 683 |
| NM_001874 | SEQ ID NO 685 |
| NM_001885 | SEQ ID NO 686 |
| NM_001892 | SEQ ID NO 688 |
| NM_001897 | SEQ ID NO 689 |
| NM_001899 | SEQ ID NO 690 |
| NM_001905 | SEQ ID NO 691 |
| NM_001912 | SEQ ID NO 692 |
| NM_001914 | SEQ ID NO 693 |
| NM_001919 | SEQ ID NO 694 |
| NM_001941 | SEQ ID NO 695 |
| NM_001943 | SEQ ID NO 696 |
| NM_001944 | SEQ ID NO 697 |
| NM_001953 | SEQ ID NO 699 |
| NM_001954 | SEQ ID NO 700 |
| NM_001955 | SEQ ID NO 701 |
| NM_001956 | SEQ ID NO 702 |
| NM_001958 | SEQ ID NO 703 |
| NM_001961 | SEQ ID NO 705 |
| NM_001970 | SEQ ID NO 706 |
| NM_001979 | SEQ ID NO 707 |
| NM_001982 | SEQ ID NO 708 |
| NM_002017 | SEQ ID NO 710 |
| NM_002033 | SEQ ID NO 713 |
| NM_002046 | SEQ ID NO 714 |
| NM_002047 | SEQ ID NO 715 |
| NM_002051 | SEQ ID NO 716 |
| NM_002053 | SEQ ID NO 717 |
| NM_002061 | SEQ ID NO 718 |
| NM_002065 | SEQ ID NO 719 |
| NM_002068 | SEQ ID NO 720 |
| NM_002077 | SEQ ID NO 722 |
| NM_002091 | SEQ ID NO 723 |
| NM_002101 | SEQ ID NO 724 |
| NM_002106 | SEQ ID NO 725 |
| NM_002110 | SEQ ID NO 726 |
| NM_002111 | SEQ ID NO 727 |
| NM_002115 | SEQ ID NO 728 |
| NM_002118 | SEQ ID NO 729 |
| NM_002123 | SEQ ID NO 730 |
| NM_002131 | SEQ ID NO 731 |
| NM_002136 | SEQ ID NO 732 |
| NM_002145 | SEQ ID NO 733 |
| NM_002164 | SEQ ID NO 734 |
| NM_002168 | SEQ ID NO 735 |
| NM_002184 | SEQ ID NO 736 |
| NM_002185 | SEQ ID NO 737 |
| NM_002189 | SEQ ID NO 738 |
| NM_002200 | SEQ ID NO 739 |
| NM_002201 | SEQ ID NO 740 |
| NM_002213 | SEQ ID NO 741 |
| NM_002219 | SEQ ID NO 742 |
| NM_002222 | SEQ ID NO 743 |
| NM_002239 | SEQ ID NO 744 |
| NM_002243 | SEQ ID NO 745 |
| NM_002245 | SEQ ID NO 746 |
| NM_002250 | SEQ ID NO 747 |
| NM_002254 | SEQ ID NO 748 |
| NM_002266 | SEQ ID NO 749 |
| NM_002273 | SEQ ID NO 750 |
| NM_002281 | SEQ ID NO 751 |
| NM_002292 | SEQ ID NO 752 |
| NM_002298 | SEQ ID NO 753 |
| NM_002300 | SEQ ID NO 754 |
| NM_002308 | SEQ ID NO 755 |
| NM_002314 | SEQ ID NO 756 |
| NM_002337 | SEQ ID NO 757 |
| NM_002341 | SEQ ID NO 758 |
| NM_002342 | SEQ ID NO 759 |
| NM_002346 | SEQ ID NO 760 |
| NM_002349 | SEQ ID NO 761 |
| NM_002350 | SEQ ID NO 762 |
| NM_002356 | SEQ ID NO 763 |
| NM_002358 | SEQ ID NO 764 |
| NM_002370 | SEQ ID NO 765 |
| NM_002395 | SEQ ID NO 766 |
| NM_002416 | SEQ ID NO 767 |
| NM_002421 | SEQ ID NO 768 |
| NM_002426 | SEQ ID NO 769 |
| NM_002435 | SEQ ID NO 770 |
| NM_002438 | SEQ ID NO 771 |
| NM_002444 | SEQ ID NO 772 |
| NM_002449 | SEQ ID NO 773 |

TABLE 1-continued 2,460 gene markers that distinguish ER(+) and ER(−) cell samples.

| GenBank Accession Number | SEQ ID NO |
|---|---|
| NM_002450 | SEQ ID NO 774 |
| NM_002456 | SEQ ID NO 775 |
| NM_002466 | SEQ ID NO 776 |
| NM_002482 | SEQ ID NO 777 |
| NM_002497 | SEQ ID NO 778 |
| NM_002510 | SEQ ID NO 779 |
| NM_002515 | SEQ ID NO 781 |
| NM_002524 | SEQ ID NO 782 |
| NM_002539 | SEQ ID NO 783 |
| NM_002555 | SEQ ID NO 785 |
| NM_002570 | SEQ ID NO 787 |
| NM_002579 | SEQ ID NO 788 |
| NM_002587 | SEQ ID NO 789 |
| NM_002590 | SEQ ID NO 790 |
| NM_002600 | SEQ ID NO 791 |
| NM_002614 | SEQ ID NO 792 |
| NM_002618 | SEQ ID NO 794 |
| NM_002626 | SEQ ID NO 795 |
| NM_002633 | SEQ ID NO 796 |
| NM_002639 | SEQ ID NO 797 |
| NM_002648 | SEQ ID NO 798 |
| NM_002659 | SEQ ID NO 799 |
| NM_002661 | SEQ ID NO 800 |
| NM_002662 | SEQ ID NO 801 |
| NM_002664 | SEQ ID NO 802 |
| NM_002689 | SEQ ID NO 804 |
| NM_002690 | SEQ ID NO 805 |
| NM_002709 | SEQ ID NO 806 |
| NM_002727 | SEQ ID NO 807 |
| NM_002729 | SEQ ID NO 808 |
| NM_002734 | SEQ ID NO 809 |
| NM_002736 | SEQ ID NO 810 |
| NM_002740 | SEQ ID NO 811 |
| NM_002748 | SEQ ID NO 813 |
| NM_002774 | SEQ ID NO 814 |
| NM_002775 | SEQ ID NO 815 |
| NM_002776 | SEQ ID NO 816 |
| NM_002789 | SEQ ID NO 817 |
| NM_002794 | SEQ ID NO 818 |
| NM_002796 | SEQ ID NO 819 |
| NM_002800 | SEQ ID NO 820 |
| NM_002801 | SEQ ID NO 821 |
| NM_002808 | SEQ ID NO 822 |
| NM_002821 | SEQ ID NO 824 |
| NM_002826 | SEQ ID NO 825 |
| NM_002827 | SEQ ID NO 826 |
| NM_002838 | SEQ ID NO 827 |
| NM_002852 | SEQ ID NO 828 |
| NM_002854 | SEQ ID NO 829 |
| NM_002856 | SEQ ID NO 830 |
| NM_002857 | SEQ ID NO 831 |
| NM_002858 | SEQ ID NO 832 |
| NM_002888 | SEQ ID NO 833 |
| NM_002890 | SEQ ID NO 834 |
| NM_002901 | SEQ ID NO 836 |
| NM_002906 | SEQ ID NO 837 |
| NM_002916 | SEQ ID NO 838 |
| NM_002923 | SEQ ID NO 839 |
| NM_002933 | SEQ ID NO 840 |
| NM_002936 | SEQ ID NO 841 |
| NM_002937 | SEQ ID NO 842 |
| NM_002950 | SEQ ID NO 843 |
| NM_002961 | SEQ ID NO 844 |
| NM_002964 | SEQ ID NO 845 |
| NM_002965 | SEQ ID NO 846 |
| NM_002966 | SEQ ID NO 847 |
| NM_002982 | SEQ ID NO 849 |
| NM_002983 | SEQ ID NO 850 |
| NM_002984 | SEQ ID NO 851 |
| NM_002985 | SEQ ID NO 852 |
| NM_002988 | SEQ ID NO 853 |
| NM_002996 | SEQ ID NO 854 |
| NM_002997 | SEQ ID NO 855 |
| NM_002999 | SEQ ID NO 856 |
| NM_003012 | SEQ ID NO 857 |
| NM_003022 | SEQ ID NO 858 |
| NM_003034 | SEQ ID NO 859 |
| NM_003035 | SEQ ID NO 860 |
| NM_003039 | SEQ ID NO 861 |
| NM_003051 | SEQ ID NO 862 |
| NM_003064 | SEQ ID NO 863 |
| NM_003066 | SEQ ID NO 864 |
| NM_003088 | SEQ ID NO 865 |
| NM_003090 | SEQ ID NO 866 |
| NM_003096 | SEQ ID NO 867 |
| NM_003099 | SEQ ID NO 868 |
| NM_003102 | SEQ ID NO 869 |
| NM_003104 | SEQ ID NO 870 |
| NM_003108 | SEQ ID NO 871 |
| NM_003121 | SEQ ID NO 873 |
| NM_003134 | SEQ ID NO 874 |
| NM_003137 | SEQ ID NO 875 |
| NM_003144 | SEQ ID NO 876 |
| NM_003146 | SEQ ID NO 877 |
| NM_003149 | SEQ ID NO 878 |
| NM_003151 | SEQ ID NO 879 |
| NM_003157 | SEQ ID NO 880 |
| NM_003158 | SEQ ID NO 881 |
| NM_003165 | SEQ ID NO 882 |
| NM_003172 | SEQ ID NO 883 |
| NM_003177 | SEQ ID NO 884 |
| NM_003197 | SEQ ID NO 885 |
| NM_003202 | SEQ ID NO 886 |
| NM_003213 | SEQ ID NO 887 |
| NM_003217 | SEQ ID NO 888 |
| NM_003225 | SEQ ID NO 889 |
| NM_003226 | SEQ ID NO 890 |
| NM_003236 | SEQ ID NO 892 |
| NM_003239 | SEQ ID NO 893 |
| NM_003248 | SEQ ID NO 894 |
| NM_003255 | SEQ ID NO 895 |
| NM_003258 | SEQ ID NO 896 |
| NM_003264 | SEQ ID NO 897 |
| NM_003283 | SEQ ID NO 898 |
| NM_003318 | SEQ ID NO 899 |
| NM_003329 | SEQ ID NO 900 |
| NM_003332 | SEQ ID NO 901 |
| NM_003358 | SEQ ID NO 902 |
| NM_003359 | SEQ ID NO 903 |
| NM_003360 | SEQ ID NO 904 |
| NM_003368 | SEQ ID NO 905 |
| NM_003376 | SEQ ID NO 906 |
| NM_003380 | SEQ ID NO 907 |
| NM_003392 | SEQ ID NO 908 |
| NM_003412 | SEQ ID NO 909 |
| NM_003430 | SEQ ID NO 910 |
| NM_003462 | SEQ ID NO 911 |
| NM_003467 | SEQ ID NO 912 |
| NM_003472 | SEQ ID NO 913 |
| NM_003479 | SEQ ID NO 914 |
| NM_003489 | SEQ ID NO 915 |
| NM_003494 | SEQ ID NO 916 |
| NM_003498 | SEQ ID NO 917 |
| NM_003504 | SEQ ID NO 919 |
| NM_003508 | SEQ ID NO 920 |
| NM_003510 | SEQ ID NO 921 |
| NM_003512 | SEQ ID NO 922 |
| NM_003528 | SEQ ID NO 923 |
| NM_003544 | SEQ ID NO 924 |
| NM_003561 | SEQ ID NO 925 |
| NM_003563 | SEQ ID NO 926 |
| NM_003568 | SEQ ID NO 927 |
| NM_003579 | SEQ ID NO 928 |
| NM_003600 | SEQ ID NO 929 |
| NM_003615 | SEQ ID NO 931 |
| NM_003627 | SEQ ID NO 932 |

TABLE 1-continued 2,460 gene markers that distinguish ER(+) and ER(−) cell samples.

| GenBank Accession Number | SEQ ID NO |
|---|---|
| NM_003645 | SEQ ID NO 935 |
| NM_003651 | SEQ ID NO 936 |
| NM_003657 | SEQ ID NO 937 |
| NM_003662 | SEQ ID NO 938 |
| NM_003670 | SEQ ID NO 939 |
| NM_003675 | SEQ ID NO 940 |
| NM_003676 | SEQ ID NO 941 |
| NM_003681 | SEQ ID NO 942 |
| NM_003683 | SEQ ID NO 943 |
| NM_003686 | SEQ ID NO 944 |
| NM_003689 | SEQ ID NO 945 |
| NM_003714 | SEQ ID NO 946 |
| NM_003720 | SEQ ID NO 947 |
| NM_003726 | SEQ ID NO 948 |
| NM_003729 | SEQ ID NO 949 |
| NM_003740 | SEQ ID NO 950 |
| NM_003772 | SEQ ID NO 952 |
| NM_003791 | SEQ ID NO 953 |
| NM_003793 | SEQ ID NO 954 |
| NM_003795 | SEQ ID NO 955 |
| NM_003806 | SEQ ID NO 956 |
| NM_003821 | SEQ ID NO 957 |
| NM_003829 | SEQ ID NO 958 |
| NM_003831 | SEQ ID NO 959 |
| NM_003862 | SEQ ID NO 960 |
| NM_003866 | SEQ ID NO 961 |
| NM_003875 | SEQ ID NO 962 |
| NM_003878 | SEQ ID NO 963 |
| NM_003894 | SEQ ID NO 965 |
| NM_003897 | SEQ ID NO 966 |
| NM_003904 | SEQ ID NO 967 |
| NM_003929 | SEQ ID NO 968 |
| NM_003933 | SEQ ID NO 969 |
| NM_003937 | SEQ ID NO 970 |
| NM_003940 | SEQ ID NO 971 |
| NM_003942 | SEQ ID NO 972 |
| NM_003944 | SEQ ID NO 973 |
| NM_003953 | SEQ ID NO 974 |
| NM_003954 | SEQ ID NO 975 |
| NM_003975 | SEQ ID NO 976 |
| NM_003981 | SEQ ID NO 977 |
| NM_003982 | SEQ ID NO 978 |
| NM_003986 | SEQ ID NO 979 |
| NM_004003 | SEQ ID NO 980 |
| NM_004010 | SEQ ID NO 981 |
| NM_004024 | SEQ ID NO 982 |
| NM_004038 | SEQ ID NO 983 |
| NM_004049 | SEQ ID NO 984 |
| NM_004052 | SEQ ID NO 985 |
| NM_004053 | SEQ ID NO 986 |
| NM_004079 | SEQ ID NO 987 |
| NM_004104 | SEQ ID NO 988 |
| NM_004109 | SEQ ID NO 989 |
| NM_004110 | SEQ ID NO 990 |
| NM_004120 | SEQ ID NO 991 |
| NM_004131 | SEQ ID NO 992 |
| NM_004143 | SEQ ID NO 993 |
| NM_004154 | SEQ ID NO 994 |
| NM_004170 | SEQ ID NO 996 |
| NM_004172 | SEQ ID NO 997 |
| NM_004176 | SEQ ID NO 998 |
| NM_004180 | SEQ ID NO 999 |
| NM_004181 | SEQ ID NO 1000 |
| NM_004184 | SEQ ID NO 1001 |
| NM_004203 | SEQ ID NO 1002 |
| NM_004207 | SEQ ID NO 1003 |
| NM_004217 | SEQ ID NO 1004 |
| NM_004219 | SEQ ID NO 1005 |
| NM_004221 | SEQ ID NO 1006 |
| NM_004233 | SEQ ID NO 1007 |
| NM_004244 | SEQ ID NO 1008 |
| NM_004252 | SEQ ID NO 1009 |
| NM_004265 | SEQ ID NO 1010 |
| NM_004267 | SEQ ID NO 1011 |
| NM_004281 | SEQ ID NO 1012 |
| NM_004289 | SEQ ID NO 1013 |
| NM_004298 | SEQ ID NO 1015 |
| NM_004301 | SEQ ID NO 1016 |
| NM_004305 | SEQ ID NO 1017 |
| NM_004311 | SEQ ID NO 1018 |
| NM_004315 | SEQ ID NO 1019 |
| NM_004323 | SEQ ID NO 1020 |
| NM_004330 | SEQ ID NO 1021 |
| NM_004336 | SEQ ID NO 1022 |
| NM_004338 | SEQ ID NO 1023 |
| NM_004350 | SEQ ID NO 1024 |
| NM_004354 | SEQ ID NO 1025 |
| NM_004358 | SEQ ID NO 1026 |
| NM_004360 | SEQ ID NO 1027 |
| NM_004362 | SEQ ID NO 1028 |
| NM_004374 | SEQ ID NO 1029 |
| NM_004378 | SEQ ID NO 1030 |
| NM_004392 | SEQ ID NO 1031 |
| NM_004395 | SEQ ID NO 1032 |
| NM_004414 | SEQ ID NO 1033 |
| NM_004418 | SEQ ID NO 1034 |
| NM_004425 | SEQ ID NO 1035 |
| NM_004431 | SEQ ID NO 1036 |
| NM_004436 | SEQ ID NO 1037 |
| NM_004438 | SEQ ID NO 1038 |
| NM_004443 | SEQ ID NO 1039 |
| NM_004446 | SEQ ID NO 1040 |
| NM_004451 | SEQ ID NO 1041 |
| NM_004454 | SEQ ID NO 1042 |
| NM_004456 | SEQ ID NO 1043 |
| NM_004458 | SEQ ID NO 1044 |
| NM_004472 | SEQ ID NO 1045 |
| NM_004480 | SEQ ID NO 1046 |
| NM_004482 | SEQ ID NO 1047 |
| NM_004494 | SEQ ID NO 1048 |
| NM_004496 | SEQ ID NO 1049 |
| NM_004503 | SEQ ID NO 1050 |
| NM_004504 | SEQ ID NO 1051 |
| NM_004515 | SEQ ID NO 1052 |
| NM_004522 | SEQ ID NO 1053 |
| NM_004523 | SEQ ID NO 1054 |
| NM_004525 | SEQ ID NO 1055 |
| NM_004556 | SEQ ID NO 1056 |
| NM_004559 | SEQ ID NO 1057 |
| NM_004569 | SEQ ID NO 1058 |
| NM_004577 | SEQ ID NO 1059 |
| NM_004585 | SEQ ID NO 1060 |
| NM_004587 | SEQ ID NO 1061 |
| NM_004594 | SEQ ID NO 1062 |
| NM_004599 | SEQ ID NO 1063 |
| NM_004633 | SEQ ID NO 1066 |
| NM_004642 | SEQ ID NO 1067 |
| NM_004648 | SEQ ID NO 1068 |
| NM_004663 | SEQ ID NO 1069 |
| NM_004664 | SEQ ID NO 1070 |
| NM_004684 | SEQ ID NO 1071 |
| NM_004688 | SEQ ID NO 1072 |
| NM_004694 | SEQ ID NO 1073 |
| NM_004695 | SEQ ID NO 1074 |
| NM_004701 | SEQ ID NO 1075 |
| NM_004708 | SEQ ID NO 1077 |
| NM_004711 | SEQ ID NO 1078 |
| NM_004726 | SEQ ID NO 1079 |
| NM_004750 | SEQ ID NO 1081 |
| NM_004761 | SEQ ID NO 1082 |
| NM_004762 | SEQ ID NO 1083 |
| NM_004780 | SEQ ID NO 1085 |
| NM_004791 | SEQ ID NO 1086 |
| NM_004798 | SEQ ID NO 1087 |
| NM_004808 | SEQ ID NO 1088 |
| NM_004811 | SEQ ID NO 1089 |

TABLE 1-continued 2,460 gene markers that distinguish ER(+) and ER(−) cell samples.

| GenBank Accession Number | SEQ ID NO |
|---|---|
| NM_004833 | SEQ ID NO 1090 |
| NM_004835 | SEQ ID NO 1091 |
| NM_004843 | SEQ ID NO 1092 |
| NM_004847 | SEQ ID NO 1093 |
| NM_004848 | SEQ ID NO 1094 |
| NM_004864 | SEQ ID NO 1095 |
| NM_004865 | SEQ ID NO 1096 |
| NM_004866 | SEQ ID NO 1097 |
| NM_004877 | SEQ ID NO 1098 |
| NM_004900 | SEQ ID NO 1099 |
| NM_004906 | SEQ ID NO 1100 |
| NM_004910 | SEQ ID NO 1101 |
| NM_004918 | SEQ ID NO 1103 |
| NM_004923 | SEQ ID NO 1104 |
| NM_004938 | SEQ ID NO 1105 |
| NM_004951 | SEQ ID NO 1106 |
| NM_004968 | SEQ ID NO 1107 |
| NM_004994 | SEQ ID NO 1108 |
| NM_004999 | SEQ ID NO 1109 |
| NM_005001 | SEQ ID NO 1110 |
| NM_005002 | SEQ ID NO 1111 |
| NM_005012 | SEQ ID NO 1112 |
| NM_005032 | SEQ ID NO 1113 |
| NM_005044 | SEQ ID NO 1114 |
| NM_005046 | SEQ ID NO 1115 |
| NM_005049 | SEQ ID NO 1116 |
| NM_005067 | SEQ ID NO 1117 |
| NM_005077 | SEQ ID NO 1118 |
| NM_005080 | SEQ ID NO 1119 |
| NM_005084 | SEQ ID NO 1120 |
| NM_005130 | SEQ ID NO 1122 |
| NM_005139 | SEQ ID NO 1123 |
| NM_005168 | SEQ ID NO 1125 |
| NM_005190 | SEQ ID NO 1126 |
| NM_005196 | SEQ ID NO 1127 |
| NM_005213 | SEQ ID NO 1128 |
| NM_005218 | SEQ ID NO 1129 |
| NM_005235 | SEQ ID NO 1130 |
| NM_005245 | SEQ ID NO 1131 |
| NM_005249 | SEQ ID NO 1132 |
| NM_005257 | SEQ ID NO 1133 |
| NM_005264 | SEQ ID NO 1134 |
| NM_005271 | SEQ ID NO 1135 |
| NM_005314 | SEQ ID NO 1136 |
| NM_005321 | SEQ ID NO 1137 |
| NM_005322 | SEQ ID NO 1138 |
| NM_005325 | SEQ ID NO 1139 |
| NM_005326 | SEQ ID NO 1140 |
| NM_005335 | SEQ ID NO 1141 |
| NM_005337 | SEQ ID NO 1142 |
| NM_005342 | SEQ ID NO 1143 |
| NM_005345 | SEQ ID NO 1144 |
| NM_005357 | SEQ ID NO 1145 |
| NM_005375 | SEQ ID NO 1146 |
| NM_005391 | SEQ ID NO 1147 |
| NM_005408 | SEQ ID NO 1148 |
| NM_005409 | SEQ ID NO 1149 |
| NM_005410 | SEQ ID NO 1150 |
| NM_005426 | SEQ ID NO 1151 |
| NM_005433 | SEQ ID NO 1152 |
| NM_005441 | SEQ ID NO 1153 |
| NM_005443 | SEQ ID NO 1154 |
| NM_005483 | SEQ ID NO 1155 |
| NM_005486 | SEQ ID NO 1156 |
| NM_005496 | SEQ ID NO 1157 |
| NM_005498 | SEQ ID NO 1158 |
| NM_005499 | SEQ ID NO 1159 |
| NM_005514 | SEQ ID NO 1160 |
| NM_005531 | SEQ ID NO 1162 |
| NM_005538 | SEQ ID NO 1163 |
| NM_005541 | SEQ ID NO 1164 |
| NM_005544 | SEQ ID NO 1165 |
| NM_005548 | SEQ ID NO 1166 |
| NM_005554 | SEQ ID NO 1167 |
| NM_005555 | SEQ ID NO 1168 |
| NM_005556 | SEQ ID NO 1169 |
| NM_005557 | SEQ ID NO 1170 |
| NM_005558 | SEQ ID NO 1171 |
| NM_005562 | SEQ ID NO 1172 |
| NM_005563 | SEQ ID NO 1173 |
| NM_005565 | SEQ ID NO 1174 |
| NM_005566 | SEQ ID NO 1175 |
| NM_005572 | SEQ ID NO 1176 |
| NM_005582 | SEQ ID NO 1177 |
| NM_005608 | SEQ ID NO 1178 |
| NM_005614 | SEQ ID NO 1179 |
| NM_005617 | SEQ ID NO 1180 |
| NM_005620 | SEQ ID NO 1181 |
| NM_005625 | SEQ ID NO 1182 |
| NM_005651 | SEQ ID NO 1183 |
| NM_005658 | SEQ ID NO 1184 |
| NM_005659 | SEQ ID NO 1185 |
| NM_005667 | SEQ ID NO 1186 |
| NM_005686 | SEQ ID NO 1187 |
| NM_005690 | SEQ ID NO 1188 |
| NM_005720 | SEQ ID NO 1190 |
| NM_005727 | SEQ ID NO 1191 |
| NM_005733 | SEQ ID NO 1192 |
| NM_005737 | SEQ ID NO 1193 |
| NM_005742 | SEQ ID NO 1194 |
| NM_005746 | SEQ ID NO 1195 |
| NM_005749 | SEQ ID NO 1196 |
| NM_005760 | SEQ ID NO 1197 |
| NM_005764 | SEQ ID NO 1198 |
| NM_005794 | SEQ ID NO 1199 |
| NM_005796 | SEQ ID NO 1200 |
| NM_005804 | SEQ ID NO 1201 |
| NM_005813 | SEQ ID NO 1202 |
| NM_005824 | SEQ ID NO 1203 |
| NM_005825 | SEQ ID NO 1204 |
| NM_005849 | SEQ ID NO 1205 |
| NM_005853 | SEQ ID NO 1206 |
| NM_005855 | SEQ ID NO 1207 |
| NM_005864 | SEQ ID NO 1208 |
| NM_005874 | SEQ ID NO 1209 |
| NM_005876 | SEQ ID NO 1210 |
| NM_005880 | SEQ ID NO 1211 |
| NM_005891 | SEQ ID NO 1212 |
| NM_005892 | SEQ ID NO 1213 |
| NM_005899 | SEQ ID NO 1214 |
| NM_005915 | SEQ ID NO 1215 |
| NM_005919 | SEQ ID NO 1216 |
| NM_005923 | SEQ ID NO 1217 |
| NM_005928 | SEQ ID NO 1218 |
| NM_005932 | SEQ ID NO 1219 |
| NM_005935 | SEQ ID NO 1220 |
| NM_005945 | SEQ ID NO 1221 |
| NM_005953 | SEQ ID NO 1222 |
| NM_005978 | SEQ ID NO 1223 |
| NM_005990 | SEQ ID NO 1224 |
| NM_006002 | SEQ ID NO 1225 |
| NM_006004 | SEQ ID NO 1226 |
| NM_006005 | SEQ ID NO 1227 |
| NM_006006 | SEQ ID NO 1228 |
| NM_006017 | SEQ ID NO 1229 |
| NM_006018 | SEQ ID NO 1230 |
| NM_006023 | SEQ ID NO 1231 |
| NM_006027 | SEQ ID NO 1232 |
| NM_006029 | SEQ ID NO 1233 |
| NM_006033 | SEQ ID NO 1234 |
| NM_006051 | SEQ ID NO 1235 |
| NM_006055 | SEQ ID NO 1236 |
| NM_006074 | SEQ ID NO 1237 |
| NM_006086 | SEQ ID NO 1238 |
| NM_006087 | SEQ ID NO 1239 |
| NM_006096 | SEQ ID NO 1240 |

TABLE 1-continued 2,460 gene markers that distinguish ER(+) and ER(−) cell samples.

| GenBank Accession Number | SEQ ID NO |
|---|---|
| NM_006101 | SEQ ID NO 1241 |
| NM_006103 | SEQ ID NO 1242 |
| NM_006111 | SEQ ID NO 1243 |
| NM_006113 | SEQ ID NO 1244 |
| NM_006115 | SEQ ID NO 1245 |
| NM_006117 | SEQ ID NO 1246 |
| NM_006142 | SEQ ID NO 1247 |
| NM_006144 | SEQ ID NO 1248 |
| NM_006148 | SEQ ID NO 1249 |
| NM_006153 | SEQ ID NO 1250 |
| NM_006159 | SEQ ID NO 1251 |
| NM_006170 | SEQ ID NO 1252 |
| NM_006197 | SEQ ID NO 1253 |
| NM_006224 | SEQ ID NO 1255 |
| NM_006227 | SEQ ID NO 1256 |
| NM_006235 | SEQ ID NO 1257 |
| NM_006243 | SEQ ID NO 1258 |
| NM_006264 | SEQ ID NO 1259 |
| NM_006271 | SEQ ID NO 1261 |
| NM_006274 | SEQ ID NO 1262 |
| NM_006290 | SEQ ID NO 1265 |
| NM_006291 | SEQ ID NO 1266 |
| NM_006296 | SEQ ID NO 1267 |
| NM_006304 | SEQ ID NO 1268 |
| NM_006314 | SEQ ID NO 1269 |
| NM_006332 | SEQ ID NO 1270 |
| NM_006357 | SEQ ID NO 1271 |
| NM_006366 | SEQ ID NO 1272 |
| NM_006372 | SEQ ID NO 1273 |
| NM_006377 | SEQ ID NO 1274 |
| NM_006378 | SEQ ID NO 1275 |
| NM_006383 | SEQ ID NO 1276 |
| NM_006389 | SEQ ID NO 1277 |
| NM_006393 | SEQ ID NO 1278 |
| NM_006398 | SEQ ID NO 1279 |
| NM_006406 | SEQ ID NO 1280 |
| NM_006408 | SEQ ID NO 1281 |
| NM_006410 | SEQ ID NO 1282 |
| NM_006414 | SEQ ID NO 1283 |
| NM_006417 | SEQ ID NO 1284 |
| NM_006430 | SEQ ID NO 1285 |
| NM_006460 | SEQ ID NO 1286 |
| NM_006461 | SEQ ID NO 1287 |
| NM_006469 | SEQ ID NO 1288 |
| NM_006470 | SEQ ID NO 1289 |
| NM_006491 | SEQ ID NO 1290 |
| NM_006495 | SEQ ID NO 1291 |
| NM_006500 | SEQ ID NO 1292 |
| NM_006509 | SEQ ID NO 1293 |
| NM_006516 | SEQ ID NO 1294 |
| NM_006533 | SEQ ID NO 1295 |
| NM_006551 | SEQ ID NO 1296 |
| NM_006556 | SEQ ID NO 1297 |
| NM_006558 | SEQ ID NO 1298 |
| NM_006564 | SEQ ID NO 1299 |
| NM_006573 | SEQ ID NO 1300 |
| NM_006607 | SEQ ID NO 1301 |
| NM_006622 | SEQ ID NO 1302 |
| NM_006623 | SEQ ID NO 1303 |
| NM_006636 | SEQ ID NO 1304 |
| NM_006670 | SEQ ID NO 1305 |
| NM_006681 | SEQ ID NO 1306 |
| NM_006682 | SEQ ID NO 1307 |
| NM_006696 | SEQ ID NO 1308 |
| NM_006698 | SEQ ID NO 1309 |
| NM_006705 | SEQ ID NO 1310 |
| NM_006739 | SEQ ID NO 1311 |
| NM_006748 | SEQ ID NO 1312 |
| NM_006759 | SEQ ID NO 1313 |
| NM_006762 | SEQ ID NO 1314 |
| NM_006763 | SEQ ID NO 1315 |
| NM_006769 | SEQ ID NO 1316 |
| NM_006770 | SEQ ID NO 1317 |
| NM_006780 | SEQ ID NO 1318 |
| NM_006787 | SEQ ID NO 1319 |
| NM_006806 | SEQ ID NO 1320 |
| NM_006813 | SEQ ID NO 1321 |
| NM_006825 | SEQ ID NO 1322 |
| NM_006826 | SEQ ID NO 1323 |
| NM_006829 | SEQ ID NO 1324 |
| NM_006834 | SEQ ID NO 1325 |
| NM_006835 | SEQ ID NO 1326 |
| NM_006840 | SEQ ID NO 1327 |
| NM_006845 | SEQ ID NO 1328 |
| NM_006847 | SEQ ID NO 1329 |
| NM_006851 | SEQ ID NO 1330 |
| NM_006855 | SEQ ID NO 1331 |
| NM_006864 | SEQ ID NO 1332 |
| NM_006868 | SEQ ID NO 1333 |
| NM_006875 | SEQ ID NO 1334 |
| NM_006889 | SEQ ID NO 1336 |
| NM_006892 | SEQ ID NO 1337 |
| NM_006912 | SEQ ID NO 1338 |
| NM_006931 | SEQ ID NO 1341 |
| NM_006941 | SEQ ID NO 1342 |
| NM_006943 | SEQ ID NO 1343 |
| NM_006984 | SEQ ID NO 1344 |
| NM_007005 | SEQ ID NO 1345 |
| NM_007006 | SEQ ID NO 1346 |
| NM_007019 | SEQ ID NO 1347 |
| NM_007027 | SEQ ID NO 1348 |
| NM_007044 | SEQ ID NO 1350 |
| NM_007050 | SEQ ID NO 1351 |
| NM_007057 | SEQ ID NO 1352 |
| NM_007069 | SEQ ID NO 1353 |
| NM_007074 | SEQ ID NO 1355 |
| NM_007088 | SEQ ID NO 1356 |
| NM_007111 | SEQ ID NO 1357 |
| NM_007146 | SEQ ID NO 1358 |
| NM_007173 | SEQ ID NO 1359 |
| NM_007177 | SEQ ID NO 1360 |
| NM_007196 | SEQ ID NO 1361 |
| NM_007203 | SEQ ID NO 1362 |
| NM_007214 | SEQ ID NO 1363 |
| NM_007217 | SEQ ID NO 1364 |
| NM_007231 | SEQ ID NO 1365 |
| NM_007268 | SEQ ID NO 1367 |
| NM_007274 | SEQ ID NO 1368 |
| NM_007275 | SEQ ID NO 1369 |
| NM_007281 | SEQ ID NO 1370 |
| NM_007309 | SEQ ID NO 1371 |
| NM_007315 | SEQ ID NO 1372 |
| NM_007334 | SEQ ID NO 1373 |
| NM_007358 | SEQ ID NO 1374 |
| NM_009585 | SEQ ID NO 1375 |
| NM_009587 | SEQ ID NO 1376 |
| NM_009588 | SEQ ID NO 1377 |
| NM_012062 | SEQ ID NO 1378 |
| NM_012067 | SEQ ID NO 1379 |
| NM_012101 | SEQ ID NO 1380 |
| NM_012105 | SEQ ID NO 1381 |
| NM_012108 | SEQ ID NO 1382 |
| NM_012110 | SEQ ID NO 1383 |
| NM_012124 | SEQ ID NO 1384 |
| NM_012142 | SEQ ID NO 1386 |
| NM_012155 | SEQ ID NO 1388 |
| NM_012175 | SEQ ID NO 1389 |
| NM_012177 | SEQ ID NO 1390 |
| NM_012205 | SEQ ID NO 1391 |
| NM_012219 | SEQ ID NO 1393 |
| NM_012242 | SEQ ID NO 1394 |
| NM_012250 | SEQ ID NO 1395 |
| NM_012261 | SEQ ID NO 1397 |
| NM_012286 | SEQ ID NO 1398 |
| NM_012319 | SEQ ID NO 1400 |
| NM_012332 | SEQ ID NO 1401 |

TABLE 1-continued 2,460 gene markers that distinguish ER(+) and ER(−) cell samples.

| GenBank Accession Number | SEQ ID NO |
|---|---|
| NM_012336 | SEQ ID NO 1402 |
| NM_012339 | SEQ ID NO 1404 |
| NM_012341 | SEQ ID NO 1405 |
| NM_012391 | SEQ ID NO 1406 |
| NM_012394 | SEQ ID NO 1407 |
| NM_012413 | SEQ ID NO 1408 |
| NM_012421 | SEQ ID NO 1409 |
| NM_012425 | SEQ ID NO 1410 |
| NM_012427 | SEQ ID NO 1411 |
| NM_012429 | SEQ ID NO 1413 |
| NM_012446 | SEQ ID NO 1414 |
| NM_012463 | SEQ ID NO 1415 |
| NM_012474 | SEQ ID NO 1416 |
| NM_013230 | SEQ ID NO 1417 |
| NM_013233 | SEQ ID NO 1418 |
| NM_013238 | SEQ ID NO 1419 |
| NM_013239 | SEQ ID NO 1420 |
| NM_013242 | SEQ ID NO 1421 |
| NM_013257 | SEQ ID NO 1423 |
| NM_013261 | SEQ ID NO 1424 |
| NM_013262 | SEQ ID NO 1425 |
| NM_013277 | SEQ ID NO 1426 |
| NM_013296 | SEQ ID NO 1427 |
| NM_013301 | SEQ ID NO 1428 |
| NM_013324 | SEQ ID NO 1429 |
| NM_013327 | SEQ ID NO 1430 |
| NM_013336 | SEQ ID NO 1431 |
| NM_013339 | SEQ ID NO 1432 |
| NM_013363 | SEQ ID NO 1433 |
| NM_013378 | SEQ ID NO 1435 |
| NM_013384 | SEQ ID NO 1436 |
| NM_013385 | SEQ ID NO 1437 |
| NM_013406 | SEQ ID NO 1438 |
| NM_013437 | SEQ ID NO 1439 |
| NM_013451 | SEQ ID NO 1440 |
| NM_013943 | SEQ ID NO 1441 |
| NM_013994 | SEQ ID NO 1442 |
| NM_013995 | SEQ ID NO 1443 |
| NM_014026 | SEQ ID NO 1444 |
| NM_014029 | SEQ ID NO 1445 |
| NM_014036 | SEQ ID NO 1446 |
| NM_014062 | SEQ ID NO 1447 |
| NM_014074 | SEQ ID NO 1448 |
| NM_014096 | SEQ ID NO 1450 |
| NM_014109 | SEQ ID NO 1451 |
| NM_014112 | SEQ ID NO 1452 |
| NM_014147 | SEQ ID NO 1453 |
| NM_014149 | SEQ ID NO 1454 |
| NM_014164 | SEQ ID NO 1455 |
| NM_014172 | SEQ ID NO 1456 |
| NM_014175 | SEQ ID NO 1457 |
| NM_014181 | SEQ ID NO 1458 |
| NM_014184 | SEQ ID NO 1459 |
| NM_014211 | SEQ ID NO 1460 |
| NM_014214 | SEQ ID NO 1461 |
| NM_014216 | SEQ ID NO 1462 |
| NM_014241 | SEQ ID NO 1463 |
| NM_014246 | SEQ ID NO 1465 |
| NM_014268 | SEQ ID NO 1466 |
| NM_014272 | SEQ ID NO 1467 |
| NM_014274 | SEQ ID NO 1468 |
| NM_014289 | SEQ ID NO 1469 |
| NM_014298 | SEQ ID NO 1470 |
| NM_014302 | SEQ ID NO 1471 |
| NM_014315 | SEQ ID NO 1473 |
| NM_014316 | SEQ ID NO 1474 |
| NM_014317 | SEQ ID NO 1475 |
| NM_014320 | SEQ ID NO 1476 |
| NM_014321 | SEQ ID NO 1477 |
| NM_014325 | SEQ ID NO 1478 |
| NM_014335 | SEQ ID NO 1479 |
| NM_014363 | SEQ ID NO 1480 |
| NM_014364 | SEQ ID NO 1481 |
| NM_014365 | SEQ ID NO 1482 |
| NM_014373 | SEQ ID NO 1483 |
| NM_014382 | SEQ ID NO 1484 |
| NM_014395 | SEQ ID NO 1485 |
| NM_014398 | SEQ ID NO 1486 |
| NM_014399 | SEQ ID NO 1487 |
| NM_014402 | SEQ ID NO 1488 |
| NM_014428 | SEQ ID NO 1489 |
| NM_014448 | SEQ ID NO 1490 |
| NM_014449 | SEQ ID NO 1491 |
| NM_014450 | SEQ ID NO 1492 |
| NM_014452 | SEQ ID NO 1493 |
| NM_014453 | SEQ ID NO 1494 |
| NM_014456 | SEQ ID NO 1495 |
| NM_014479 | SEQ ID NO 1497 |
| NM_014501 | SEQ ID NO 1498 |
| NM_014552 | SEQ ID NO 1500 |
| NM_014553 | SEQ ID NO 1501 |
| NM_014570 | SEQ ID NO 1502 |
| NM_014575 | SEQ ID NO 1503 |
| NM_014585 | SEQ ID NO 1504 |
| NM_014595 | SEQ ID NO 1505 |
| NM_014624 | SEQ ID NO 1507 |
| NM_014633 | SEQ ID NO 1508 |
| NM_014640 | SEQ ID NO 1509 |
| NM_014642 | SEQ ID NO 1510 |
| NM_014643 | SEQ ID NO 1511 |
| NM_014656 | SEQ ID NO 1512 |
| NM_014668 | SEQ ID NO 1513 |
| NM_014669 | SEQ ID NO 1514 |
| NM_014673 | SEQ ID NO 1515 |
| NM_014675 | SEQ ID NO 1516 |
| NM_014679 | SEQ ID NO 1517 |
| NM_014680 | SEQ ID NO 1518 |
| NM_014696 | SEQ ID NO 1519 |
| NM_014700 | SEQ ID NO 1520 |
| NM_014715 | SEQ ID NO 1521 |
| NM_014721 | SEQ ID NO 1522 |
| NM_014737 | SEQ ID NO 1524 |
| NM_014738 | SEQ ID NO 1525 |
| NM_014747 | SEQ ID NO 1526 |
| NM_014750 | SEQ ID NO 1527 |
| NM_014754 | SEQ ID NO 1528 |
| NM_014767 | SEQ ID NO 1529 |
| NM_014770 | SEQ ID NO 1530 |
| NM_014773 | SEQ ID NO 1531 |
| NM_014776 | SEQ ID NO 1532 |
| NM_014782 | SEQ ID NO 1533 |
| NM_014785 | SEQ ID NO 1534 |
| NM_014791 | SEQ ID NO 1535 |
| NM_014808 | SEQ ID NO 1536 |
| NM_014811 | SEQ ID NO 1537 |
| NM_014812 | SEQ ID NO 1538 |
| NM_014838 | SEQ ID NO 1540 |
| NM_014862 | SEQ ID NO 1542 |
| NM_014865 | SEQ ID NO 1543 |
| NM_014870 | SEQ ID NO 1544 |
| NM_014875 | SEQ ID NO 1545 |
| NM_014886 | SEQ ID NO 1547 |
| NM_014889 | SEQ ID NO 1548 |
| NM_014905 | SEQ ID NO 1549 |
| NM_014935 | SEQ ID NO 1550 |
| NM_014945 | SEQ ID NO 1551 |
| NM_014965 | SEQ ID NO 1552 |
| NM_014967 | SEQ ID NO 1553 |
| NM_014968 | SEQ ID NO 1554 |
| NM_015032 | SEQ ID NO 1555 |
| NM_015239 | SEQ ID NO 1556 |
| NM_015383 | SEQ ID NO 1557 |
| NM_015392 | SEQ ID NO 1558 |
| NM_015416 | SEQ ID NO 1559 |
| NM_015417 | SEQ ID NO 1560 |
| NM_015420 | SEQ ID NO 1561 |

TABLE 1-continued 2,460 gene markers that distinguish ER(+) and ER(−) cell samples.

| GenBank Accession Number | SEQ ID NO |
|---|---|
| NM_015434 | SEQ ID NO 1562 |
| NM_015474 | SEQ ID NO 1563 |
| NM_015507 | SEQ ID NO 1565 |
| NM_015513 | SEQ ID NO 1566 |
| NM_015515 | SEQ ID NO 1567 |
| NM_015523 | SEQ ID NO 1568 |
| NM_015524 | SEQ ID NO 1569 |
| NM_015599 | SEQ ID NO 1571 |
| NM_015623 | SEQ ID NO 1572 |
| NM_015640 | SEQ ID NO 1573 |
| NM_015641 | SEQ ID NO 1574 |
| NM_015678 | SEQ ID NO 1575 |
| NM_015721 | SEQ ID NO 1576 |
| NM_015892 | SEQ ID NO 1578 |
| NM_015895 | SEQ ID NO 1579 |
| NM_015907 | SEQ ID NO 1580 |
| NM_015925 | SEQ ID NO 1581 |
| NM_015937 | SEQ ID NO 1582 |
| NM_015954 | SEQ ID NO 1583 |
| NM_015955 | SEQ ID NO 1584 |
| NM_015961 | SEQ ID NO 1585 |
| NM_015984 | SEQ ID NO 1587 |
| NM_015986 | SEQ ID NO 1588 |
| NM_015987 | SEQ ID NO 1589 |
| NM_015991 | SEQ ID NO 1590 |
| NM_016002 | SEQ ID NO 1592 |
| NM_016028 | SEQ ID NO 1594 |
| NM_016029 | SEQ ID NO 1595 |
| NM_016047 | SEQ ID NO 1596 |
| NM_016048 | SEQ ID NO 1597 |
| NM_016050 | SEQ ID NO 1598 |
| NM_016056 | SEQ ID NO 1599 |
| NM_016058 | SEQ ID NO 1600 |
| NM_016066 | SEQ ID NO 1601 |
| NM_016072 | SEQ ID NO 1602 |
| NM_016073 | SEQ ID NO 1603 |
| NM_016108 | SEQ ID NO 1605 |
| NM_016109 | SEQ ID NO 1606 |
| NM_016121 | SEQ ID NO 1607 |
| NM_016126 | SEQ ID NO 1608 |
| NM_016127 | SEQ ID NO 1609 |
| NM_016135 | SEQ ID NO 1610 |
| NM_016142 | SEQ ID NO 1612 |
| NM_016153 | SEQ ID NO 1613 |
| NM_016171 | SEQ ID NO 1614 |
| NM_016175 | SEQ ID NO 1615 |
| NM_016184 | SEQ ID NO 1616 |
| NM_016185 | SEQ ID NO 1617 |
| NM_016187 | SEQ ID NO 1618 |
| NM_016199 | SEQ ID NO 1619 |
| NM_016210 | SEQ ID NO 1620 |
| NM_016217 | SEQ ID NO 1621 |
| NM_016228 | SEQ ID NO 1623 |
| NM_016229 | SEQ ID NO 1624 |
| NM_016235 | SEQ ID NO 1625 |
| NM_016240 | SEQ ID NO 1626 |
| NM_016243 | SEQ ID NO 1627 |
| NM_016250 | SEQ ID NO 1628 |
| NM_016267 | SEQ ID NO 1629 |
| NM_016271 | SEQ ID NO 1630 |
| NM_016299 | SEQ ID NO 1631 |
| NM_016306 | SEQ ID NO 1632 |
| NM_016308 | SEQ ID NO 1634 |
| NM_016321 | SEQ ID NO 1635 |
| NM_016337 | SEQ ID NO 1636 |
| NM_016352 | SEQ ID NO 1637 |
| NM_016359 | SEQ ID NO 1638 |
| NM_016401 | SEQ ID NO 1641 |
| NM_016403 | SEQ ID NO 1642 |
| NM_016411 | SEQ ID NO 1643 |
| NM_016423 | SEQ ID NO 1644 |
| NM_016463 | SEQ ID NO 1647 |
| NM_016475 | SEQ ID NO 1649 |
| NM_016477 | SEQ ID NO 1650 |
| NM_016491 | SEQ ID NO 1651 |
| NM_016495 | SEQ ID NO 1652 |
| NM_016542 | SEQ ID NO 1653 |
| NM_016548 | SEQ ID NO 1654 |
| NM_016569 | SEQ ID NO 1655 |
| NM_016577 | SEQ ID NO 1656 |
| NM_016582 | SEQ ID NO 1657 |
| NM_016593 | SEQ ID NO 1658 |
| NM_016603 | SEQ ID NO 1659 |
| NM_016612 | SEQ ID NO 1660 |
| NM_016619 | SEQ ID NO 1661 |
| NM_016623 | SEQ ID NO 1663 |
| NM_016625 | SEQ ID NO 1664 |
| NM_016629 | SEQ ID NO 1665 |
| NM_016640 | SEQ ID NO 1666 |
| NM_016645 | SEQ ID NO 1667 |
| NM_016650 | SEQ ID NO 1668 |
| NM_016657 | SEQ ID NO 1669 |
| NM_016733 | SEQ ID NO 1670 |
| NM_016815 | SEQ ID NO 1671 |
| NM_016817 | SEQ ID NO 1672 |
| NM_016818 | SEQ ID NO 1673 |
| NM_016839 | SEQ ID NO 1675 |
| NM_017414 | SEQ ID NO 1676 |
| NM_017422 | SEQ ID NO 1677 |
| NM_017423 | SEQ ID NO 1678 |
| NM_017447 | SEQ ID NO 1679 |
| NM_017518 | SEQ ID NO 1680 |
| NM_017522 | SEQ ID NO 1681 |
| NM_017540 | SEQ ID NO 1682 |
| NM_017555 | SEQ ID NO 1683 |
| NM_017572 | SEQ ID NO 1684 |
| NM_017585 | SEQ ID NO 1685 |
| NM_017586 | SEQ ID NO 1686 |
| NM_017596 | SEQ ID NO 1687 |
| NM_017606 | SEQ ID NO 1688 |
| NM_017617 | SEQ ID NO 1689 |
| NM_017633 | SEQ ID NO 1690 |
| NM_017634 | SEQ ID NO 1691 |
| NM_017646 | SEQ ID NO 1692 |
| NM_017660 | SEQ ID NO 1693 |
| NM_017680 | SEQ ID NO 1694 |
| NM_017691 | SEQ ID NO 1695 |
| NM_017698 | SEQ ID NO 1696 |
| NM_017702 | SEQ ID NO 1697 |
| NM_017731 | SEQ ID NO 1699 |
| NM_017732 | SEQ ID NO 1700 |
| NM_017733 | SEQ ID NO 1701 |
| NM_017734 | SEQ ID NO 1702 |
| NM_017746 | SEQ ID NO 1703 |
| NM_017750 | SEQ ID NO 1704 |
| NM_017761 | SEQ ID NO 1705 |
| NM_017763 | SEQ ID NO 1706 |
| NM_017770 | SEQ ID NO 1707 |
| NM_017779 | SEQ ID NO 1708 |
| NM_017780 | SEQ ID NO 1709 |
| NM_017782 | SEQ ID NO 1710 |
| NM_017786 | SEQ ID NO 1711 |
| NM_017791 | SEQ ID NO 1712 |
| NM_017805 | SEQ ID NO 1713 |
| NM_017816 | SEQ ID NO 1714 |
| NM_017821 | SEQ ID NO 1715 |
| NM_017835 | SEQ ID NO 1716 |
| NM_017843 | SEQ ID NO 1717 |
| NM_017857 | SEQ ID NO 1718 |
| NM_017901 | SEQ ID NO 1719 |
| NM_017906 | SEQ ID NO 1720 |
| NM_017918 | SEQ ID NO 1721 |
| NM_017961 | SEQ ID NO 1722 |
| NM_017996 | SEQ ID NO 1723 |
| NM_018000 | SEQ ID NO 1724 |
| NM_018004 | SEQ ID NO 1725 |

TABLE 1-continued 2,460 gene markers that distinguish ER(+) and ER(−) cell samples.

| GenBank Accession Number | SEQ ID NO |
|---|---|
| NM_018011 | SEQ ID NO 1726 |
| NM_018014 | SEQ ID NO 1727 |
| NM_018022 | SEQ ID NO 1728 |
| NM_018031 | SEQ ID NO 1729 |
| NM_018043 | SEQ ID NO 1730 |
| NM_018048 | SEQ ID NO 1731 |
| NM_018062 | SEQ ID NO 1732 |
| NM_018069 | SEQ ID NO 1733 |
| NM_018072 | SEQ ID NO 1734 |
| NM_018077 | SEQ ID NO 1735 |
| NM_018086 | SEQ ID NO 1736 |
| NM_018087 | SEQ ID NO 1737 |
| NM_018093 | SEQ ID NO 1738 |
| NM_018098 | SEQ ID NO 1739 |
| NM_018099 | SEQ ID NO 1740 |
| NM_018101 | SEQ ID NO 1741 |
| NM_018103 | SEQ ID NO 1742 |
| NM_018109 | SEQ ID NO 1744 |
| NM_018123 | SEQ ID NO 1746 |
| NM_018131 | SEQ ID NO 1747 |
| NM_018136 | SEQ ID NO 1748 |
| NM_018138 | SEQ ID NO 1749 |
| NM_018166 | SEQ ID NO 1750 |
| NM_018171 | SEQ ID NO 1751 |
| NM_018178 | SEQ ID NO 1752 |
| NM_018181 | SEQ ID NO 1753 |
| NM_018186 | SEQ ID NO 1754 |
| NM_018188 | SEQ ID NO 1756 |
| NM_018194 | SEQ ID NO 1757 |
| NM_018204 | SEQ ID NO 1758 |
| NM_018208 | SEQ ID NO 1759 |
| NM_018212 | SEQ ID NO 1760 |
| NM_018234 | SEQ ID NO 1763 |
| NM_018255 | SEQ ID NO 1764 |
| NM_018257 | SEQ ID NO 1765 |
| NM_018265 | SEQ ID NO 1766 |
| NM_018271 | SEQ ID NO 1767 |
| NM_018290 | SEQ ID NO 1768 |
| NM_018295 | SEQ ID NO 1769 |
| NM_018304 | SEQ ID NO 1770 |
| NM_018306 | SEQ ID NO 1771 |
| NM_018326 | SEQ ID NO 1772 |
| NM_018346 | SEQ ID NO 1773 |
| NM_018366 | SEQ ID NO 1775 |
| NM_018370 | SEQ ID NO 1776 |
| NM_018373 | SEQ ID NO 1777 |
| NM_018379 | SEQ ID NO 1778 |
| NM_018384 | SEQ ID NO 1779 |
| NM_018389 | SEQ ID NO 1780 |
| NM_018410 | SEQ ID NO 1783 |
| NM_018439 | SEQ ID NO 1785 |
| NM_018454 | SEQ ID NO 1786 |
| NM_018455 | SEQ ID NO 1787 |
| NM_018465 | SEQ ID NO 1788 |
| NM_018471 | SEQ ID NO 1789 |
| NM_018478 | SEQ ID NO 1790 |
| NM_018479 | SEQ ID NO 1791 |
| NM_018529 | SEQ ID NO 1793 |
| NM_018556 | SEQ ID NO 1794 |
| NM_018569 | SEQ ID NO 1795 |
| NM_018584 | SEQ ID NO 1796 |
| NM_018653 | SEQ ID NO 1797 |
| NM_018660 | SEQ ID NO 1798 |
| NM_018683 | SEQ ID NO 1799 |
| NM_018685 | SEQ ID NO 1800 |
| NM_018686 | SEQ ID NO 1801 |
| NM_018695 | SEQ ID NO 1802 |
| NM_018728 | SEQ ID NO 1803 |
| NM_018840 | SEQ ID NO 1804 |
| NM_018842 | SEQ ID NO 1805 |
| NM_018950 | SEQ ID NO 1806 |
| NM_018988 | SEQ ID NO 1807 |
| NM_019000 | SEQ ID NO 1808 |
| NM_019013 | SEQ ID NO 1809 |
| NM_019025 | SEQ ID NO 1810 |
| NM_019027 | SEQ ID NO 1811 |
| NM_019041 | SEQ ID NO 1812 |
| NM_019044 | SEQ ID NO 1813 |
| NM_019063 | SEQ ID NO 1815 |
| NM_019084 | SEQ ID NO 1816 |
| NM_019554 | SEQ ID NO 1817 |
| NM_019845 | SEQ ID NO 1818 |
| NM_019858 | SEQ ID NO 1819 |
| NM_020130 | SEQ ID NO 1820 |
| NM_020133 | SEQ ID NO 1821 |
| NM_020143 | SEQ ID NO 1822 |
| NM_020150 | SEQ ID NO 1823 |
| NM_020163 | SEQ ID NO 1824 |
| NM_020166 | SEQ ID NO 1825 |
| NM_020169 | SEQ ID NO 1826 |
| NM_020179 | SEQ ID NO 1827 |
| NM_020184 | SEQ ID NO 1828 |
| NM_020186 | SEQ ID NO 1829 |
| NM_020188 | SEQ ID NO 1830 |
| NM_020189 | SEQ ID NO 1831 |
| NM_020197 | SEQ ID NO 1832 |
| NM_020199 | SEQ ID NO 1833 |
| NM_020215 | SEQ ID NO 1834 |
| NM_020347 | SEQ ID NO 1836 |
| NM_020365 | SEQ ID NO 1837 |
| NM_020386 | SEQ ID NO 1838 |
| NM_020445 | SEQ ID NO 1839 |
| NM_020639 | SEQ ID NO 1840 |
| NM_020659 | SEQ ID NO 1841 |
| NM_020675 | SEQ ID NO 1842 |
| NM_020686 | SEQ ID NO 1843 |
| NM_020974 | SEQ ID NO 1844 |
| NM_020978 | SEQ ID NO 1845 |
| NM_020979 | SEQ ID NO 1846 |
| NM_020980 | SEQ ID NO 1847 |
| NM_021000 | SEQ ID NO 1849 |
| NM_021004 | SEQ ID NO 1850 |
| NM_021025 | SEQ ID NO 1851 |
| NM_021063 | SEQ ID NO 1852 |
| NM_021065 | SEQ ID NO 1853 |
| NM_021077 | SEQ ID NO 1854 |
| NM_021095 | SEQ ID NO 1855 |
| NM_021101 | SEQ ID NO 1856 |
| NM_021103 | SEQ ID NO 1857 |
| NM_021128 | SEQ ID NO 1858 |
| NM_021147 | SEQ ID NO 1859 |
| NM_021151 | SEQ ID NO 1860 |
| NM_021181 | SEQ ID NO 1861 |
| NM_021190 | SEQ ID NO 1862 |
| NM_021198 | SEQ ID NO 1863 |
| NM_021200 | SEQ ID NO 1864 |
| NM_021203 | SEQ ID NO 1865 |
| NM_021238 | SEQ ID NO 1866 |
| NM_021242 | SEQ ID NO 1867 |
| S40706 | SEQ ID NO 1869 |
| S53354 | SEQ ID NO 1870 |
| S59184 | SEQ ID NO 1871 |
| S62138 | SEQ ID NO 1872 |
| U09848 | SEQ ID NO 1873 |
| U10991 | SEQ ID NO 1874 |
| U17077 | SEQ ID NO 1875 |
| U18919 | SEQ ID NO 1876 |
| U41387 | SEQ ID NO 1877 |
| U45975 | SEQ ID NO 1878 |
| U49835 | SEQ ID NO 1879 |
| U56725 | SEQ ID NO 1880 |
| U58033 | SEQ ID NO 1881 |
| U61167 | SEQ ID NO 1882 |
| U66042 | SEQ ID NO 1883 |
| U68385 | SEQ ID NO 1885 |
| U68494 | SEQ ID NO 1886 |

TABLE 1-continued 2,460 gene markers that distinguish ER(+) and ER(−) cell samples.

| GenBank Accession Number | SEQ ID NO |
|---|---|
| U74612 | SEQ ID NO 1887 |
| U75968 | SEQ ID NO 1888 |
| U79293 | SEQ ID NO 1889 |
| U80736 | SEQ ID NO 1890 |
| U82987 | SEQ ID NO 1891 |
| U83115 | SEQ ID NO 1892 |
| U89715 | SEQ ID NO 1893 |
| U90916 | SEQ ID NO 1894 |
| U92544 | SEQ ID NO 1895 |
| U96131 | SEQ ID NO 1896 |
| U96394 | SEQ ID NO 1897 |
| W61000_RC | SEQ ID NO 1898 |
| X00437 | SEQ ID NO 1899 |
| X00497 | SEQ ID NO 1900 |
| X01394 | SEQ ID NO 1901 |
| X03084 | SEQ ID NO 1902 |
| X07834 | SEQ ID NO 1905 |
| X14356 | SEQ ID NO 1906 |
| X16302 | SEQ ID NO 1907 |
| X52486 | SEQ ID NO 1909 |
| X52882 | SEQ ID NO 1910 |
| X56807 | SEQ ID NO 1911 |
| X57809 | SEQ ID NO 1912 |
| X57819 | SEQ ID NO 1913 |
| X58529 | SEQ ID NO 1914 |
| X59405 | SEQ ID NO 1915 |
| X72475 | SEQ ID NO 1918 |
| X73617 | SEQ ID NO 1919 |
| X74794 | SEQ ID NO 1920 |
| X75315 | SEQ ID NO 1921 |
| X79782 | SEQ ID NO 1922 |
| X82693 | SEQ ID NO 1923 |
| X83301 | SEQ ID NO 1924 |
| X93006 | SEQ ID NO 1926 |
| X94232 | SEQ ID NO 1927 |
| X98834 | SEQ ID NO 1929 |
| X99142 | SEQ ID NO 1930 |
| Y14737 | SEQ ID NO 1932 |
| Z11887 | SEQ ID NO 1933 |
| Z48633 | SEQ ID NO 1935 |
| NM_004222 | SEQ ID NO 1936 |
| NM_016405 | SEQ ID NO 1937 |
| NM_017690 | SEQ ID NO 1938 |
| Contig29_RC | SEQ ID NO 1939 |
| Contig237_RC | SEQ ID NO 1940 |
| Contig263_RC | SEQ ID NO 1941 |
| Contig292_RC | SEQ ID NO 1942 |
| Contig382_RC | SEQ ID NO 1944 |
| Contig399_RC | SEQ ID NO 1945 |
| Contig448_RC | SEQ ID NO 1946 |
| Contig569_RC | SEQ ID NO 1947 |
| Contig580_RC | SEQ ID NO 1948 |
| Contig678_RC | SEQ ID NO 1949 |
| Contig706_RC | SEQ ID NO 1950 |
| Contig718_RC | SEQ ID NO 1951 |
| Contig719_RC | SEQ ID NO 1952 |
| Contig742_RC | SEQ ID NO 1953 |
| Contig753_RC | SEQ ID NO 1954 |
| Contig758_RC | SEQ ID NO 1956 |
| Contig760_RC | SEQ ID NO 1957 |
| Contig842_RC | SEQ ID NO 1958 |
| Contig848_RC | SEQ ID NO 1959 |
| Contig924_RC | SEQ ID NO 1960 |
| Contig974_RC | SEQ ID NO 1961 |
| Contig1018_RC | SEQ ID NO 1962 |
| Contig1056_RC | SEQ ID NO 1963 |
| Contig1061_RC | SEQ ID NO 1964 |
| Contig1129_RC | SEQ ID NO 1965 |
| Contig1148 | SEQ ID NO 1966 |
| Contig1239_RC | SEQ ID NO 1967 |
| Contig1277 | SEQ ID NO 1968 |
| Contig1333_RC | SEQ ID NO 1969 |
| Contig1386_RC | SEQ ID NO 1970 |
| Contig1389_RC | SEQ ID NO 1971 |
| Contig1418_RC | SEQ ID NO 1972 |
| Contig1462_RC | SEQ ID NO 1973 |
| Contig1505_RC | SEQ ID NO 1974 |
| Contig1540_RC | SEQ ID NO 1975 |
| Contig1584_RC | SEQ ID NO 1976 |
| Contig1632_RC | SEQ ID NO 1977 |
| Contig1682_RC | SEQ ID NO 1978 |
| Contig1778_RC | SEQ ID NO 1979 |
| Contig1829 | SEQ ID NO 1981 |
| Contig1838_RC | SEQ ID NO 1982 |
| Contig1938_RC | SEQ ID NO 1983 |
| Contig1970_RC | SEQ ID NO 1984 |
| Contig1998_RC | SEQ ID NO 1985 |
| Contig2099_RC | SEQ ID NO 1986 |
| Contig2143_RC | SEQ ID NO 1987 |
| Contig2237_RC | SEQ ID NO 1988 |
| Contig2429_RC | SEQ ID NO 1990 |
| Contig2504_RC | SEQ ID NO 1991 |
| Contig2512_RC | SEQ ID NO 1992 |
| Contig2575_RC | SEQ ID NO 1993 |
| Contig2578_RC | SEQ ID NO 1994 |
| Contig2639_RC | SEQ ID NO 1995 |
| Contig2647_RC | SEQ ID NO 1996 |
| Contig2657_RC | SEQ ID NO 1997 |
| Contig2728_RC | SEQ ID NO 1998 |
| Contig2745_RC | SEQ ID NO 1999 |
| Contig2811_RC | SEQ ID NO 2000 |
| Contig2873_RC | SEQ ID NO 2001 |
| Contig2883_RC | SEQ ID NO 2002 |
| Contig2915_RC | SEQ ID NO 2003 |
| Contig2928_RC | SEQ ID NO 2004 |
| Contig3024_RC | SEQ ID NO 2005 |
| Contig3094_RC | SEQ ID NO 2006 |
| Contig3164_RC | SEQ ID NO 2007 |
| Contig3495_RC | SEQ ID NO 2009 |
| Contig3607_RC | SEQ ID NO 2010 |
| Contig3659_RC | SEQ ID NO 2011 |
| Contig3677_RC | SEQ ID NO 2012 |
| Contig3682_RC | SEQ ID NO 2013 |
| Contig3734_RC | SEQ ID NO 2014 |
| Contig3834_RC | SEQ ID NO 2015 |
| Contig3876_RC | SEQ ID NO 2016 |
| Contig3902_RC | SEQ ID NO 2017 |
| Contig3940_RC | SEQ ID NO 2018 |
| Contig4380_RC | SEQ ID NO 2019 |
| Contig4388_RC | SEQ ID NO 2020 |
| Contig4467_RC | SEQ ID NO 2021 |
| Contig4949_RC | SEQ ID NO 2023 |
| Contig5348_RC | SEQ ID NO 2024 |
| Contig5403_RC | SEQ ID NO 2025 |
| Contig5716_RC | SEQ ID NO 2026 |
| Contig6118_RC | SEQ ID NO 2027 |
| Contig6164_RC | SEQ ID NO 2028 |
| Contig6181_RC | SEQ ID NO 2029 |
| Contig6514_RC | SEQ ID NO 2030 |
| Contig6612_RC | SEQ ID NO 2031 |
| Contig6881_RC | SEQ ID NO 2032 |
| Contig8165_RC | SEQ ID NO 2033 |
| Contig8221_RC | SEQ ID NO 2034 |
| Contig8347_RC | SEQ ID NO 2035 |
| Contig8364_RC | SEQ ID NO 2036 |
| Contig8888_RC | SEQ ID NO 2038 |
| Contig9259_RC | SEQ ID NO 2039 |
| Contig9541_RC | SEQ ID NO 2040 |
| Contig10268_RC | SEQ ID NO 2041 |
| Contig10363_RC | SEQ ID NO 2042 |
| Contig10437_RC | SEQ ID NO 2043 |
| Contig11086_RC | SEQ ID NO 2045 |
| Contig11275_RC | SEQ ID NO 2046 |
| Contig11648_RC | SEQ ID NO 2047 |
| Contig12216_RC | SEQ ID NO 2048 |
| Contig12369_RC | SEQ ID NO 2049 |

TABLE 1-continued 2,460 gene markers that distinguish ER(+) and ER(−) cell samples.

| GenBank Accession Number | SEQ ID NO |
| --- | --- |
| Contig12814_RC | SEQ ID NO 2050 |
| Contig12951_RC | SEQ ID NO 2051 |
| Contig13480_RC | SEQ ID NO 2052 |
| Contig14284_RC | SEQ ID NO 2053 |
| Contig14390_RC | SEQ ID NO 2054 |
| Contig14780_RC | SEQ ID NO 2055 |
| Contig14954_RC | SEQ ID NO 2056 |
| Contig14981_RC | SEQ ID NO 2057 |
| Contig15692_RC | SEQ ID NO 2058 |
| Contig16192_RC | SEQ ID NO 2059 |
| Contig16759_RC | SEQ ID NO 2061 |
| Contig16786_RC | SEQ ID NO 2062 |
| Contig16905_RC | SEQ ID NO 2063 |
| Contig17103_RC | SEQ ID NO 2064 |
| Contig17105_RC | SEQ ID NO 2065 |
| Contig17248_RC | SEQ ID NO 2066 |
| Contig17345_RC | SEQ ID NO 2067 |
| Contig18502_RC | SEQ ID NO 2069 |
| Contig20156_RC | SEQ ID NO 2071 |
| Contig20302_RC | SEQ ID NO 2073 |
| Contig20600_RC | SEQ ID NO 2074 |
| Contig20617_RC | SEQ ID NO 2075 |
| Contig20629_RC | SEQ ID NO 2076 |
| Contig20651_RC | SEQ ID NO 2077 |
| Contig21130_RC | SEQ ID NO 2078 |
| Contig21185_RC | SEQ ID NO 2079 |
| Contig21421_RC | SEQ ID NO 2080 |
| Contig21787_RC | SEQ ID NO 2081 |
| Contig21812_RC | SEQ ID NO 2082 |
| Contig22418_RC | SEQ ID NO 2083 |
| Contig23085_RC | SEQ ID NO 2084 |
| Contig23454_RC | SEQ ID NO 2085 |
| Contig24138_RC | SEQ ID NO 2086 |
| Contig24252_RC | SEQ ID NO 2087 |
| Contig24655_RC | SEQ ID NO 2089 |
| Contig25055_RC | SEQ ID NO 2090 |
| Contig25290_RC | SEQ ID NO 2091 |
| Contig25343_RC | SEQ ID NO 2092 |
| Contig25362_RC | SEQ ID NO 2093 |
| Contig25617_RC | SEQ ID NO 2094 |
| Contig25659_RC | SEQ ID NO 2095 |
| Contig25722_RC | SEQ ID NO 2096 |
| Contig25809_RC | SEQ ID NO 2097 |
| Contig25991 | SEQ ID NO 2098 |
| Contig26022_RC | SEQ ID NO 2099 |
| Contig26077_RC | SEQ ID NO 2100 |
| Contig26310_RC | SEQ ID NO 2101 |
| Contig26371_RC | SEQ ID NO 2102 |
| Contig26438_RC | SEQ ID NO 2103 |
| Contig26706_RC | SEQ ID NO 2104 |
| Contig27088_RC | SEQ ID NO 2105 |
| Contig27186_RC | SEQ ID NO 2106 |
| Contig27228_RC | SEQ ID NO 2107 |
| Contig27344_RC | SEQ ID NO 2109 |
| Contig27386_RC | SEQ ID NO 2110 |
| Contig27624_RC | SEQ ID NO 2111 |
| Contig27749_RC | SEQ ID NO 2112 |
| Contig27882_RC | SEQ ID NO 2113 |
| Contig27915_RC | SEQ ID NO 2114 |
| Contig28030_RC | SEQ ID NO 2115 |
| Contig28081_RC | SEQ ID NO 2116 |
| Contig28152_RC | SEQ ID NO 2117 |
| Contig28550_RC | SEQ ID NO 2119 |
| Contig28552_RC | SEQ ID NO 2120 |
| Contig28712_RC | SEQ ID NO 2121 |
| Contig28888_RC | SEQ ID NO 2122 |
| Contig28947_RC | SEQ ID NO 2123 |
| Contig29126_RC | SEQ ID NO 2124 |
| Contig29193_RC | SEQ ID NO 2125 |
| Contig29369_RC | SEQ ID NO 2126 |
| Contig29639_RC | SEQ ID NO 2127 |
| Contig30047_RC | SEQ ID NO 2129 |
| Contig30154_RC | SEQ ID NO 2131 |
| Contig30209_RC | SEQ ID NO 2132 |
| Contig30213_RC | SEQ ID NO 2133 |
| Contig30230_RC | SEQ ID NO 2134 |
| Contig30267_RC | SEQ ID NO 2135 |
| Contig30390_RC | SEQ ID NO 2136 |
| Contig30480_RC | SEQ ID NO 2137 |
| Contig30609_RC | SEQ ID NO 2138 |
| Contig30934_RC | SEQ ID NO 2139 |
| Contig31150_RC | SEQ ID NO 2140 |
| Contig31186_RC | SEQ ID NO 2141 |
| Contig31251_RC | SEQ ID NO 2142 |
| Contig31288_RC | SEQ ID NO 2143 |
| Contig31291_RC | SEQ ID NO 2144 |
| Contig31295_RC | SEQ ID NO 2145 |
| Contig31424_RC | SEQ ID NO 2146 |
| Contig31449_RC | SEQ ID NO 2147 |
| Contig31596_RC | SEQ ID NO 2148 |
| Contig31864_RC | SEQ ID NO 2149 |
| Contig31928_RC | SEQ ID NO 2150 |
| Contig31966_RC | SEQ ID NO 2151 |
| Contig31986_RC | SEQ ID NO 2152 |
| Contig32084_RC | SEQ ID NO 2153 |
| Contig32105_RC | SEQ ID NO 2154 |
| Contig32185_RC | SEQ ID NO 2156 |
| Contig32242_RC | SEQ ID NO 2157 |
| Contig32322_RC | SEQ ID NO 2158 |
| Contig32336_RC | SEQ ID NO 2159 |
| Contig32558_RC | SEQ ID NO 2160 |
| Contig32798_RC | SEQ ID NO 2161 |
| Contig33005_RC | SEQ ID NO 2162 |
| Contig33230_RC | SEQ ID NO 2163 |
| Contig33260_RC | SEQ ID NO 2164 |
| Contig33654_RC | SEQ ID NO 2166 |
| Contig33741_RC | SEQ ID NO 2167 |
| Contig33771_RC | SEQ ID NO 2168 |
| Contig33814_RC | SEQ ID NO 2169 |
| Contig33815_RC | SEQ ID NO 2170 |
| Contig33833 | SEQ ID NO 2171 |
| Contig33998_RC | SEQ ID NO 2172 |
| Contig34079 | SEQ ID NO 2173 |
| Contig34080_RC | SEQ ID NO 2174 |
| Contig34222_RC | SEQ ID NO 2175 |
| Contig34233_RC | SEQ ID NO 2176 |
| Contig34303_RC | SEQ ID NO 2177 |
| Contig34393_RC | SEQ ID NO 2178 |
| Contig34477_RC | SEQ ID NO 2179 |
| Contig34766_RC | SEQ ID NO 2181 |
| Contig34952 | SEQ ID NO 2182 |
| Contig34989_RC | SEQ ID NO 2183 |
| Contig35030_RC | SEQ ID NO 2184 |
| Contig35251_RC | SEQ ID NO 2185 |
| Contig35629_RC | SEQ ID NO 2186 |
| Contig35635_RC | SEQ ID NO 2187 |
| Contig35763_RC | SEQ ID NO 2188 |
| Contig35814_RC | SEQ ID NO 2189 |
| Contig35896_RC | SEQ ID NO 2190 |
| Contig35976_RC | SEQ ID NO 2191 |
| Contig36042_RC | SEQ ID NO 2192 |
| Contig36081_RC | SEQ ID NO 2193 |
| Contig36152_RC | SEQ ID NO 2194 |
| Contig36193_RC | SEQ ID NO 2195 |
| Contig36312_RC | SEQ ID NO 2196 |
| Contig36323_RC | SEQ ID NO 2197 |
| Contig36339_RC | SEQ ID NO 2198 |
| Contig36647_RC | SEQ ID NO 2199 |
| Contig36744_RC | SEQ ID NO 2200 |
| Contig36761_RC | SEQ ID NO 2201 |
| Contig36879_RC | SEQ ID NO 2202 |
| Contig36900_RC | SEQ ID NO 2203 |
| Contig37015_RC | SEQ ID NO 2204 |
| Contig37024_RC | SEQ ID NO 2205 |
| Contig37072_RC | SEQ ID NO 2207 |
| Contig37140_RC | SEQ ID NO 2208 |

TABLE 1-continued 2,460 gene markers that distinguish ER(+) and ER(−) cell samples.

| GenBank Accession Number | SEQ ID NO |
|---|---|
| Contig37141_RC | SEQ ID NO 2209 |
| Contig37204_RC | SEQ ID NO 2210 |
| Contig37281_RC | SEQ ID NO 2211 |
| Contig37287_RC | SEQ ID NO 2212 |
| Contig37439_RC | SEQ ID NO 2213 |
| Contig37562_RC | SEQ ID NO 2214 |
| Contig37571_RC | SEQ ID NO 2215 |
| Contig37598 | SEQ ID NO 2216 |
| Contig37758_RC | SEQ ID NO 2217 |
| Contig37778_RC | SEQ ID NO 2218 |
| Contig37884_RC | SEQ ID NO 2219 |
| Contig37946_RC | SEQ ID NO 2220 |
| Contig38170_RC | SEQ ID NO 2221 |
| Contig38288_RC | SEQ ID NO 2223 |
| Contig38398_RC | SEQ ID NO 2224 |
| Contig38580_RC | SEQ ID NO 2226 |
| Contig38630_RC | SEQ ID NO 2227 |
| Contig38652_RC | SEQ ID NO 2228 |
| Contig38683_RC | SEQ ID NO 2229 |
| Contig38726_RC | SEQ ID NO 2230 |
| Contig38791_RC | SEQ ID NO 2231 |
| Contig38901_RC | SEQ ID NO 2232 |
| Contig38983_RC | SEQ ID NO 2233 |
| Contig39090_RC | SEQ ID NO 2234 |
| Contig39132_RC | SEQ ID NO 2235 |
| Contig39157_RC | SEQ ID NO 2236 |
| Contig39226_RC | SEQ ID NO 2237 |
| Contig39285_RC | SEQ ID NO 2238 |
| Contig39556_RC | SEQ ID NO 2239 |
| Contig39591_RC | SEQ ID NO 2240 |
| Contig39826_RC | SEQ ID NO 2241 |
| Contig39845_RC | SEQ ID NO 2242 |
| Contiq39891_RC | SEQ ID NO 2243 |
| Contig39922_RC | SEQ ID NO 2244 |
| Contig39960_RC | SEQ ID NO 2245 |
| Contig40026_RC | SEQ ID NO 2246 |
| Contig40121_RC | SEQ ID NO 2247 |
| Contig40128_RC | SEQ ID NO 2248 |
| Contig40146 | SEQ ID NO 2249 |
| Contig40208_RC | SEQ ID NO 2250 |
| Contig40212_RC | SEQ ID NO 2251 |
| Contig40238_RC | SEQ ID NO 2252 |
| Contig40434_RC | SEQ ID NO 2253 |
| Contig40446_RC | SEQ ID NO 2254 |
| Contig40500_RC | SEQ ID NO 2255 |
| Contig40573_RC | SEQ ID NO 2256 |
| Contig40813_RC | SEQ ID NO 2258 |
| Contig40816_RC | SEQ ID NO 2259 |
| Contig40845_RC | SEQ ID NO 2261 |
| Contig40889_RC | SEQ ID NO 2262 |
| Contig41035 | SEQ ID NO 2263 |
| Contig41234_RC | SEQ ID NO 2264 |
| Contig41413_RC | SEQ ID NO 2266 |
| Contig41521_RC | SEQ ID NO 2267 |
| Contig41530_RC | SEQ ID NO 2268 |
| Contig41590 | SEQ ID NO 2269 |
| Contig41618_RC | SEQ ID NO 2270 |
| Contig41624_RC | SEQ ID NO 2271 |
| Contig41635_RC | SEQ ID NO 2272 |
| Contig41676_RC | SEQ ID NO 2273 |
| Contig41689_RC | SEQ ID NO 2274 |
| Contig41804_RC | SEQ ID NO 2275 |
| Contig41887_RC | SEQ ID NO 2276 |
| Contig41905_RC | SEQ ID NO 2277 |
| Contig41954_RC | SEQ ID NO 2278 |
| Contig41983_RC | SEQ ID NO 2279 |
| Contig42006_RC | SEQ ID NO 2280 |
| Contig42014_RC | SEQ ID NO 2281 |
| Contig42036_RC | SEQ ID NO 2282 |
| Contig42041_RC | SEQ ID NO 2283 |
| Contig42139 | SEQ ID NO 2284 |
| Contig42161_RC | SEQ ID NO 2285 |
| Contig42220_RC | SEQ ID NO 2286 |
| Contig42306_RC | SEQ ID NO 2287 |
| Contig42311_RC | SEQ ID NO 2288 |
| Contig42313_RC | SEQ ID NO 2289 |
| Contig42402_RC | SEQ ID NO 2290 |
| Contig42421_RC | SEQ ID NO 2291 |
| Contig42430_RC | SEQ ID NO 2292 |
| Contig42431_RC | SEQ ID NO 2293 |
| Contig42542_RC | SEQ ID NO 2294 |
| Contig42582 | SEQ ID NO 2295 |
| Contig42631_RC | SEQ ID NO 2296 |
| Contig42751_RC | SEQ ID NO 2297 |
| Contig42759_RC | SEQ ID NO 2298 |
| Contig43054 | SEQ ID NO 2299 |
| Contig43079_RC | SEQ ID NO 2300 |
| Contig43195_RC | SEQ ID NO 2301 |
| Contig43368_RC | SEQ ID NO 2302 |
| Contig43410_RC | SEQ ID NO 2303 |
| Contig43476_RC | SEQ ID NO 2304 |
| Contig43549_RC | SEQ ID NO 2305 |
| Contig43645_RC | SEQ ID NO 2306 |
| Contig43648_RC | SEQ ID NO 2307 |
| Contig43673_RC | SEQ ID NO 2308 |
| Contig43679_RC | SEQ ID NO 2309 |
| Contig43694_RC | SEQ ID NO 2310 |
| Contig43747_RC | SEQ ID NO 2311 |
| Contig43918_RC | SEQ ID NO 2312 |
| Contig43983_RC | SEQ ID NO 2313 |
| Contig44040_RC | SEQ ID NO 2314 |
| Contig44064_RC | SEQ ID NO 2315 |
| Contig44195_RC | SEQ ID NO 2316 |
| Contig44226_RC | SEQ ID NO 2317 |
| Contig44289_RC | SEQ ID NO 2320 |
| Contig44310_RC | SEQ ID NO 2321 |
| Contig44409 | SEQ ID NO 2322 |
| Contig44413_RC | SEQ ID NO 2323 |
| Contig44451_RC | SEQ ID NO 2324 |
| Contig44585_RC | SEQ ID NO 2325 |
| Contig44656_RC | SEQ ID NO 2326 |
| Contig44703_RC | SEQ ID NO 2327 |
| Contig44708_RC | SEQ ID NO 2328 |
| Contig44757_RC | SEQ ID NO 2329 |
| Contig44829_RC | SEQ ID NO 2331 |
| Contig44870 | SEQ ID NO 2332 |
| Contig44893_RC | SEQ ID NO 2333 |
| Contig44909_RC | SEQ ID NO 2334 |
| Contig44939_RC | SEQ ID NO 2335 |
| Contig45022_RC | SEQ ID NO 2336 |
| Contig45032_RC | SEQ ID NO 2337 |
| Contig45041_RC | SEQ ID NO 2338 |
| Contig45049_RC | SEQ ID NO 2339 |
| Contig45090_RC | SEQ ID NO 2340 |
| Contig45156_RC | SEQ ID NO 2341 |
| Contig45316_RC | SEQ ID NO 2342 |
| Contig45321 | SEQ ID NO 2343 |
| Contig45375_RC | SEQ ID NO 2345 |
| Contig45443_RC | SEQ ID NO 2346 |
| Contig45454_RC | SEQ ID NO 2347 |
| Contig45537_RC | SEQ ID NO 2348 |
| Contig45588_RC | SEQ ID NO 2349 |
| Contig45708_RC | SEQ ID NO 2350 |
| Contig45816_RC | SEQ ID NO 2351 |
| Contig45847_RC | SEQ ID NO 2352 |
| Contig45891_RC | SEQ ID NO 2353 |
| Contig46056_RC | SEQ ID NO 2354 |
| Contig46062_RC | SEQ ID NO 2355 |
| Contig46075_RC | SEQ ID NO 2356 |
| Contig46164_RC | SEQ ID NO 2357 |
| Contig46218_RC | SEQ ID NO 2358 |
| Contig46223_RC | SEQ ID NO 2359 |
| Contig46244_RC | SEQ ID NO 2360 |
| Contig46262_RC | SEQ ID NO 2361 |
| Contig46362_RC | SEQ ID NO 2364 |
| Contig46443_RC | SEQ ID NO 2365 |

TABLE 1-continued 2,460 gene markers that distinguish ER(+) and ER(−) cell samples.

| GenBank Accession Number | SEQ ID NO |
|---|---|
| Contig46553_RC | SEQ ID NO 2367 |
| Contig46597_RC | SEQ ID NO 2368 |
| Contig46653_RC | SEQ ID NO 2369 |
| Contig46709_RC | SEQ ID NO 2370 |
| Contig46777_RC | SEQ ID NO 2371 |
| Contig46802_RC | SEQ ID NO 2372 |
| Contig46890_RC | SEQ ID NO 2374 |
| Contig46922_RC | SEQ ID NO 2375 |
| Contig46934_RC | SEQ ID NO 2376 |
| Contig46937_RC | SEQ ID NO 2377 |
| Contig46991_RC | SEQ ID NO 2378 |
| Contig47016_RC | SEQ ID NO 2379 |
| Contig47045_RC | SEQ ID NO 2380 |
| Contig47106_RC | SEQ ID NO 2381 |
| Contig47146_RC | SEQ ID NO 2382 |
| Contig47230_RC | SEQ ID NO 2383 |
| Contig47405_RC | SEQ ID NO 2384 |
| Contig47456_RC | SEQ ID NO 2385 |
| Contig47465_RC | SEQ ID NO 2386 |
| Contig47498_RC | SEQ ID NO 2387 |
| Contig47578_RC | SEQ ID NO 2388 |
| Contig47645_RC | SEQ ID NO 2389 |
| Contig47680_RC | SEQ ID NO 2390 |
| Contig47781_RC | SEQ ID NO 2391 |
| Contig47814_RC | SEQ ID NO 2392 |
| Contig48004_RC | SEQ ID NO 2393 |
| Contig48043_RC | SEQ ID NO 2394 |
| Contig48057_RC | SEQ ID NO 2395 |
| Contig48076_RC | SEQ ID NO 2396 |
| Contig48249_RC | SEQ ID NO 2397 |
| Contig48263_RC | SEQ ID NO 2398 |
| Contig48270_RC | SEQ ID NO 2399 |
| Contig48328_RC | SEQ ID NO 2400 |
| Contig48518_RC | SEQ ID NO 2401 |
| Contig48572_RC | SEQ ID NO 2402 |
| Contig48659_RC | SEQ ID NO 2403 |
| Contig48722_RC | SEQ ID NO 2404 |
| Contig48774_RC | SEQ ID NO 2405 |
| Contig48776_RC | SEQ ID NO 2406 |
| Contig48800_RC | SEQ ID NO 2407 |
| Contig48806_RC | SEQ ID NO 2408 |
| Contig48852_RC | SEQ ID NO 2409 |
| Contig48900_RC | SEQ ID NO 2410 |
| Contig48913_RC | SEQ ID NO 2411 |
| Contig48970_RC | SEQ ID NO 2413 |
| Contig49058_RC | SEQ ID NO 2414 |
| Contig49063_RC | SEQ ID NO 2415 |
| Contig49093 | SEQ ID NO 2416 |
| Contig49098_RC | SEQ ID NO 2417 |
| Contig49169_RC | SEQ ID NO 2418 |
| Contig49233_RC | SEQ ID NO 2419 |
| Contig49270_RC | SEQ ID NO 2420 |
| Contig49282_RC | SEQ ID NO 2421 |
| Contig49289_RC | SEQ ID NO 2422 |
| Contig49342_RC | SEQ ID NO 2423 |
| Contig49344 | SEQ ID NO 2424 |
| Contig49388_RC | SEQ ID NO 2425 |
| Contig49405_RC | SEQ ID NO 2426 |
| Contig49445_RC | SEQ ID NO 2427 |
| Contig49468_RC | SEQ ID NO 2428 |
| Contig49509_RC | SEQ ID NO 2429 |
| Contig49578_RC | SEQ ID NO 2431 |
| Contig49581_RC | SEQ ID NO 2432 |
| Contig49631_RC | SEQ ID NO 2433 |
| Contig49673_RC | SEQ ID NO 2435 |
| Contig49743_RC | SEQ ID NO 2436 |
| Contig49790_RC | SEQ ID NO 2437 |
| Contig49818_RC | SEQ ID NO 2438 |
| Contig49849_RC | SEQ ID NO 2439 |
| Contig49855 | SEQ ID NO 2440 |
| Contig49910_RC | SEQ ID NO 2441 |
| Contig49948_RC | SEQ ID NO 2442 |
| Contig50004_RC | SEQ ID NO 2443 |
| Contig50094 | SEQ ID NO 2444 |
| Contig50120_RC | SEQ ID NO 2446 |
| Contig50153_RC | SEQ ID NO 2447 |
| Contig50189_RC | SEQ ID NO 2448 |
| Contig50276_RC | SEQ ID NO 2449 |
| Contig50288_RC | SEQ ID NO 2450 |
| Contig50297_RC | SEQ ID NO 2451 |
| Contig50391_RC | SEQ ID NO 2452 |
| Contig50410 | SEQ ID NO 2453 |
| Contig50523_RC | SEQ ID NO 2454 |
| Contig50529 | SEQ ID NO 2455 |
| Contig50588_RC | SEQ ID NO 2456 |
| Contig50592 | SEQ ID NO 2457 |
| Contig50669_RC | SEQ ID NO 2458 |
| Contig50719_RC | SEQ ID NO 2460 |
| Contig50728_RC | SEQ ID NO 2461 |
| Contig50731_RC | SEQ ID NO 2462 |
| Contig50802_RC | SEQ ID NO 2463 |
| Contig50822_RC | SEQ ID NO 2464 |
| Contig50850_RC | SEQ ID NO 2466 |
| Contig50860_RC | SEQ ID NO 2467 |
| Contig50913_RC | SEQ ID NO 2468 |
| Contig50950_RC | SEQ ID NO 2469 |
| Contig51066_RC | SEQ ID NO 2470 |
| Contig51105_RC | SEQ ID NO 2472 |
| Contig51117_RC | SEQ ID NO 2473 |
| Contig51196_RC | SEQ ID NO 2474 |
| Contig51235_RC | SEQ ID NO 2475 |
| Contig51254_RC | SEQ ID NO 2476 |
| Contig51352_RC | SEQ ID NO 2477 |
| Contig51369_RC | SEQ ID NO 2478 |
| Contig51392_RC | SEQ ID NO 2479 |
| Contig51403_RC | SEQ ID NO 2480 |
| Contig51685_RC | SEQ ID NO 2483 |
| Contig51726_RC | SEQ ID NO 2484 |
| Contig51742_RC | SEQ ID NO 2485 |
| Contig51749_RC | SEQ ID NO 2486 |
| Contig51775_RC | SEQ ID NO 2487 |
| Contig51800 | SEQ ID NO 2488 |
| Contig51809_RC | SEQ ID NO 2489 |
| Contig51821_RC | SEQ ID NO 2490 |
| Contig51888_RC | SEQ ID NO 2491 |
| Contig51953_RC | SEQ ID NO 2493 |
| Contig51967_RC | SEQ ID NO 2495 |
| Contig51981_RC | SEQ ID NO 2496 |
| Contig51994_RC | SEQ ID NO 2497 |
| Contig52082_RC | SEQ ID NO 2498 |
| Contig52094_RC | SEQ ID NO 2499 |
| Contig52320 | SEQ ID NO 2500 |
| Contig52398_RC | SEQ ID NO 2501 |
| Contig52425_RC | SEQ ID NO 2503 |
| Contig52482_RC | SEQ ID NO 2504 |
| Contig52543_RC | SEQ ID NO 2505 |
| Contig52553_RC | SEQ ID NO 2506 |
| Contig52579_RC | SEQ ID NO 2507 |
| Contig52603_RC | SEQ ID NO 2508 |
| Contig52639_RC | SEQ ID NO 2509 |
| Contig52641_RC | SEQ ID NO 2510 |
| Contig52684 | SEQ ID NO 2511 |
| Contig52705_RC | SEQ ID NO 2512 |
| Contig52720_RC | SEQ ID NO 2513 |
| Contig52722_RC | SEQ ID NO 2514 |
| Contig52723_RC | SEQ ID NO 2515 |
| Contig52740_RC | SEQ ID NO 2516 |
| Contig52779_RC | SEQ ID NO 2517 |
| Contig52957_RC | SEQ ID NO 2518 |
| Contig52994_RC | SEQ ID NO 2519 |
| Contig53022_RC | SEQ ID NO 2520 |
| Contig53038_RC | SEQ ID NO 2521 |
| Contig53047_RC | SEQ ID NO 2522 |
| Contig53130 | SEQ ID NO 2523 |
| Contig53183_RC | SEQ ID NO 2524 |
| Contig53242_RC | SEQ ID NO 2526 |

TABLE 1-continued 2,460 gene markers that distinguish ER(+) and ER(−) cell samples.

| GenBank Accession Number | SEQ ID NO |
| --- | --- |
| Contig53248_RC | SEQ ID NO 2527 |
| Contig53260_RC | SEQ ID NO 2528 |
| Contig53296_RC | SEQ ID NO 2531 |
| Contig53307_RC | SEQ ID NO 2532 |
| Contig53314_RC | SEQ ID NO 2533 |
| Contig53401_RC | SEQ ID NO 2534 |
| Contig53550_RC | SEQ ID NO 2535 |
| Contig53551_RC | SEQ ID NO 2536 |
| Contig53598_RC | SEQ ID NO 2537 |
| Contig53646_RC | SEQ ID NO 2538 |
| Contig53658_RC | SEQ ID NO 2539 |
| Contig53698_RC | SEQ ID NO 2540 |
| Contig53719_RC | SEQ ID NO 2541 |
| Contig53742_RC | SEQ ID NO 2542 |
| Contig53757_RC | SEQ ID NO 2543 |
| Contig53870_RC | SEQ ID NO 2544 |
| Contig53952_RC | SEQ ID NO 2546 |
| Contig53962_RC | SEQ ID NO 2547 |
| Contig53968_RC | SEQ ID NO 2548 |
| Contig54113_RC | SEQ ID NO 2549 |
| Contig54142_RC | SEQ ID NO 2550 |
| Contig54232_RC | SEQ ID NO 2551 |
| Contig54242_RC | SEQ ID NO 2552 |
| Contig54260_RC | SEQ ID NO 2553 |
| Contig54263_RC | SEQ ID NO 2554 |
| Contig54295_RC | SEQ ID NO 2555 |
| Contig54318_RC | SEQ ID NO 2556 |
| Contig54325_RC | SEQ ID NO 2557 |
| Contig54389_RC | SEQ ID NO 2558 |
| Contig54394_RC | SEQ ID NO 2559 |
| Contig54414_RC | SEQ ID NO 2560 |
| Contig54425 | SEQ ID NO 2561 |
| Contig54477_RC | SEQ ID NO 2562 |
| Contig54503_RC | SEQ ID NO 2563 |
| Contig54534_RC | SEQ ID NO 2564 |
| Contig54560_RC | SEQ ID NO 2566 |
| Contig54581_RC | SEQ ID NO 2567 |
| Contig54609_RC | SEQ ID NO 2568 |
| Contig54666_RC | SEQ ID NO 2569 |
| Contig54667_RC | SEQ ID NO 2570 |
| Contig54726_RC | SEQ ID NO 2571 |
| Contig54742_RC | SEQ ID NO 2572 |
| Contig54745_RC | SEQ ID NO 2573 |
| Contig54757_RC | SEQ ID NO 2574 |
| Contig54761_RC | SEQ ID NO 2575 |
| Contig54813_RC | SEQ ID NO 2576 |
| Contig54867_RC | SEQ ID NO 2577 |
| Contig54895_RC | SEQ ID NO 2578 |
| Contig54898_RC | SEQ ID NO 2579 |
| Contig54913_RC | SEQ ID NO 2580 |
| Contig54965_RC | SEQ ID NO 2582 |
| Contig54968_RC | SEQ ID NO 2583 |
| Contig55069_RC | SEQ ID NO 2584 |
| Contig55181_RC | SEQ ID NO 2585 |
| Contig55188_RC | SEQ ID NO 2586 |
| Contig55221_RC | SEQ ID NO 2587 |
| Contig55254_RC | SEQ ID NO 2588 |
| Contig55265_RC | SEQ ID NO 2589 |
| Contig55377_RC | SEQ ID NO 2591 |
| Contig55397_RC | SEQ ID NO 2592 |
| Contig55448_RC | SEQ ID NO 2593 |
| Contig55468_RC | SEQ ID NO 2594 |
| Contig55500_RC | SEQ ID NO 2595 |
| Contig55538_RC | SEQ ID NO 2596 |
| Contig55558_RC | SEQ ID NO 2597 |
| Contig55606_RC | SEQ ID NO 2598 |
| Contig55674_RC | SEQ ID NO 2599 |
| Contig55725_RC | SEQ ID NO 2600 |
| Contig55728_RC | SEQ ID NO 2601 |
| Contig55756_RC | SEQ ID NO 2602 |
| Contig55769_RC | SEQ ID NO 2603 |
| Contig55771_RC | SEQ ID NO 2605 |
| Contig55813_RC | SEQ ID NO 2607 |
| Contig55829_RC | SEQ ID NO 2608 |
| Contig55852_RC | SEQ ID NO 2609 |
| Contig55883_RC | SEQ ID NO 2610 |
| Contig55920_RC | SEQ ID NO 2611 |
| Contig55940_RC | SEQ ID NO 2612 |
| Contig55950_RC | SEQ ID NO 2613 |
| Contig55991_RC | SEQ ID NO 2614 |
| Contig55997_RC | SEQ ID NO 2615 |
| Contig56023_RC | SEQ ID NO 2616 |
| Contig56030_RC | SEQ ID NO 2617 |
| Contig56093_RC | SEQ ID NO 2618 |
| Contig56205_RC | SEQ ID NO 2621 |
| Contig56270_RC | SEQ ID NO 2622 |
| Contig56276_RC | SEQ ID NO 2623 |
| Contig56291_RC | SEQ ID NO 2624 |
| Contig56298_RC | SEQ ID NO 2625 |
| Contig56307 | SEQ ID NO 2627 |
| Contig56390_RC | SEQ ID NO 2628 |
| Contig56434_RC | SEQ ID NO 2629 |
| Contig56457_RC | SEQ ID NO 2630 |
| Contig56534_RC | SEQ ID NO 2631 |
| Contig56670_RC | SEQ ID NO 2632 |
| Contig56678_RC | SEQ ID NO 2633 |
| Contig56742_RC | SEQ ID NO 2634 |
| Contig56759_RC | SEQ ID NO 2635 |
| Contig56765_RC | SEQ ID NO 2636 |
| Contig56843_RC | SEQ ID NO 2637 |
| Contig57011_RC | SEQ ID NO 2638 |
| Contig57023_RC | SEQ ID NO 2639 |
| Contig57057_RC | SEQ ID NO 2640 |
| Contig57076_RC | SEQ ID NO 2641 |
| Contig57081_RC | SEQ ID NO 2642 |
| Contig57091_RC | SEQ ID NO 2643 |
| Contig57138_RC | SEQ ID NO 2644 |
| Contig57173_RC | SEQ ID NO 2645 |
| Contig57230_RC | SEQ ID NO 2646 |
| Contig57258_RC | SEQ ID NO 2647 |
| Contiq57270_RC | SEQ ID NO 2648 |
| Contig57272_RC | SEQ ID NO 2649 |
| Contig57344_RC | SEQ ID NO 2650 |
| Contig57430_RC | SEQ ID NO 2651 |
| Contig57458_RC | SEQ ID NO 2652 |
| Contig57493_RC | SEQ ID NO 2653 |
| Contig57584_RC | SEQ ID NO 2654 |
| Contig57595 | SEQ ID NO 2655 |
| Contig57602_RC | SEQ ID NO 2656 |
| Contig57609_RC | SEQ ID NO 2657 |
| Contig57610_RC | SEQ ID NO 2658 |
| Contig57644_RC | SEQ ID NO 2659 |
| Contig57725_RC | SEQ ID NO 2660 |
| Contig57739_RC | SEQ ID NO 2661 |
| Contig57825_RC | SEQ ID NO 2662 |
| Contig57864_RC | SEQ ID NO 2663 |
| Contig57940_RC | SEQ ID NO 2664 |
| Contig58260_RC | SEQ ID NO 2665 |
| Contig58272_RC | SEQ ID NO 2666 |
| Contig58301_RC | SEQ ID NO 2667 |
| Contig58368_RC | SEQ ID NO 2668 |
| Contig58471_RC | SEQ ID NO 2669 |
| Contig58755_RC | SEQ ID NO 2671 |
| Contig59120_RC | SEQ ID NO 2672 |
| Contig60157_RC | SEQ ID NO 2673 |
| Contig60864_RC | SEQ ID NO 2676 |
| Contig61254_RC | SEQ ID NO 2677 |
| Contig61815 | SEQ ID NO 2678 |
| Contig61975 | SEQ ID NO 2679 |
| Contig62306 | SEQ ID NO 2680 |
| Contig62568_RC | SEQ ID NO 2681 |
| Contig62922_RC | SEQ ID NO 2682 |
| Contig62964_RC | SEQ ID NO 2683 |
| Contig63520_RC | SEQ ID NO 2685 |
| Contig63649_RC | SEQ ID NO 2686 |
| Contig63683_RC | SEQ ID NO 2687 |

TABLE 1-continued 2,460 gene markers that distinguish ER(+) and ER(−) cell samples.

| GenBank Accession Number | SEQ ID NO |
|---|---|
| Contig63748_RC | SEQ ID NO 2688 |
| Contig64502 | SEQ ID NO 2689 |
| Contig64688 | SEQ ID NO 2690 |
| Contig64775_RC | SEQ ID NO 2691 |
| Contig65227 | SEQ ID NO 2692 |
| Contig65663 | SEQ ID NO 2693 |
| Contig65785_RC | SEQ ID NO 2694 |
| Contig65900 | SEQ ID NO 2695 |
| Contig66219_RC | SEQ ID NO 2696 |
| Contig66705_RC | SEQ ID NO 2697 |
| Contig66759_RC | SEQ ID NO 2698 |
| Contig67182_RC | SEQ ID NO 2699 |

TABLE 2

550 preferred ER status markers drawn from Table 1.

| Identifier | Correlation | Name | Description |
|---|---|---|---|
| NM_002051 | 0.763977 | GATA3 | GATA-binding protein 3 |
| AB020689 | 0.753592 | KIAA0882 | KIAA0882 protein |
| NM_001218 | 0.753225 | CA12 | carbonic anhydrase XII |
| NM_000125 | 0.748421 | ESR1 | estrogen receptor 1 |
| Contig56678_RC | 0.747816 | | ESTs |
| NM_004496 | 0.729116 | HNF3A | hepatocyte nuclear factor 3, alpha |
| NM_017732 | 0.713398 | FLJ20262 | hypothetical protein FLJ20262 |
| NM_006806 | −0.712678 | BTG3 | BTG family, member 3 |
| Contig56390_RC | 0.705940 | | ESTs |
| Contig37571_RC | 0.704468 | | ESTs |
| NM_004559 | −0.701617 | NSEP1 | nuclease sensitive element binding protein 1 |
| Contig50153_RC | −0.696652 | | ESTs, Weakly similar to LKHU proteoglycan link protein precursor [*H. sapiens*] |
| NM_012155 | 0.694332 | EMAP-2 | microtubule-associated protein like echinoderm EMAP |
| Contig237_RC | 0.687485 | FLJ21127 | hypothetical protein FLJ21127 |
| NM_019063 | −0.686064 | C2ORF2 | chromosome 2 open reading frame 2 |
| NM_012219 | −0.680900 | MRAS | muscle RAS oncogene homolog |
| NM_001982 | 0.676114 | ERBB3 | v-erb-b2 avian erythroblastic leukemia viral oncogene homolog 3 |
| NM_006623 | −0.675090 | PHGDH | phosphoglycerate dehydrogenase |
| NM_000636 | −0.674282 | SOD2 | superoxide dismutase 2, mitochondrial |
| NM_006017 | −0.670353 | PROML1 | prominin (mouse)-like 1 |
| Contig57940_RC | 0.667915 | MAP-1 | MAP-1 protein |
| Contig46934_RC | 0.666908 | | ESTs, Weakly similar to JE0350 Anterior gradient-2 [*H. sapiens*] |
| NM_005080 | 0.665772 | XBP1 | X-box binding protein 1 |
| NM_014246 | 0.665725 | CELSR1 | cadherin, EGF LAG seven-pass G-type receptor 1, flamingo (*Drosophila*) homolog |
| Contig54667_RC | −0.663727 | | Human DNA sequence from clone RP1-187J11 on chromosome 6q11.1-22.33. Contains the gene for a novel protein similar to *S. pombe* and *S. cerevisiae* predicted proteins, the gene for a novel protein similar to protein kinase C inhibitors, the 3' end of the gene for a novel protein similar to *Drosophila* L82 and predicted worm proteins, ESTs, STSs, GSSs and two putative CpG islands |
| Contig51994_RC | 0.663715 | | ESTs, Weakly similar to B0416.1 [*C. elegans*] |
| NM_016337 | 0.663006 | RNB6 | RNB6 |
| NM_015640 | −0.660165 | PAI-RBP1 | PAI-1 mRNA-binding protein |
| X07834 | −0.657798 | SOD2 | superoxide dismutase 2, mitochondrial |
| NM_012319 | 0.657666 | LIV-1 | LIV-1 protein, estrogen regulated |
| Contig41887_RC | 0.656042 | | ESTs, Weakly similar to Homolog of rat Zymogen granule membrane protein [*H. sapiens*] |

TABLE 2-continued 550 preferred ER status markers drawn from Table 1.

| Identifier | Correlation | Name | Description |
|---|---|---|---|
| NM_003462 | 0.655349 | P28 | dynein, axonemal, light intermediate polypeptide |
| Contig58301_RC | 0.654268 | | *Homo sapiens* mRNA; cDNA DKFZp667D095 (from clone DKFZp667D095) |
| NM_005375 | 0.653783 | MYB | v-myb avian myeloblastosis viral oncogene homolog |
| NM_017447 | −0.652445 | YG81 | hypothetical protein LOC54149 |
| Contig924_RC | −0.650658 | | ESTs |
| M55914 | −0.650181 | MPB1 | MYC promoter-binding protein 1 |
| NM_006004 | −0.649819 | UQCRH | ubiquinol-cytochrome c reductase hinge protein |
| NM_000964 | 0.649072 | RARA | retinoic acid receptor, alpha |
| NM_013301 | 0.647583 | HSU79303 | protein predicted by clone 23882 |
| AB023211 | −0.647403 | PDI2 | peptidyl arginine deiminase, type II |
| NM_016629 | −0.646412 | LOC51323 | hypothetical protein |
| K02403 | 0.645532 | C4A | complement component 4A |
| NM_016405 | −0.642201 | HSU93243 | Ubc6p homolog |
| Contig46597_RC | 0.641733 | | ESTs |
| Contig55377_RC | 0.640310 | | ESTs |
| NM_001207 | 0.637800 | BTF3 | basic transcription factor 3 |
| NM_018166 | 0.636422 | FLJ10647 | hypothetical protein FLJ10647 |
| AL110202 | −0.635398 | | *Homo sapiens* mRNA; cDNA DKFZp586I2022 (from clone DKFZp586I2022) |
| AL133105 | −0.635201 | DKFZp434F2322 | hypothetical protein DKFZp434F2322 |
| NM_016839 | −0.635169 | RBMS1 | RNA binding motif, single stranded interacting protein 1 |
| Contig53130 | −0.634812 | | ESTs, Weakly similar to hyperpolarization-activated cyclic nucleotide-gated channel hHCN2 [*H. sapiens*] |
| NM_018014 | −0.634460 | BCL11A | B-cell CLL/lymphoma 11A (zinc finger protein) |
| NM_006769 | −0.632197 | LMO4 | LIM domain only 4 |
| U92544 | 0.631170 | JCL-1 | hepatocellular carcinoma associated protein; breast cancer associated gene 1 |
| Contig49233_RC | −0.631047 | | *Homo sapiens*, Similar to nuclear receptor binding factor 2, clone IMAGE: 3463191, mRNA, partial cds |
| AL133033 | 0.629690 | KIAA1025 | KIAA1025 protein |
| AL049265 | 0.629414 | | *Homo sapiens* mRNA; cDNA DKFZp564F053 (from clone DKFZp564F053) |
| NM_018728 | 0.627989 | MYO5C | myosin 5C |
| NM_004780 | 0.627856 | TCEAL1 | transcription elongation factor A (SII)-like 1 |
| Contig760_RC | 0.627132 | | ESTs |
| Contig399_RC | 0.626543 | FLJ12538 | hypothetical protein FLJ12538 similar to ras-related protein RAB17 |
| M83822 | 0.625092 | CDC4L | cell division cycle 4-like |
| NM_001255 | −0.625089 | CDC20 | CDC20 (cell division cycle 20, *S. cerevisiae*, homolog) |
| NM_006739 | −0.624903 | MCM5 | minichromosome maintenance deficient (*S. cerevisiae*) 5 (cell division cycle 46) |
| NM_002888 | −0.624664 | RARRES1 | retinoic acid receptor responder (tazarotene induced) 1 |
| NM_003197 | 0.623850 | TCEB1L | transcription elongation factor B (SIII), polypeptide 1-like |
| NM_006787 | 0.623625 | JCL-1 | hepatocellular carcinoma associated protein; breast cancer associated gene 1 |
| Contig49342_RC | 0.622179 | | ESTs |
| AL133619 | 0.621719 | | *Homo sapiens* mRNA; cDNA DKFZp434E2321 (from clone DKFZp434E2321); partial cds |
| AL133622 | 0.621577 | KIAA0876 | KIAA0876 protein |
| NM_004648 | −0.621532 | PTPNS1 | protein tyrosine phosphatase, non-receptor type substrate 1 |
| NM_001793 | −0.621530 | CDH3 | cadherin 3, type 1, P-cadherin (placental) |

TABLE 2-continued 550 preferred ER status markers drawn from Table 1.

| Identifier | Correlation | Name | Description |
| --- | --- | --- | --- |
| NM_003217 | 0.620915 | TEGT | testis enhanced gene transcript (BAX inhibitor 1) |
| NM_001551 | 0.620832 | IGBP1 | immunoglobulin (CD79A) binding protein 1 |
| NM_002539 | −0.620683 | ODC1 | ornithine decarboxylase 1 |
| Contig55997_RC | −0.619932 | | ESTs |
| NM_000633 | 0.619547 | BCL2 | B-cell CLL/lymphoma 2 |
| NM_016267 | −0.619096 | TONDU | TONDU |
| Contig3659_RC | 0.618048 | FLJ21174 | hypothetical protein FLJ21174 |
| NM_000191 | 0.617250 | HMGCL | 3-hydroxymethyl-3-methylglutaryl-Coenzyme A lyase (hydroxymethylglutaricaciduria) |
| NM_001267 | 0.616890 | CHAD | chondroadherin |
| Contig39090_RC | 0.616385 | | ESTs |
| AF055270 | −0.616268 | HSSG1 | heat-shock suppressed protein 1 |
| Contig43054 | 0.616015 | FLJ21603 | hypothetical protein FLJ21603 |
| NM_001428 | −0.615855 | ENO1 | enolase 1, (alpha) |
| Contig51369_RC | 0.615466 | | ESTs |
| Contig36647_RC | 0.615310 | GFRA1 | GDNF family receptor alpha 1 |
| NM_014096 | −0.614832 | PRO1659 | PRO1659 protein |
| NM_015937 | 0.614735 | LOC51604 | CGI-06 protein |
| Contig49790_RC | −0.614463 | | ESTs |
| NM_006759 | −0.614279 | UGP2 | UDP-glucose pyrophosphorylase 2 |
| Contig53598_RC | −0.613787 | FLJ11413 | hypothetical protein FLJ11413 |
| AF113132 | −0.613561 | PSA | phosphoserine aminotransferase |
| AK000004 | 0.613001 | | *Homo sapiens* mRNA for FLJ00004 protein, partial cds |
| Contig52543_RC | 0.612960 | | *Homo sapiens* cDNA FLJ13945 fis, clone Y79AA1000969 |
| AB032966 | −0.611917 | KIAA1140 | KIAA1140 protein |
| AL080192 | 0.611544 | | *Homo sapiens* cDNA: FLJ21238 fis, clone COL01115 |
| X56807 | −0.610654 | DSC2 | desmocollin 2 |
| Contig30390_RC | 0.609614 | | ESTs |
| AL137362 | 0.609121 | FLJ22237 | hypothetical protein FLJ22237 |
| NM_014211 | −0.608585 | GABRP | gamma-aminobutyric acid (GABA) A receptor, pi |
| NM_006696 | 0.608474 | SMAP | thyroid hormone receptor coactivating protein |
| Contig45588_RC | −0.608273 | | *Homo sapiens* cDNA: FLJ22610 fis, clone HSI04930 |
| NM_003358 | 0.608244 | UGCG | UDP-glucose ceramide glucosyltransferase |
| NM_006153 | −0.608129 | NCK1 | NCK adaptor protein 1 |
| NM_001453 | −0.606939 | FOXC1 | forkhead box C1 |
| Contig54666_RC | 0.606475 | | oy65e02.x1 NCI_CGAP_CLL1 *Homo sapiens* cDNA clone IMAGE: 1670714 3' similar to TR: Q29168 Q29168 UNKNOWN PROTEIN;, mRNA sequence. |
| NM_005945 | −0.605945 | MPB1 | MYC promoter-binding protein 1 |
| Contig55725_RC | −0.605841 | | ESTs, Moderately similar to T50635 hypothetical protein DKFZp762L0311.1 [*H. sapiens*] |
| Contig37015_RC | −0.605780 | | ESTs, Weakly similar to UAS3_HUMAN UBASH3A PROTEIN [*H. sapiens*] |
| AL157480 | −0.604362 | SH3BP1 | SH3-domain binding protein 1 |
| NM_005325 | −0.604310 | H1F1 | H1 histone family, member 1 |
| NM_001446 | −0.604061 | FABP7 | fatty acid binding protein 7, brain |
| Contig263_RC | 0.603318 | | *Homo sapiens* cDNA: FLJ23000 fis, clone LNG00194 |
| Contig8347_RC | −0.603311 | | ESTs |
| NM_002988 | −0.603279 | SCYA18 | small inducible cytokine subfamily A (Cys-Cys), member 18, pulmonary and activation-regulated |
| AF111849 | 0.603157 | HELO1 | homolog of yeast long chain polyunsaturated fatty acid elongation enzyme 2 |
| NM_014700 | 0.603042 | KIAA0665 | KIAA0665 gene product |
| NM_001814 | −0.602988 | CTSC | cathepsin C |
| AF116682 | −0.602350 | PRO2013 | hypothetical protein PRO2013 |
| AB037836 | 0.602024 | KIAA1415 | KIAA1415 protein |
| AB002301 | 0.602005 | KIAA0303 | KIAA0303 protein |

TABLE 2-continued 550 preferred ER status markers drawn from Table 1.

| Identifier | Correlation | Name | Description |
|---|---|---|---|
| NM_002996 | −0.601841 | SCYD1 | small inducible cytokine subfamily D (Cys-X3-Cys), member 1 (fractalkine, neurotactin) |
| NM_018410 | −0.601765 | DKFZp762E1312 | hypothetical protein DKFZp762E1312 |
| Contig49581_RC | −0.601571 | KIAA1350 | KIAA1350 protein |
| NM_003088 | −0.601458 | SNL | singed (*Drosophila*)-like (sea urchin fascin homolog like) |
| Contig47045_RC | 0.601088 | | ESTs, Weakly similar to DP1_HUMAN POLYPOSIS LOCUS PROTEIN 1 [*H. sapiens*] |
| NM_001806 | −0.600954 | CEBPG | CCAAT/enhancer binding protein (C/EBP), gamma |
| NM_004374 | 0.600766 | COX6C | cytochrome c oxidase subunit VIc |
| Contig52641_RC | 0.600132 | | ESTs, Weakly similar to CENB MOUSE MAJOR CENTROMERE AUTOANTIGEN B [*M. musculus*] |
| NM_000100 | −0.600127 | CSTB | cystatin B (stefin B) |
| NM_002250 | −0.600004 | KCNN4 | potassium intermediate/small conductance calcium-activated channel, subfamily N, member 4 |
| AB033035 | −0.599423 | KIAA1209 | KIAA1209 protein |
| Contig53968_RC | 0.599077 | | ESTs |
| NM_002300 | −0.598246 | LDHB | lactate dehydrogenase B |
| NM_000507 | 0.598110 | FBP1 | fructose-1,6-bisphosphatase 1 |
| NM_002053 | −0.597756 | GBP1 | guanylate binding protein 1, interferon-inducible, 67 kD |
| AB007883 | 0.597043 | KIAA0423 | KIAA0423 protein |
| NM_004900 | −0.597010 | DJ742C19.2 | phorbolin (similar to apolipoprotein B mRNA editing protein) |
| NM_004480 | 0.596321 | FUT8 | fucosyltransferase 8 (alpha (1,6) fucosyltransferase) |
| Contig35896_RC | 0.596281 | | ESTs |
| NM_020974 | 0.595173 | CEGP1 | CEGP1 protein |
| NM_000662 | 0.595114 | NAT1 | N-acetyltransferase 1 (arylamine N-acetyltransferase) |
| NM_006113 | 0.595017 | VAV3 | vav 3 oncogene |
| NM_014865 | −0.594928 | KIAA0159 | chromosome condensation-related SMC-associated protein 1 |
| Contig55538_RC | −0.594573 | BA395L14.2 | hypothetical protein bA395L14.2 |
| NM_016056 | 0.594084 | LOC51643 | CGI-119 protein |
| NM_003579 | −0.594063 | RAD54L | RAD54 (*S. cerevisiae*)-like |
| NM_014214 | −0.593860 | IMPA2 | inositol(myo)-1 (or 4)-monophosphatase 2 |
| U79293 | 0.593793 | | Human clone 23948 mRNA sequence |
| NM_005557 | −0.593746 | KRT16 | keratin 16 (focal non-epidermolytic palmoplantar keratoderma) |
| NM_002444 | −0.592405 | MSN | moesin |
| NM_003681 | −0.592155 | PDXK | pyridoxal (pyridoxine, vitamin B6) kinase |
| NM_006372 | −0.591711 | NSAP1 | NS1-associated protein 1 |
| NM_005218 | −0.591192 | DEFB1 | defensin, beta 1 |
| NM_004642 | −0.591081 | DOC1 | deleted in oral cancer (mouse, homolog) 1 |
| AL133074 | 0.590359 | | *Homo sapiens* cDNA: FLJ22139 fis, clone HEP20959 |
| M73547 | 0.590317 | D5S346 | DNA segment, single copy probe LNS-CAI/LNS-CAII (deleted in polyposis |
| Contig65663 | 0.590312 | | ESTs |
| AL035297 | −0.589728 | | *H. sapiens* gene from PAC 747L4 |
| Contig35629_RC | 0.589383 | | ESTs |
| NM_019027 | 0.588862 | FLJ20273 | hypothetical protein |
| NM_012425 | −0.588804 | | *Homo sapiens* Ras suppressor protein 1 (RSU1), mRNA |
| NM_020179 | −0.588326 | FN5 | FN5 protein |
| AF090913 | −0.587275 | TMSB10 | thymosin, beta 10 |
| NM_004176 | 0.587190 | SREBF1 | sterol regulatory element binding transcription factor 1 |
| NM_016121 | 0.586941 | LOC51133 | NY-REN-45 antigen |
| NM_014773 | 0.586871 | KIAA0141 | KIAA0141 gene product |
| NM_019000 | 0.586677 | FLJ20152 | hypothetical protein |
| NM_016243 | 0.585942 | LOC51706 | cytochrome b5 reductase 1 (B5R.1) |

TABLE 2-continued 550 preferred ER status markers drawn from Table 1.

| Identifier | Correlation | Name | Description |
| --- | --- | --- | --- |
| NM_014274 | −0.585815 | ABP/ZF | Alu-binding protein with zinc finger domain |
| NM_018379 | 0.585497 | FLJ11280 | hypothetical protein FLJ11280 |
| AL157431 | −0.585077 | DKFZp762A227 | hypothetical protein DKFZp762A227 |
| D38521 | −0.584684 | KIAA0077 | KIAA0077 protein |
| NM_002570 | 0.584272 | PACE4 | paired basic amino acid cleaving system 4 |
| NM_001809 | −0.584252 | CENPA | centromere protein A (17 kD) |
| NM_003318 | −0.583556 | TTK | TTK protein kinase |
| NM_014325 | −0.583555 | CORO1C | coronin, actin-binding protein, 1C |
| NM_005667 | 0.583376 | ZFP103 | zinc finger protein homologous to Zfp103 in mouse |
| NM_004354 | 0.582420 | CCNG2 | cyclin G2 |
| NM_003670 | 0.582235 | BHLHB2 | basic helix-loop-helix domain containing, class B, 2 |
| NM_001673 | −0.581902 | ASNS | asparagine synthetase |
| NM_001333 | −0.581402 | CTSL2 | cathepsin L2 |
| Contig54295_RC | 0.581256 | | ESTs |
| Contig33998_RC | 0.581018 | | ESTs |
| NM_006002 | −0.580592 | UCHL3 | ubiquitin carboxyl-terminal esterase L3 (ubiquitin thiolesterase) |
| NM_015392 | 0.580568 | NPDC1 | neural proliferation, differentiation and control, 1 |
| NM_004866 | 0.580138 | SCAMP1 | secretory carrier membrane protein 1 |
| Contig50391_RC | 0.580071 | | ESTs |
| NM_000592 | 0.579965 | C4B | complement component 4B |
| Contig50802_RC | 0.579881 | | ESTs |
| Contig41635_RC | −0.579468 | | ESTs |
| NM_006845 | −0.579339 | KNSL6 | kinesin-like 6 (mitotic centromere-associated kinesin) |
| NM_003720 | −0.579296 | DSCR2 | Down syndrome critical region gene 2 |
| NM_000060 | 0.578967 | BTD | biotinidase |
| AL050388 | −0.578736 | | *Homo sapiens* mRNA; cDNA DKFZp564M2422 (from clone DKFZp564M2422); partial cds |
| NM_003772 | −0.578395 | JRKL | jerky (mouse) homolog-like |
| NM_014398 | −0.578388 | TSC403 | similar to lysosome-associated membrane glycoprotein |
| NM_001280 | 0.578213 | CIRBP | cold inducible RNA-binding protein |
| NM_001395 | −0.577369 | DUSP9 | dual specificity phosphatase 9 |
| NM_016229 | −0.576290 | LOC51700 | cytochrome b5 reductase b5R.2 |
| NM_006096 | −0.575615 | NDRG1 | N-myc downstream regulated |
| NM_001552 | 0.575438 | IGFBP4 | insulin-like growth factor-binding protein 4 |
| NM_005558 | −0.574818 | LAD1 | ladinin 1 |
| Contig54534_RC | 0.574784 | | Human glucose transporter pseudogene |
| Contig1239_RC | 0.573822 | | Human Chromosome 16 BAC clone CIT987SK-A-362G6 |
| Contig57173_RC | 0.573807 | | *Homo sapiens* mRNA for KIAA1737 protein, partial cds |
| NM_004414 | −0.573538 | DSCR1 | Down syndrome critical region gene 1 |
| NM_021103 | −0.572722 | TMSB10 | thymosin, beta 10 |
| NM_002350 | −0.571917 | LYN | v-yes-1 Yamaguchi sarcoma viral related oncogene homolog |
| Contig51235_RC | 0.571049 | | *Homo sapiens* cDNA: FLJ23388 fis, clone HEP17008 |
| NM_013384 | 0.570987 | TMSG1 | tumor metastasis-suppressor |
| NM_014399 | 0.570936 | NET-6 | tetraspan NET-6 protein |
| Contig26022_RC | −0.570851 | | ESTs |
| AB023152 | 0.570561 | KIAA0935 | KIAA0935 protein |
| NM_021077 | −0.569944 | NMB | neuromedin B |
| NM_003498 | −0.569129 | SNN | stannin |
| U17077 | −0.568979 | BENE | BENE protein |
| D86985 | 0.567698 | KIAA0232 | KIAA0232 gene product |
| NM_006357 | −0.567513 | UBE2E3 | ubiquitin-conjugating enzyme E2E 3 (homologous to yeast UBC4/5) |
| AL049397 | −0.567434 | | *Homo sapiens* mRNA; cDNA DKFZp586C1019 (from clone DKFZp586C1019) |

TABLE 2-continued

550 preferred ER status markers drawn from Table 1.

| Identifier | Correlation | Name | Description |
|---|---|---|---|
| Contig64502 | 0.567433 | | ESTs, Weakly similar to unknown [*M. musculus*] |
| Contig56298_RC | −0.566892 | FLJ13154 | hypothetical protein FLJ13154 |
| Contig46056_RC | 0.566634 | | ESTs, Weakly similar to YZ28_HUMAN HYPOTHETICAL PROTEIN ZAP128 [*H. sapiens*] |
| AF007153 | 0.566044 | | *Homo sapiens* clone 23736 mRNA sequence |
| Contig1778_RC | −0.565789 | | ESTs |
| NM_017702 | −0.565789 | FLJ20186 | hypothetical protein FLJ20186 |
| Contig39226_RC | 0.565761 | | *Homo sapiens* cDNA FLJ12187 fis, clone MAMMA1000831 |
| NM_000168 | 0.564879 | GLI3 | GLI-Kruppel family member GLI3 (Greig cephalopolysyndactyly syndrome) |
| Contig57609_RC | 0.564751 | | ESTs, Weakly similar to T2D3_HUMAN TRANSCRIPTION INITIATION FACTOR TFIID 135 KDA SUBUNIT [*H. sapiens*] |
| U45975 | 0.564602 | PIB5PA | phosphatidylinositol (4,5) bisphosphate 5-phosphatase, A |
| AF038182 | 0.564596 | | *Homo sapiens* clone 23860 mRNA sequence |
| Contig5348_RC | 0.564480 | | ESTs, Weakly similar to 1607338A transcription factor BTF3a [*H. sapiens*] |
| NM_001321 | −0.564459 | CSRP2 | cysteine and glycine-rich protein 2 |
| Contig25362_RC | −0.563801 | | ESTs |
| NM_001609 | 0.563782 | ACADSB | acyl-Coenzyme A dehydrogenase, short/branched chain |
| Contig40146 | 0.563731 | | wi84e12.x1 NCI_CGAP_Kid12 *Homo sapiens* cDNA clone IMAGE: 2400046 3' similar to SW: RASD_DICDI P03967 RAS-LIKE PROTEIN RASD;, mRNA sequence. |
| NM_016002 | 0.563403 | LOC51097 | CGI-49 protein |
| Contig34303_RC | 0.563157 | | *Homo sapiens* cDNA: FLJ21517 fis, clone COL05829 |
| Contig55883_RC | 0.563141 | | ESTs |
| NM_017961 | 0.562479 | FLJ20813 | hypothetical protein FLJ20813 |
| M21551 | −0.562340 | NMB | neuromedin B |
| Contig3940_RC | −0.561956 | YWHAH | tyrosine 3-monooxygenase/tryptophan 5-monooxygenase activation protein, eta polypeptide |
| AB033111 | −0.561746 | KIAA1285 | KIAA1285 protein |
| Contig43410_RC | 0.561678 | | ESTs |
| Contig42006_RC | −0.561677 | | ESTs |
| Contig57272_RC | 0.561228 | | ESTs |
| G26403 | −0.561068 | YWHAH | tyrosine 3-monooxygenase/tryptophan 5-monooxygenase activation protein, eta polypeptide |
| NM_005915 | −0.560813 | MCM6 | minichromosome maintenance deficient (mis5, *S. pombe*) 6 |
| NM_003875 | −0.560668 | GMPS | guanine monophosphate synthetase |
| AK000142 | 0.559651 | AK000142 | *Homo sapiens* cDNA FLJ20135 fis, clone COL06818. |
| NM_002709 | −0.559621 | PPP1CB | protein phosphatase 1, catalytic subunit, beta isoform |
| NM_001276 | −0.558868 | CHI3L1 | chitinase 3-like 1 (cartilage glycoprotein-39) |
| NM_002857 | 0.558862 | PXF | peroxisomal farnesylated protein |
| Contig33815_RC | −0.558741 | FLJ22833 | hypothetical protein FLJ22833 |
| NM_003740 | −0.558491 | KCNK5 | potassium channel, subfamily K, member 5 (TASK-2) |
| Contig53646_RC | 0.558455 | | ESTs |
| NM_005538 | −0.558350 | INHBC | inhibin, beta C |
| NM_002111 | 0.557860 | HD | huntingtin (Huntington disease) |
| NM_003683 | −0.557807 | D21S2056E | DNA segment on chromosome 21 (unique) 2056 expressed sequence |
| NM_003035 | −0.557380 | SIL | TAL1 (SCL) interrupting locus |

TABLE 2-continued

550 preferred ER status markers drawn from Table 1.

| Identifier | Correlation | Name | Description |
|---|---|---|---|
| Contig4388_RC | −0.557216 | | *Homo sapiens*, Similar to integral membrane protein 3, clone MGC: 3011, mRNA, complete cds |
| Contig38288_RC | −0.556426 | | ESTs, Weakly similar to ISHUSS protein disulfide-isomerase [*H. sapiens*] |
| NM_015417 | 0.556184 | DKFZP434 I114 | DKFZP434I114 protein |
| NM_015507 | −0.556138 | EGFL6 | EGF-like-domain, multiple 6 |
| AF279865 | 0.555951 | KIF13B | kinesin family member 13B |
| Contig31288_RC | −0.555754 | | ESTs |
| NM_002966 | −0.555620 | S100A10 | S100 calcium-binding protein A10 (annexin II ligand, calpactin I, light polypeptide (p11)) |
| NM_017585 | −0.555476 | SLC2A6 | solute carrier family 2 (facilitated glucose transporter), member 6 |
| NM_013296 | −0.555367 | HSU54999 | LGN protein |
| NM_000224 | 0.554838 | KRT18 | keratin 18 |
| Contig49270_RC | −0.554593 | KIAA1553 | KIAA1553 protein |
| NM_004848 | −0.554538 | ICB-1 | basement membrane-induced gene |
| NM_007275 | 0.554278 | FUS1 | lung cancer candidate |
| NM_007044 | −0.553550 | KATNA1 | katanin p60 (ATPase-containing) subunit A 1 |
| Contig1829 | 0.553317 | | ESTs |
| AF272357 | 0.553286 | NPDC1 | neural proliferation, differentiation and control, 1 |
| Contig57584_RC | −0.553080 | | *Homo sapiens*, Similar to gene rich cluster, C8 gene, clone MGC: 2577, mRNA, complete cds |
| NM_003039 | −0.552747 | SLC2A5 | solute carrier family 2 (facilitated glucose transporter), member 5 |
| NM_014216 | 0.552321 | ITPK1 | inositol 1,3,4-triphosphate 5/6 kinase |
| NM_007027 | −0.552064 | TOPBP1 | topoisomerase (DMA) II binding protein |
| AF118224 | −0.551916 | ST14 | suppression of tumorigenicity 14 (colon carcinoma, matriptase, epithin) |
| X75315 | −0.551853 | HSRNASE B | seb4D |
| NM_012101 | −0.551824 | ATDC | ataxia-telangiectasia group D-associated protein |
| AL157482 | −0.551329 | FLJ23399 | hypothetical protein FLJ23399 |
| NM_012474 | −0.551150 | UMPK | uridine monophosphate kinase |
| Contig57081_RC | 0.551103 | | ESTs |
| NM_006941 | −0.551069 | SOX10 | SRY (sex determining region Y)-box 10 |
| NM_004694 | 0.550932 | SLC16A6 | solute carrier family 16 (monocarboxylic acid transporters), member 6 |
| Contig9541_RC | 0.550680 | | ESTs |
| Contig20617_RC | 0.550546 | | ESTs |
| NM_004252 | 0.550365 | SLC9A3R 1 | solute carrier family 9 (sodium/hydrogen exchanger), isoform 3 regulatory factor 1 |
| NM_015641 | −0.550200 | DKFZP586 B2022 | testin |
| NM_004336 | −0.550164 | BUB1 | budding uninhibited by benzimidazoles 1 (yeast homolog) |
| Contig39960_RC | −0.549951 | FLJ21079 | hypothetical protein FLJ21079 |
| NM_020686 | 0.549659 | NPD009 | NPD009 protein |
| NM_002633 | −0.549647 | PGM1 | phosphoglucomutase 1 |
| Contig30480_RC | 0.548932 | | ESTs |
| NM_003479 | 0.548896 | PTP4A2 | protein tyrosine phosphatase type IVA, member 2 |
| NM_001679 | −0.548768 | ATP1B3 | ATPase, Na+/K+ transporting, beta 3 polypeptide |
| NM_001124 | −0.548601 | ADM | adrenomedullin |
| NM_001216 | −0.548375 | CA9 | carbonic anhydrase IX |
| U58033 | −0.548354 | MTMR2 | myotubularin related protein 2 |
| NM_018389 | −0.547875 | FLJ11320 | hypothetical protein FLJ11320 |
| AF176012 | 0.547867 | JDP1 | J domain containing protein 1 |
| Contig66705_RC | −0.546926 | ST5 | suppression of tumorigenicity 5 |
| NM_018194 | 0.546878 | FLJ10724 | hypothetical protein FLJ10724 |
| NM_006851 | −0.546823 | RTVP1 | glioma pathogenesis-related protein |

TABLE 2-continued 550 preferred ER status markers drawn from Table 1.

| Identifier | Correlation | Name | Description |
|---|---|---|---|
| Contig53870_RC | 0.546756 | | ESTs |
| NM_002482 | −0.546012 | NASP | nuclear autoantigenic sperm protein (histone-binding) |
| NM_002292 | 0.545949 | LAMB2 | laminin, beta 2 (laminin S) |
| NM_014696 | −0.545758 | KIAA0514 | KIAA0514 gene product |
| Contig49855 | 0.545517 | | ESTs |
| AL117666 | 0.545203 | DKFZP586 O1624 | DKFZP586O1624 protein |
| NM_004701 | −0.545185 | CCNB2 | cyclin B2 |
| NM_007050 | 0.544890 | PTPRT | protein tyrosine phosphatase, receptor type, T |
| NM_000414 | 0.544778 | HSD17B4 | hydroxysteroid (17-beta) dehydrogenase 4 |
| Contig52398_RC | −0.544775 | | *Homo sapiens* cDNA: FLJ21950 fis, clone HEP04949 |
| AB007916 | 0.544496 | KIAA0447 | KIAA0447 gene product |
| Contig66219_RC | 0.544467 | FLJ22402 | hypothetical protein FLJ22402 |
| D87453 | 0.544145 | KIAA0264 | KIAA0264 protein |
| NM_015515 | −0.543929 | DKFZP434 G032 | DKFZP434G032 protein |
| NM_001530 | −0.543898 | HIF1A | hypoxia-inducible factor 1, alpha subunit (basic helix-loop-helix transcription factor) |
| NM_004109 | −0.543893 | FDX1 | ferredoxin 1 |
| NM_000381 | −0.543871 | MID1 | midline 1 (Opitz/BBB syndrome) |
| Contig43983_RC | 0.543523 | CS2 | calsyntenin-2 |
| AL137761 | 0.543371 | | *Homo sapiens* mRNA; cDNA DKFZp586L2424 (from clone DKFZp586L2424) |
| NM_005764 | −0.543175 | DD96 | epithelial protein up-regulated in carcinoma, membrane associated protein 17 |
| Contig1838_RC | 0.542996 | | *Homo sapiens* cDNA: FLJ22722 fis, clone HSI14444 |
| NM_006670 | 0.542932 | 5T4 | 5T4 oncofetal trophoblast glycoprotein |
| Contig28552_RC | −0.542617 | | *Homo sapiens* mRNA; cDNA DKFZp434C0931 (from clone DKFZp434C0931); partial cds |
| Contig14284_RC | 0.542224 | | ESTs |
| NM_006290 | −0.542115 | TNFAIP3 | tumor necrosis factor, alpha-induced protein 3 |
| AL050372 | 0.541463 | | *Homo sapiens* mRNA; cDNA DKFZp434A091 (from clone DKFZp434A091); partial cds |
| NM_014181 | −0.541095 | HSPC159 | HSPC159 protein |
| Contig37141_RC | 0.540990 | | *Homo sapiens* cDNA: FLJ23582 fis, clone LNG13759 |
| NM_000947 | −0.540621 | PRIM2A | primase, polypeptide 2A (58 kD) |
| NM_002136 | 0.540572 | HNRPA1 | heterogeneous nuclear ribonucleoprotein A1 |
| NM_004494 | −0.540543 | HDGF | hepatoma-derived growth factor (high-mobility group protein 1-like) |
| Contig38983_RC | 0.540526 | | ESTs |
| Contig27882_RC | −0.540506 | | ESTs |
| Z11887 | −0.540020 | MMP7 | matrix metalloproteinase 7 (matrilysin, uterine) |
| NM_014575 | −0.539725 | SCHIP-1 | schwannomin interacting protein 1 |
| Contig38170_RC | 0.539708 | | ESTs |
| Contig44064_RC | 0.539403 | | ESTs |
| U68385 | 0.539395 | MEIS3 | Meis (mouse) homolog 3 |
| Contig51967_RC | 0.538952 | | ESTs |
| Contig37562_RC | 0.538657 | | ESTs, Weakly similar to transformation-related protein [*H. sapiens*] |
| Contig40500_RC | 0.538582 | | ESTs, Weakly similar to unnamed protein product [*H. sapiens*] |
| Contig1129_RC | 0.538339 | | ESTs |
| NM_002184 | 0.538185 | IL6ST | interleukin 6 signal transducer (gp130, oncostatin M receptor) |
| AL049381 | 0.538041 | | *Homo sapiens* cDNA FLJ12900 fis, clone NT2RP2004321 |
| NM_002189 | −0.537867 | IL15RA | interleukin 15 receptor, alpha |
| NM_012110 | −0.537562 | CHIC2 | cystein-rich hydrophobic domain 2 |
| AB040881 | −0.537473 | KIAA1448 | KIAA1448 protein |

TABLE 2-continued 550 preferred ER status markers drawn from Table 1.

| Identifier | Correlation | Name | Description |
| --- | --- | --- | --- |
| NM_016577 | −0.537430 | RAB6B | RAB6B, member RAS oncogene family |
| NM_001745 | 0.536940 | CAMLG | calcium modulating ligand |
| NM_005742 | −0.536738 | P5 | protein disulfide isomerase-related protein |
| AB011132 | 0.536345 | KIAA0560 | KIAA0560 gene product |
| Contig54898_RC | 0.536094 | PNN | pinin, desmosome associated protein |
| Contig45049_RC | −0.536043 | FUT4 | fucosyltransferase 4 (alpha (1,3) fucosyltransferase, myeloid-specific) |
| NM_006864 | −0.535924 | LILRB3 | leukocyte immunoglobulin-like receptor, subfamily B (with TM and ITIM domains), member 3 |
| Contig53242_RC | −0.535909 | | *Homo sapiens* cDNA FLJ11436 fis, clone HEMBA1001213 |
| NM_005544 | 0.535712 | IRS1 | insulin receptor substrate 1 |
| Contig47456_RC | 0.535493 | CACNA1D | calcium channel, voltage-dependent, L type, alpha 1D subunit |
| Contig42751_RC | −0.535469 | | ESTs |
| Contig29126_RC | −0.535186 | | ESTs |
| NM_012391 | 0.535067 | PDEF | prostate epithelium-specific Ets transcription factor |
| NM_012429 | 0.534974 | SEC14L2 | SEC14 (*S. cerevisiae*)-like 2 |
| NM_018171 | 0.534898 | FLJ10659 | hypothetical protein FLJ10659 |
| Contig53047_RC | −0.534773 | TTYH1 | tweety (*Drosophila*) homolog 1 |
| Contig54968_RC | 0.534754 | | *Homo sapiens* cDNA FLJ13558 fis, clone PLACE1007743 |
| Contig2099_RC | −0.534694 | KIAA1691 | KIAA1691 protein |
| NM_005264 | 0.534057 | GFRA1 | GDNF family receptor alpha 1 |
| NM_014036 | −0.533638 | SBBI42 | BCM-like membrane protein precursor |
| NM_018101 | −0.533473 | FLJ10468 | hypothetical protein FLJ10468 |
| Contig56765_RC | 0.533442 | | ESTs, Moderately similar to K02E10.2 [*C. elegans*] |
| AB006746 | −0.533400 | PLSCR1 | phospholipid scramblase 1 |
| NM_001089 | 0.533350 | ABCA3 | ATP-binding cassette, sub-family A (ABC1), member 3 |
| NM_018188 | −0.533132 | FLJ10709 | hypothetical protein FLJ10709 |
| X94232 | −0.532925 | MAPRE2 | microtubule-associated protein, RP/EB family, member 2 |
| AF234532 | −0.532910 | MYO10 | myosin X |
| Contig292_RC | 0.532853 | FLJ22386 | hypothetical protein FLJ22386 |
| NM_000101 | −0.532767 | CYBA | cytochrome b-245, alpha polypeptide |
| Contig47814_RC | −0.532656 | HHGP | HHGP protein |
| NM_014320 | −0.532430 | SOUL | putative heme-binding protein |
| NM_020347 | 0.531976 | LZTFL1 | leucine zipper transcription factor-like 1 |
| NM_004323 | 0.531936 | BAG1 | BCL2-associated athanogene |
| Contig50850_RC | −0.531914 | | ESTs |
| Contig11648_RC | 0.531704 | | ESTs |
| NM_018131 | −0.531559 | FLJ10540 | hypothetical protein FLJ10540 |
| NM_004688 | −0.531329 | NMI | N-myc (and STAT) interactor |
| NM_014870 | 0.531101 | KIAA0478 | KIAA0478 gene product |
| Contig31424_RC | 0.530720 | | ESTs |
| NM_000874 | −0.530545 | IFNAR2 | interferon (alpha, beta and omega) receptor 2 |
| Contig50588_RC | 0.530145 | | ESTs |
| NM_016463 | 0.529998 | HSPC195 | hypothetical protein |
| NM_013324 | 0.529966 | CISH | cytokine inducible SH2-containing protein |
| NM_006705 | 0.529840 | GADD45G | growth arrest and DNA-damage-inducible, gamma |
| Contig38901_RC | −0.529747 | | ESTs |
| NM_004184 | −0.529635 | WARS | tryptophanyl-tRNA synthetase |
| NM_015955 | −0.529538 | LOC51072 | CGI-27 protein |
| AF151810 | 0.529416 | CGI-52 | similar to phosphatidylcholine transfer protein 2 |
| NM_002164 | −0.529117 | INDO | indoleamine-pyrrole 2,3 dioxygenase |
| NM_004267 | −0.528679 | CHST2 | carbohydrate (chondroitin 6/keratan) sulfotransferase 2 |
| Contig32185_RC | −0.528529 | | *Homo sapiens* cDNA FLJ13997 fis, clone Y79AA1002220 |

TABLE 2-continued 550 preferred ER status markers drawn from Table 1.

| Identifier | Correlation | Name | Description |
| --- | --- | --- | --- |
| NM_004154 | −0.528343 | P2RY6 | pyrimidinergic receptor P2Y, G-protein coupled, 6 |
| NM_005235 | 0.528294 | ERBB4 | v-erb-a avian erythroblastic leukemia viral oncogene homolog-like 4 |
| Contig40208_RC | −0.528062 | LOC56938 | transcription factor BMAL2 |
| NM_013262 | 0.527297 | MIR | myosin regulatory light chain interacting protein |
| NM_003034 | −0.527148 | SIAT8A | sialyltransferase 8 (alpha-N-acetylneuraminate: alpha-2,8-sialyltransferase, GD3 synthase) A |
| NM_004556 | −0.527146 | NFKBIE | nuclear factor of kappa light polypeptide gene enhancer in B-cells inhibitor, epsilon |
| NM_002046 | −0.527051 | GAPD | glyceraldehyde-3-phosphate dehydrogenase |
| NM_001905 | −0.526986 | CTPS | CTP synthase |
| Contig42402_RC | 0.526852 | | ESTs |
| NM_014272 | −0.526283 | ADAMTS7 | a disintegrin-like and metalloprotease (reprolysin type) with thrombospondin type 1 motif, 7 |
| AF076612 | 0.526205 | CHRD | chordin |
| Contig57725_RC | −0.526122 | | *Homo sapiens* mRNA for HMG-box transcription factor TCF-3, complete cds |
| Contig42041_RC | −0.525877 | | ESTs |
| Contig44656_RC | −0.525868 | | ESTs, Highly similar to S02392 alpha-2-macroglobulin receptor precursor [*H. sapiens*] |
| NM_018004 | −0.525610 | FLJ10134 | hypothetical protein FLJ10134 |
| Contig56434_RC | 0.525510 | | *Homo sapiens* cDNA FLJ13603 fis, clone PLACE1010270 |
| D25328 | −0.525504 | PFKP | phosphofructokinase, platelet |
| Contig55950_RC | −0.525358 | FLJ22329 | hypothetical protein FLJ22329 |
| NM_002648 | −0.525211 | PIM1 | pim-1 oncogene |
| AL157505 | 0.525186 | | *Homo sapiens* mRNA; cDNA DKFZp586P1124 (from clone DKFZp586P1124) |
| AF061034 | −0.525185 | FIP2 | *Homo sapiens* FIP2 alternatively translated mRNA, complete cds. |
| NM_014721 | −0.525102 | KIAA0680 | KIAA0680 gene product |
| NM_001634 | −0.525030 | AMD1 | S-adenosylmethionine decarboxylase 1 |
| NM_006304 | −0.524911 | DSS1 | Deleted in split-hand/split-foot 1 region |
| Contig37778_RC | 0.524667 | | ESTs, Highly similar to HLHUSB MHC class II histocompatibility antigen HLA-DP alpha-1 chain precursor [*H. sapiens*] |
| NM_003099 | 0.524339 | SNX1 | sorting nexin 1 |
| AL079298 | 0.523774 | MCCC2 | methylcrotonoyl-Coenzyme A carboxylase 2 (beta) |
| NM_019013 | −0.523663 | FLJ10156 | hypothetical protein |
| NM_000397 | −0.523293 | CYBB | cytochrome b-245, beta polypeptide (chronic granulomatous disease) |
| NM_014811 | 0.523132 | KIAA0649 | KIAA0649 gene product |
| Contig20600_RC | 0.523072 | | ESTs |
| NM_005190 | −0.522710 | CCNC | cyclin C |
| AL161960 | −0.522574 | FLJ21324 | hypothetical protein FLJ21324 |
| AL117502 | 0.522280 | | *Homo sapiens* mRNA; cDNA DKFZp434D0935 (from clone DKFZp434D0935) |
| AF131753 | −0.522245 | | *Homo sapiens* clone 24859 mRNA sequence |
| NM_000320 | 0.521974 | QDPR | quinoid dihydropteridine reductase |
| NM_002115 | −0.521870 | HK3 | hexokinase 3 (white cell) |
| NM_006460 | 0.521696 | HIS1 | HMBA-inducible |
| NM_018683 | −0.521679 | ZNF313 | zinc finger protein 313 |
| NM_004305 | −0.521539 | BIN1 | bridging integrator 1 |
| NM_006770 | −0.521538 | MARCO | macrophage receptor with collagenous structure |
| NM_001166 | −0.521530 | BIRC2 | baculoviral IAP repeat-containing 2 |
| D42047 | 0.521522 | KIAA0089 | KIAA0089 protein |
| NM_016235 | −0.521298 | GPRC5B | G protein-coupled receptor, family C, group 5, member B |

TABLE 2-continued 550 preferred ER status markers drawn from Table 1.

| Identifier | Correlation | Name | Description |
| --- | --- | --- | --- |
| NM_004504 | −0.521189 | HRB | HIV-1 Rev binding protein |
| NM_002727 | −0.521146 | PRG1 | proteoglycan 1, secretory granule |
| AB029031 | −0.520761 | KIAA1108 | KIAA1108 protein |
| NM_005556 | −0.520692 | KRT7 | keratin 7 |
| NM_018031 | 0.520600 | WDR6 | WD repeat domain 6 |
| AL117523 | −0.520579 | KIAA1053 | KIAA1053 protein |
| NM_004515 | −0.520363 | ILF2 | Interleukin enhancer binding factor 2, 45 kD |
| NM_004708 | −0.519935 | PDCD5 | programmed cell death 5 |
| NM_005935 | 0.519765 | MLLT2 | myeloid/lymphoid or mixed-lineage leukemia (trithorax (*Drosophila*) homolog); translocated to, 2 |
| Contig49289_RC | −0.519546 | | *Homo sapiens* mRNA; cDNA DKFZp586J1119 (from clone DKFZp586J1119); complete cds |
| NM_000211 | −0.519342 | ITGB2 | integrin, beta 2 (antigen CD18 (p95), lymphocyte function-associated antigen 1; macrophage antigen 1 (mac-1) beta subunit) |
| AL079276 | 0.519207 | LOC58495 | putative zinc finger protein from EUROIMAGE 566589 |
| Contig57825_RC | 0.519041 | | ESTs |
| NM_002466 | −0.518911 | MYBL2 | v-myb avian myeloblastosis viral oncogene homolog-like 2 |
| NM_016072 | −0.518802 | LOC51026 | CGI-141 protein |
| AB007950 | −0.518699 | KIAA0481 | KIAA0481 gene product |
| NM_001550 | −0.518549 | IFRD1 | interferon-related developmental regulator 1 |
| AF155120 | −0.518221 | UBE2V1 | ubiquitin-conjugating enzyme E2 variant 1 |
| Contig49849_RC | 0.517983 | | ESTs, Weakly similar to AF188706 1 g20 protein [*H. sapiens*] |
| NM_016625 | −0.517936 | LOC51319 | hypothetical protein |
| NM_004049 | −0.517862 | BCL2A1 | BCL2-related protein A1 |
| Contig50719_RC | 0.517740 | | ESTs |
| D80010 | −0.517620 | LPIN1 | lipin 1 |
| NM_000299 | −0.517405 | PKP1 | plakophilin 1 (ectodermal dysplasia/skin fragility syndrome) |
| AL049365 | 0.517080 | FTL | ferritin, light polypeptide |
| Contig65227 | 0.517003 | | ESTs |
| NM_004865 | −0.516808 | TBPL1 | TBP-like 1 |
| Contig54813_RC | 0.516246 | FLJ13962 | hypothetical protein FLJ13962 |
| NM_003494 | −0.516221 | DYSF | dysferlin, limb girdle muscular dystrophy 2B (autosomal recessive) |
| NM_004431 | −0.516212 | EPHA2 | EphA2 |
| AL117600 | −0.516067 | DKFZP564J0863 | DKFZP564J0863 protein |
| AL080209 | −0.516037 | DKFZP586F2423 | hypothetical protein DKFZp586F2423 |
| NM_000135 | −0.515613 | FANCA | Fanconi anemia, complementation group A |
| NM_000050 | −0.515494 | ASS | argininosuccinate synthetase |
| NM_001830 | −0.515439 | CLCN4 | chloride channel 4 |
| NM_018234 | −0.515365 | FLJ10829 | hypothetical protein FLJ10829 |
| Contig53307_RC | 0.515328 | | ESTs, Highly similar to KIAA1437 protein [*H. sapiens*] |
| AL117617 | −0.515141 | | *Homo sapiens* mRNA; cDNA DKFZp564H0764 (from clone DKFZp564H0764) |
| NM_002906 | −0.515098 | RDX | radixin |
| NM_003360 | −0.514427 | UGT8 | UDP glycosyltransferase 8 (UDP-galactose ceramide galactosyltransferase) |
| NM_018478 | 0.514332 | HSMNP1 | uncharacterized hypothalamus protein HSMNP1 |
| M90657 | −0.513908 | TM4SF1 | transmembrane 4 superfamily member 1 |
| NM_014967 | 0.513793 | KIAA1018 | KIAA1018 protein |
| Contig1462_RC | 0.513604 | C11ORF15 | chromosome 11 open reading frame 15 |
| Contig37287_RC | −0.513324 | | ESTs |
| NM_000355 | −0.513225 | TCN2 | transcobalamin II; macrocytic anemia |
| AB037756 | 0.512914 | KIAA1335 | hypothetical protein KIAA1335 |
| Contig842_RC | −0.512880 | | ESTs |

TABLE 2-continued 550 preferred ER status markers drawn from Table 1.

| Identifier | Correlation | Name | Description |
|---|---|---|---|
| NM_018186 | −0.512878 | FLJ10706 | hypothetical protein FLJ10706 |
| NM_014668 | 0.512746 | KIAA0575 | KIAA0575 gene product |
| NM_003226 | 0.512611 | TFF3 | trefoil factor 3 (intestinal) |
| Contig56457_RC | −0.512548 | TMEFF1 | transmembrane protein with EGF-like and two follistatin-like domains 1 |
| AL050367 | −0.511999 | | *Homo sapiens* mRNA; cDNA DKFZp564A026 (from clone DKFZp564A026) |
| NM_014791 | −0.511963 | KIAA0175 | KIAA0175 gene product |
| Contig36312_RC | 0.511794 | | ESTs |
| NM_004811 | −0.511447 | LPXN | leupaxin |
| Contig67182_RC | −0.511416 | | ESTs, Highly similar to epithelial V-like antigen precursor [*H. sapiens*] |
| Contig52723_RC | −0.511134 | | ESTs |
| Contig17105_RC | −0.511072 | | *Homo sapiens* mRNA for putative cytoplasmatic protein (ORF1-FL21) |
| NM_014449 | 0.511023 | A | protein "A" |
| Contig52957_RC | 0.510815 | | ESTs |
| Contig49388_RC | 0.510582 | FLJ13322 | hypothetical protein FLJ13322 |
| NM_017786 | 0.510557 | FLJ20366 | hypothetical protein FLJ20366 |
| AL157476 | 0.510478 | | *Homo sapiens* mRNA; cDNA DKFZp761C082 (from clone DKFZp761C082) |
| NM_001919 | 0.510242 | DCI | dodecenoyl-Coenzyme A delta isomerase (3,2 trans-enoyl-Coenzyme A isomerase) |
| NM_000268 | −0.510165 | NF2 | neurofibromin 2 (bilateral acoustic neuroma) |
| NM_016210 | 0.510018 | LOC51161 | g20 protein |
| Contig45816_RC | −0.509977 | | ESTs |
| NM_003953 | −0.509969 | MPZL1 | myelin protein zero-like 1 |
| NM_000057 | −0.509669 | BLM | Bloom syndrome |
| NM_014452 | −0.509473 | DR6 | death receptor 6 |
| Contig45156_RC | 0.509284 | | ESTs, Moderately similar to motor domain of KIF12 [*M. musculus*] |
| NM_006943 | 0.509149 | SOX22 | SRY (sex determining region Y)-box 22 |
| NM_000594 | −0.509012 | TNF | tumor necrosis factor (TNF superfamily, member 2) |
| AL137316 | −0.508353 | KIAA1609 | KIAA1609 protein |
| NM_000557 | −0.508325 | GDF5 | growth differentiation factor 5 (cartilage-derived morphogenetic protein-1) |
| NM_018685 | −0.508307 | ANLN | anillin (*Drosophila* Scraps homolog), actin binding protein |
| Contig53401_RC | 0.508189 | | ESTs |
| NM_014364 | −0.508170 | GAPDS | glyceraldehyde-3-phosphate dehydrogenase, testis-specific |
| Contig50297_RC | 0.508137 | | ESTs, Moderately similar to ALU8_HUMAN ALU SUBFAMILY SX SEQUENCE CONTAMINATION WARNING ENTRY [*H. sapiens*] |
| Contig51800 | 0.507891 | | ESTs, Weakly similar to ALU6_HUMAN ALU SUBFAMILY SP SEQUENCE CONTAMINATION WARNING ENTRY [*H. sapiens*] |
| Contig49098_RC | −0.507716 | MGC4090 | hypothetical protein MGC4090 |
| NM_002985 | −0.507554 | SCYA5 | small inducible cytokine A5 (RANTES) |
| AB007899 | 0.507439 | KIAA0439 | KIAA0439 protein; homolog of yeast ubiquitin-protein ligase Rsp5 |
| AL110139 | 0.507145 | | *Homo sapiens* mRNA; cDNA DKFZp564O1763 (from clone DKFZp564O1763) |
| Contig51117_RC | 0.507001 | | ESTs |
| NM_017660 | −0.506768 | FLJ20085 | hypothetical protein FLJ20085 |
| NM_018000 | 0.506686 | FLJ10116 | hypothetical protein FLJ10116 |
| NM_005555 | −0.506516 | KRT6B | keratin 6B |
| NM_005582 | −0.506462 | LY64 | lymphocyte antigen 64 (mouse) homolog, radioprotective, 105 kD |
| Contig47405_RC | 0.506202 | | ESTs |
| NM_014808 | 0.506173 | KIAA0793 | KIAA0793 gene product |
| NM_004938 | −0.506121 | DAPK1 | death-associated protein kinase 1 |
| NM_020659 | −0.505793 | TTYH1 | tweety (*Drosophila*) homolog 1 |
| NM_006227 | −0.505604 | PLTP | phospholipid transfer protein |

TABLE 2-continued

550 preferred ER status markers drawn from Table 1.

| Identifier | Correlation | Name | Description |
|---|---|---|---|
| NM_014268 | −0.505412 | MAPRE2 | microtubule-associated protein, RP/EB family, member 2 |
| NM_004711 | 0.504849 | SYNGR1 | synaptogyrin 1 |
| NM_004418 | −0.504497 | DUSP2 | dual specificity phosphatase 2 |
| NM_003508 | −0.504475 | FZD9 | frizzled (*Drosophila*) homolog 9 |

TABLE 3

430 gene markers that distinguish BRCA1-related tumor samples from sporadic tumor samples

| GenBank Accession Number | SEQ ID NO |
|---|---|
| AB002301 | SEQ ID NO 4 |
| AB004857 | SEQ ID NO 8 |
| AB007458 | SEQ ID NO 12 |
| AB014534 | SEQ ID NO 29 |
| AB018305 | SEQ ID NO 34 |
| AB020677 | SEQ ID NO 36 |
| AB020689 | SEQ ID NO 37 |
| AB023151 | SEQ ID NO 41 |
| AB023163 | SEQ ID NO 43 |
| AB028986 | SEQ ID NO 48 |
| AB029025 | SEQ ID NO 50 |
| AB032966 | SEQ ID NO 53 |
| AB032988 | SEQ ID NO 57 |
| AB033049 | SEQ ID NO 63 |
| AB033055 | SEQ ID NO 66 |
| AB037742 | SEQ ID NO 73 |
| AB041269 | SEQ ID NO 96 |
| AF000974 | SEQ ID NO 97 |
| AF042838 | SEQ ID NO 111 |
| AF052155 | SEQ ID NO 119 |
| AF055084 | SEQ ID NO 125 |
| AF063725 | SEQ ID NO 129 |
| AF070536 | SEQ ID NO 133 |
| AF070617 | SEQ ID NO 135 |
| AF073299 | SEQ ID NO 136 |
| AF079529 | SEQ ID NO 140 |
| AF090353 | SEQ ID NO 141 |
| AF116238 | SEQ ID NO 155 |
| AF151810 | SEQ ID NO 171 |
| AF220492 | SEQ ID NO 185 |
| AJ224741 | SEQ ID NO 196 |
| AJ250475 | SEQ ID NO 201 |
| AJ270996 | SEQ ID NO 202 |
| AJ272057 | SEQ ID NO 203 |
| AK000174 | SEQ ID NO 211 |
| AK000617 | SEQ ID NO 215 |
| AK000959 | SEQ ID NO 222 |
| AK001438 | SEQ ID NO 229 |
| AK001838 | SEQ ID NO 233 |
| AK002107 | SEQ ID NO 238 |
| AK002197 | SEQ ID NO 239 |
| AL035297 | SEQ ID NO 241 |
| AL049346 | SEQ ID NO 243 |
| AL049370 | SEQ ID NO 245 |
| AL049667 | SEQ ID NO 249 |
| AL080222 | SEQ ID NO 276 |
| AL096737 | SEQ ID NO 279 |
| AL110163 | SEQ ID NO 282 |
| AL133057 | SEQ ID NO 300 |
| AL133096 | SEQ ID NO 302 |
| AL133572 | SEQ ID NO 305 |
| AL133619 | SEQ ID NO 307 |
| AL133623 | SEQ ID NO 309 |
| AL137347 | SEQ ID NO 320 |
| AL137381 | SEQ ID NO 322 |
| AL137461 | SEQ ID NO 325 |
| AL137540 | SEQ ID NO 328 |
| AL137555 | SEQ ID NO 329 |
| AL137638 | SEQ ID NO 332 |
| AL137639 | SEQ ID NO 333 |
| AL137663 | SEQ ID NO 334 |
| AL137761 | SEQ ID NO 339 |
| AL157431 | SEQ ID NO 340 |
| AL161960 | SEQ ID NO 351 |
| AL355708 | SEQ ID NO 353 |
| AL359053 | SEQ ID NO 354 |
| D26488 | SEQ ID NO 359 |
| D38521 | SEQ ID NO 361 |
| D50914 | SEQ ID NO 367 |
| D80001 | SEQ ID NO 369 |
| G26403 | SEQ ID NO 380 |
| K02276 | SEQ ID NO 383 |
| M21551 | SEQ ID NO 394 |
| M27749 | SEQ ID NO 397 |
| M28170 | SEQ ID NO 398 |
| M73547 | SEQ ID NO 409 |
| M80899 | SEQ ID NO 411 |
| NM_000067 | SEQ ID NO 423 |
| NM_000087 | SEQ ID NO 427 |
| NM_000090 | SEQ ID NO 428 |
| NM_000165 | SEQ ID NO 444 |
| NM_000168 | SEQ ID NO 445 |
| NM_000196 | SEQ ID NO 449 |
| NM_000269 | SEQ ID NO 457 |
| NM_000310 | SEQ ID NO 466 |
| NM_000396 | SEQ ID NO 479 |
| NM_000397 | SEQ ID NO 480 |
| NM_000597 | SEQ ID NO 502 |
| NM_000636 | SEQ ID NO 509 |
| NM_000888 | SEQ ID NO 535 |
| NM_000903 | SEQ ID NO 536 |
| NM_000930 | SEQ ID NO 540 |
| NM_000931 | SEQ ID NO 541 |
| NM_000969 | SEQ ID NO 547 |
| NM_000984 | SEQ ID NO 548 |
| NM_001026 | SEQ ID NO 552 |
| NM_001054 | SEQ ID NO 554 |
| NM_001179 | SEQ ID NO 567 |
| NM_001184 | SEQ ID NO 568 |
| NM_001204 | SEQ ID NO 571 |
| NM_001206 | SEQ ID NO 572 |
| NM_001218 | SEQ ID NO 575 |
| NM_001275 | SEQ ID NO 586 |
| NM_001394 | SEQ ID NO 602 |
| NM_001424 | SEQ ID NO 605 |
| NM_001448 | SEQ ID NO 610 |
| NM_001504 | SEQ ID NO 620 |
| NM_001553 | SEQ ID NO 630 |
| NM_001674 | SEQ ID NO 646 |
| NM_001675 | SEQ ID NO 647 |
| NM_001725 | SEQ ID NO 652 |
| NM_001740 | SEQ ID NO 656 |
| NM_001756 | SEQ ID NO 659 |
| NM_001770 | SEQ ID NO 664 |

TABLE 3-continued

430 gene markers that distinguish BRCA1-related tumor samples from sporadic tumor samples

| GenBank Accession Number | SEQ ID NO |
| --- | --- |
| NM_001797 | SEQ ID NO 670 |
| NM_001845 | SEQ ID NO 680 |
| NM_001873 | SEQ ID NO 684 |
| NM_001888 | SEQ ID NO 687 |
| NM_001892 | SEQ ID NO 688 |
| NM_001919 | SEQ ID NO 694 |
| NM_001946 | SEQ ID NO 698 |
| NM_001953 | SEQ ID NO 699 |
| NM_001960 | SEQ ID NO 704 |
| NM_001985 | SEQ ID NO 709 |
| NM_002023 | SEQ ID NO 712 |
| NM_002051 | SEQ ID NO 716 |
| NM_002053 | SEQ ID NO 717 |
| NM_002164 | SEQ ID NO 734 |
| NM_002200 | SEQ ID NO 739 |
| NM_002201 | SEQ ID NO 740 |
| NM_002213 | SEQ ID NO 741 |
| NM_002250 | SEQ ID NO 747 |
| NM_002512 | SEQ ID NO 780 |
| NM_002542 | SEQ ID NO 784 |
| NM_002561 | SEQ ID NO 786 |
| NM_002615 | SEQ ID NO 793 |
| NM_002686 | SEQ ID NO 803 |
| NM_002709 | SEQ ID NO 806 |
| NM_002742 | SEQ ID NO 812 |
| NM_002775 | SEQ ID NO 815 |
| NM_002975 | SEQ ID NO 848 |
| NM_002982 | SEQ ID NO 849 |
| NM_003104 | SEQ ID NO 870 |
| NM_003118 | SEQ ID NO 872 |
| NM_003144 | SEQ ID NO 876 |
| NM_003165 | SEQ ID NO 882 |
| NM_003197 | SEQ ID NO 885 |
| NM_003202 | SEQ ID NO 886 |
| NM_003217 | SEQ ID NO 888 |
| NM_003283 | SEQ ID NO 898 |
| NM_003462 | SEQ ID NO 911 |
| NM_003500 | SEQ ID NO 918 |
| NM_003561 | SEQ ID NO 925 |
| NM_003607 | SEQ ID NO 930 |
| NM_003633 | SEQ ID NO 933 |
| NM_003641 | SEQ ID NO 934 |
| NM_003683 | SEQ ID NO 943 |
| NM_003729 | SEQ ID NO 949 |
| NM_003793 | SEQ ID NO 954 |
| NM_003829 | SEQ ID NO 958 |
| NM_003866 | SEQ ID NO 961 |
| NM_003904 | SEQ ID NO 967 |
| NM_003953 | SEQ ID NO 974 |
| NM_004024 | SEQ ID NO 982 |
| NM_004053 | SEQ ID NO 986 |
| NM_004295 | SEQ ID NO 1014 |
| NM_004438 | SEQ ID NO 1038 |
| NM_004559 | SEQ ID NO 1057 |
| NM_004616 | SEQ ID NO 1065 |
| NM_004741 | SEQ ID NO 1080 |
| NM_004772 | SEQ ID NO 1084 |
| NM_004791 | SEQ ID NO 1086 |
| NM_004848 | SEQ ID NO 1094 |
| NM_004866 | SEQ ID NO 1097 |
| NM_005128 | SEQ ID NO 1121 |
| NM_005148 | SEQ ID NO 1124 |
| NM_005196 | SEQ ID NO 1127 |
| NM_005326 | SEQ ID NO 1140 |
| NM_005518 | SEQ ID NO 1161 |
| NM_005538 | SEQ ID NO 1163 |
| NM_005557 | SEQ ID NO 1170 |
| NM_005718 | SEQ ID NO 1189 |
| NM_005804 | SEQ ID NO 1201 |
| NM_005824 | SEQ ID NO 1203 |
| NM_005935 | SEQ ID NO 1220 |
| NM_006002 | SEQ ID NO 1225 |
| NM_006148 | SEQ ID NO 1249 |
| NM_006235 | SEQ ID NO 1257 |
| NM_006271 | SEQ ID NO 1261 |
| NM_006287 | SEQ ID NO 1264 |
| NM_006296 | SEQ ID NO 1267 |
| NM_006378 | SEQ ID NO 1275 |
| NM_006461 | SEQ ID NO 1287 |
| NM_006573 | SEQ ID NO 1300 |
| NM_006622 | SEQ ID NO 1302 |
| NM_006696 | SEQ ID NO 1308 |
| NM_006769 | SEQ ID NO 1316 |
| NM_006787 | SEQ ID NO 1319 |
| NM_006875 | SEQ ID NO 1334 |
| NM_006885 | SEQ ID NO 1335 |
| NM_006918 | SEQ ID NO 1339 |
| NM_006923 | SEQ ID NO 1340 |
| NM_006941 | SEQ ID NO 1342 |
| NM_007070 | SEQ ID NO 1354 |
| NM_007088 | SEQ ID NO 1356 |
| NM_007146 | SEQ ID NO 1358 |
| NM_007173 | SEQ ID NO 1359 |
| NM_007246 | SEQ ID NO 1366 |
| NM_007358 | SEQ ID NO 1374 |
| NM_012135 | SEQ ID NO 1385 |
| NM_012151 | SEQ ID NO 1387 |
| NM_012258 | SEQ ID NO 1396 |
| NM_012317 | SEQ ID NO 1399 |
| NM_012337 | SEQ ID NO 1403 |
| NM_012339 | SEQ ID NO 1404 |
| NM_012391 | SEQ ID NO 1406 |
| NM_012428 | SEQ ID NO 1412 |
| NM_013233 | SEQ ID NO 1418 |
| NM_013253 | SEQ ID NO 1422 |
| NM_013262 | SEQ ID NO 1425 |
| NM_013372 | SEQ ID NO 1434 |
| NM_013378 | SEQ ID NO 1435 |
| NM_014096 | SEQ ID NO 1450 |
| NM_014242 | SEQ ID NO 1464 |
| NM_014314 | SEQ ID NO 1472 |
| NM_014398 | SEQ ID NO 1486 |
| NM_014402 | SEQ ID NO 1488 |
| NM_014476 | SEQ ID NO 1496 |
| NM_014521 | SEQ ID NO 1499 |
| NM_014585 | SEQ ID NO 1504 |
| NM_014597 | SEQ ID NO 1506 |
| NM_014642 | SEQ ID NO 1510 |
| NM_014679 | SEQ ID NO 1517 |
| NM_014680 | SEQ ID NO 1518 |
| NM_014700 | SEQ ID NO 1520 |
| NM_014723 | SEQ ID NO 1523 |
| NM_014770 | SEQ ID NO 1530 |
| NM_014785 | SEQ ID NO 1534 |
| NM_014817 | SEQ ID NO 1539 |
| NM_014840 | SEQ ID NO 1541 |
| NM_014878 | SEQ ID NO 1546 |
| NM_015493 | SEQ ID NO 1564 |
| NM_015523 | SEQ ID NO 1568 |
| NM_015544 | SEQ ID NO 1570 |
| NM_015623 | SEQ ID NO 1572 |
| NM_015640 | SEQ ID NO 1573 |
| NM_015721 | SEQ ID NO 1576 |
| NM_015881 | SEQ ID NO 1577 |
| NM_015937 | SEQ ID NO 1582 |
| NM_015964 | SEQ ID NO 1586 |
| NM_015984 | SEQ ID NO 1587 |
| NM_016000 | SEQ ID NO 1591 |
| NM_016018 | SEQ ID NO 1593 |
| NM_016066 | SEQ ID NO 1601 |
| NM_016073 | SEQ ID NO 1603 |
| NM_016081 | SEQ ID NO 1604 |
| NM_016140 | SEQ ID NO 1611 |
| NM_016223 | SEQ ID NO 1622 |
| NM_016267 | SEQ ID NO 1629 |
| NM_016307 | SEQ ID NO 1633 |

TABLE 3-continued

430 gene markers that distinguish BRCA1-related tumor samples from sporadic tumor samples

| GenBank Accession Number | SEQ ID NO |
|---|---|
| NM_016364 | SEQ ID NO 1639 |
| NM_016373 | SEQ ID NO 1640 |
| NM_016459 | SEQ ID NO 1646 |
| NM_016471 | SEQ ID NO 1648 |
| NM_016548 | SEQ ID NO 1654 |
| NM_016620 | SEQ ID NO 1662 |
| NM_016820 | SEQ ID NO 1674 |
| NM_017423 | SEQ ID NO 1678 |
| NM_017709 | SEQ ID NO 1698 |
| NM_017732 | SEQ ID NO 1700 |
| NM_017734 | SEQ ID NO 1702 |
| NM_017750 | SEQ ID NO 1704 |
| NM_017763 | SEQ ID NO 1706 |
| NM_017782 | SEQ ID NO 1710 |
| NM_017816 | SEQ ID NO 1714 |
| NM_018043 | SEQ ID NO 1730 |
| NM_018072 | SEQ ID NO 1734 |
| NM_018093 | SEQ ID NO 1738 |
| NM_018103 | SEQ ID NO 1742 |
| NM_018171 | SEQ ID NO 1751 |
| NM_018187 | SEQ ID NO 1755 |
| NM_018188 | SEQ ID NO 1756 |
| NM_018222 | SEQ ID NO 1761 |
| NM_018228 | SEQ ID NO 1762 |
| NM_018373 | SEQ ID NO 1777 |
| NM_018390 | SEQ ID NO 1781 |
| NM_018422 | SEQ ID NO 1784 |
| NM_018509 | SEQ ID NO 1792 |
| NM_018584 | SEQ ID NO 1796 |
| NM_018653 | SEQ ID NO 1797 |
| NM_018660 | SEQ ID NO 1798 |
| NM_018683 | SEQ ID NO 1799 |
| NM_019049 | SEQ ID NO 1814 |
| NM_019063 | SEQ ID NO 1815 |
| NM_020150 | SEQ ID NO 1823 |
| NM_020987 | SEQ ID NO 1848 |
| NM_021095 | SEQ ID NO 1855 |
| NM_021242 | SEQ ID NO 1867 |
| U41387 | SEQ ID NO 1877 |
| U45975 | SEQ ID NO 1878 |
| U58033 | SEQ ID NO 1881 |
| U67784 | SEQ ID NO 1884 |
| U68385 | SEQ ID NO 1885 |
| U80736 | SEQ ID NO 1890 |
| X00437 | SEQ ID NO 1899 |
| X07203 | SEQ ID NO 1904 |
| X16302 | SEQ ID NO 1907 |
| X51630 | SEQ ID NO 1908 |
| X57809 | SEQ ID NO 1912 |
| X57819 | SEQ ID NO 1913 |
| X58529 | SEQ ID NO 1914 |
| X66087 | SEQ ID NO 1916 |
| X69150 | SEQ ID NO 1917 |
| X72475 | SEQ ID NO 1918 |
| X74794 | SEQ ID NO 1920 |
| X75315 | SEQ ID NO 1921 |
| X84340 | SEQ ID NO 1925 |
| X98260 | SEQ ID NO 1928 |
| Y07512 | SEQ ID NO 1931 |
| Y14737 | SEQ ID NO 1932 |
| Z34893 | SEQ ID NO 1934 |
| Contig237_RC | SEQ ID NO 1940 |
| Contig292_RC | SEQ ID NO 1942 |
| Contig372_RC | SEQ ID NO 1943 |
| Contig756_RC | SEQ ID NO 1955 |
| Contig842_RC | SEQ ID NO 1958 |
| Contig1632_RC | SEQ ID NO 1977 |
| Contig1826_RC | SEQ ID NO 1980 |
| Contig2237_RC | SEQ ID NO 1988 |
| Contig2915_RC | SEQ ID NO 2003 |
| Contig3164_RC | SEQ ID NO 2007 |
| Contig3252_RC | SEQ ID NO 2008 |
| Contig3940_RC | SEQ ID NO 2018 |
| Contig9259_RC | SEQ ID NO 2039 |
| Contig10268_RC | SEQ ID NO 2041 |
| Contig10437_RC | SEQ ID NO 2043 |
| Contig10973_RC | SEQ ID NO 2044 |
| Contig14390_RC | SEQ ID NO 2054 |
| Contig16453_RC | SEQ ID NO 2060 |
| Contig16759_RC | SEQ ID NO 2061 |
| Contig19551 | SEQ ID NO 2070 |
| Contig24541_RC | SEQ ID NO 2088 |
| Contig25362_RC | SEQ ID NO 2093 |
| Contig25617_RC | SEQ ID NO 2094 |
| Contig25722_RC | SEQ ID NO 2096 |
| Contig26022_RC | SEQ ID NO 2099 |
| Contig27915_RC | SEQ ID NO 2114 |
| Contig28081_RC | SEQ ID NO 2116 |
| Contig28179_RC | SEQ ID NO 2118 |
| Contig28550_RC | SEQ ID NO 2119 |
| Contig29639_RC | SEQ ID NO 2127 |
| Contig29647_RC | SEQ ID NO 2128 |
| Contig30092_RC | SEQ ID NO 2130 |
| Contig30209_RC | SEQ ID NO 2132 |
| Contig32185_RC | SEQ ID NO 2156 |
| Contig32798_RC | SEQ ID NO 2161 |
| Contig33230_RC | SEQ ID NO 2163 |
| Contig33394_RC | SEQ ID NO 2165 |
| Contig36323_RC | SEQ ID NO 2197 |
| Contig36761_RC | SEQ ID NO 2201 |
| Contig37141_RC | SEQ ID NO 2209 |
| Contig37778_RC | SEQ ID NO 2218 |
| Contig38285_RC | SEQ ID NO 2222 |
| Contig38520_RC | SEQ ID NO 2225 |
| Contig38901_RC | SEQ ID NO 2232 |
| Contig39826_RC | SEQ ID NO 2241 |
| Contig40212_RC | SEQ ID NO 2251 |
| Contig40712_RC | SEQ ID NO 2257 |
| Contig41402_RC | SEQ ID NO 2265 |
| Contig41635_RC | SEQ ID NO 2272 |
| Contig42006_RC | SEQ ID NO 2280 |
| Contig42220_RC | SEQ ID NO 2286 |
| Contig42306_RC | SEQ ID NO 2287 |
| Contig43918_RC | SEQ ID NO 2312 |
| Contig44195_RC | SEQ ID NO 2316 |
| Contig44265_RC | SEQ ID NO 2318 |
| Contig44278_RC | SEQ ID NO 2319 |
| Contig44757_RC | SEQ ID NO 2329 |
| Contig45588_RC | SEQ ID NO 2349 |
| Contig46262_RC | SEQ ID NO 2361 |
| Contig46288_RC | SEQ ID NO 2362 |
| Contig46343_RC | SEQ ID NO 2363 |
| Contig46452_RC | SEQ ID NO 2366 |
| Contig46868_RC | SEQ ID NO 2373 |
| Contig46937_RC | SEQ ID NO 2377 |
| Contig48004_RC | SEQ ID NO 2393 |
| Contig48249_RC | SEQ ID NO 2397 |
| Contig48774_RC | SEQ ID NO 2405 |
| Contig48913_RC | SEQ ID NO 2411 |
| Contig48945_RC | SEQ ID NO 2412 |
| Contig48970_RC | SEQ ID NO 2413 |
| Contig49233_RC | SEQ ID NO 2419 |
| Contig49289_RC | SEQ ID NO 2422 |
| Contig49342_RC | SEQ ID NO 2423 |
| Contig49510_RC | SEQ ID NO 2430 |
| Contig49855 | SEQ ID NO 2440 |
| Contig49948_RC | SEQ ID NO 2442 |
| Contig50297_RC | SEQ ID NO 2451 |
| Contig50669_RC | SEQ ID NO 2458 |
| Contig50673_RC | SEQ ID NO 2459 |
| Contig50838_RC | SEQ ID NO 2465 |
| Contig51068_RC | SEQ ID NO 2471 |
| Contig51929 | SEQ ID NO 2492 |
| Contig51953_RC | SEQ ID NO 2493 |
| Contig52405_RC | SEQ ID NO 2502 |
| Contig52543_RC | SEQ ID NO 2505 |

TABLE 3-continued 430 gene markers that distinguish BRCA1-related tumor samples from sporadic tumor samples

| GenBank Accession Number | SEQ ID NO |
|---|---|
| Contig52720_RC | SEQ ID NO 2513 |
| Contig53281_RC | SEQ ID NO 2530 |
| Contig53598_RC | SEQ ID NO 2537 |
| Contig53757_RC | SEQ ID NO 2543 |
| Contig53944_RC | SEQ ID NO 2545 |
| Contig54425 | SEQ ID NO 2561 |
| Contig54547_RC | SEQ ID NO 2565 |
| Contig54757_RC | SEQ ID NO 2574 |
| Contig54916_RC | SEQ ID NO 2581 |
| Contig55770_RC | SEQ ID NO 2604 |
| Contig55801_RC | SEQ ID NO 2606 |
| Contig56143_RC | SEQ ID NO 2619 |
| Contig56160_RC | SEQ ID NO 2620 |
| Contig56303_RC | SEQ ID NO 2626 |
| Contig57023_RC | SEQ ID NO 2639 |
| Contig57138_RC | SEQ ID NO 2644 |
| Contig57609_RC | SEQ ID NO 2657 |
| Contig58301_RC | SEQ ID NO 2667 |
| Contig58512_RC | SEQ ID NO 2670 |
| Contig60393 | SEQ ID NO 2674 |
| Contig60509_RC | SEQ ID NO 2675 |
| Contig61254_RC | SEQ ID NO 2677 |
| Contig62306 | SEQ ID NO 2680 |
| Contig64502 | SEQ ID NO 2689 |

TABLE 4

100 preferred markers from Table 3 distinguishing BRCA1-related tumors from sporadic tumors.

| Identifier | Correlation | Sequence Name | Description |
|---|---|---|---|
| NM_001892 | −0.651689 | CSNK1A1 | casein kinase 1, alpha 1 |
| NM_018171 | −0.637696 | FLJ10659 | hypothetical protein FLJ10659 |
| Contig40712_RC | −0.612509 | | ESTs |
| NM_001204 | −0.608470 | BMPR2 | bone morphogenetic protein receptor, type II (serine/threonine kinase) |
| NM_005148 | −0.598612 | UNC119 | unc119 (*C. elegans*) homolog |
| G26403 | 0.585054 | YWHAH | tyrosine 3-monooxygenase/tryptophan 5-monooxygenase activation protein, eta polypeptide |
| NM_015640 | 0.583397 | PAI-RBP1 | PAI-1 mRNA-binding protein |
| Contig9259_RC | 0.581362 | | ESTs |
| AB033049 | −0.578750 | KIAA1223 | KIAA1223 protein |
| NM_015523 | 0.576029 | DKFZP566E144 | small fragment nuclease |
| Contig41402_RC | −0.571650 | | Human DNA sequence from clone RP11-16L21 on chromosome 9. Contains the gene for NADP-dependent leukotriene B4 12-hydroxydehydrogenase, the gene for a novel DnaJ domain protein similar to *Drosophila, C. elegans* and Arabidopsis predicted proteins, the GNG10 gene for guanine nucleotide binding protein 10, a novel gene, ESTs, STSs, GSSs and six CpG islands |
| NM_004791 | −0.564819 | ITGBL1 | integrin, beta-like 1 (with EGF-like repeat domains) |
| NM_007070 | 0.561173 | FAP48 | FKBP-associated protein |
| NM_014597 | 0.555907 | HSU15552 | acidic 82 kDa protein mRNA |
| AF000974 | 0.547194 | TRIP6 | thyroid hormone receptor interactor 6 |
| NM_016073 | −0.547072 | CGI-142 | CGI-142 |
| Contig3940_RC | 0.544073 | YWHAH | tyrosine 3-monooxygenase/tryptophan 5-monooxygenase activation protein, eta polypeptide |
| NM_003683 | 0.542219 | D21S2056E | DNA segment on chromosome 21 (unique) 2056 expressed sequence |
| Contig58512_RC | −0.528458 | | *Homo sapiens* pancreas tumor-related protein (FKSG12) mRNA, complete cds |
| NM_003904 | 0.521223 | ZNF259 | zinc finger protein 259 |
| Contig26022_RC | 0.517351 | | ESTs |
| Contig48970_RC | −0.516953 | KIAA0892 | KIAA0892 protein |
| NM_016307 | −0.515398 | PRX2 | paired related homeobox protein |

TABLE 4-continued 100 preferred markers from Table 3 distinguishing
BRCA1-related tumors from sporadic tumors.

| Identifier | Correlation | Sequence Name | Description |
|---|---|---|---|
| AL137761 | −0.514891 | | *Homo sapiens* mRNA; cDNA DKFZp586L2424 (from clone DKFZp586L2424) |
| NM_001919 | −0.514799 | DCI | dodecenoyl-Coenzyme A delta isomerase (3,2 trans-enoyl-Coenzyme A isomerase) |
| NM_000196 | −0.514004 | HSD11B2 | hydroxysteroid (11-beta) dehydrogenase 2 |
| NM_002200 | 0.513149 | IRF5 | interferon regulatory factor 5 |
| AL133572 | 0.511340 | | *Homo sapiens* mRNA; cDNA DKFZp434I0535 (from clone DKFZp434I0535); partial cds |
| NM_019063 | 0.511127 | C2ORF2 | chromosome 2 open reading frame 2 |
| Contig25617_RC | 0.509506 | | ESTs |
| NM_007358 | 0.508145 | M96 | putative DNA binding protein |
| NM_014785 | −0.507114 | KIAA0258 | KIAA0258 gene product |
| NM_006235 | 0.506585 | POU2AF1 | POU domain, class 2, associating factor 1 |
| NM_014680 | −0.505779 | KIAA0100 | KIAA0100 gene product |
| X66087 | 0.500842 | MYBL1 | v-myb avian myeloblastosis viral oncogene homolog-like 1 |
| Y07512 | −0.500686 | PRKG1 | protein kinase, cGMP-dependent, type I |
| NM_006296 | 0.500344 | VRK2 | vaccinia related kinase 2 |
| Contig44278_RC | 0.498260 | DKFZP434K114 | DKFZP434K114 protein |
| Contig56160_RC | −0.497695 | | ESTs |
| NM_002023 | −0.497570 | FMOD | fibromodulin |
| M28170 | 0.497095 | CD19 | CD19 antigen |
| D26488 | 0.496511 | KIAA0007 | KIAA0007 protein |
| X72475 | 0.496125 | | *H. sapiens* mRNA for rearranged Ig kappa light chain variable region (I.114) |
| K02276 | 0.496068 | MYC | v-myc avian myelocytomatosis viral oncogene homolog |
| NM_013378 | 0.495648 | VPREB3 | pre-B lymphocyte gene 3 |
| X58529 | 0.495608 | IGHM | immunoglobulin heavy constant mu |
| NM_000168 | −0.494260 | GLI3 | GLI-Kruppel family member GLI3 (Greig cephalopolysyndactyly syndrome) |
| NM_004866 | −0.492967 | SCAMP1 | secretory carrier membrane protein 1 |
| NM_013253 | −0.491159 | DKK3 | dickkopf (*Xenopus laevis*) homolog 3 |
| NM_003729 | 0.488971 | RPC | RNA 3'-terminal phosphate cyclase |
| NM_006875 | 0.487407 | PIM2 | pim-2 oncogene |
| NM_018188 | 0.487126 | FLJ10709 | hypothetical protein FLJ10709 |
| NM_004848 | 0.485408 | ICB-1 | basement membrane-induced gene |
| NM_001179 | 0.483253 | ART3 | ADP-ribosyltransferase 3 |
| NM_016548 | −0.482329 | LOC51280 | golgi membrane protein GP73 |
| NM_007146 | −0.481994 | ZNF161 | zinc finger protein 161 |
| NM_021242 | −0.481754 | STRAIT11499 | hypothetical protein STRAIT11499 |
| NM_016223 | 0.481710 | PACSIN3 | protein kinase C and casein kinase substrate in neurons 3 |
| NM_003197 | −0.481526 | TCEB1L | transcription elongation factor B (SIII), polypeptide 1-like |
| NM_000067 | −0.481003 | CA2 | carbonic anhydrase II |
| NM_006885 | −0.479705 | ATBF1 | AT-binding transcription factor 1 |
| NM_002542 | 0.478282 | OGG1 | 8-oxoguanine DNA glycosylase |
| AL133619 | −0.476596 | | *Homo sapiens* mRNA; cDNA DKFZp434E2321 (from clone DKFZp434E2321); partial cds |
| D80001 | 0.476130 | KIAA0179 | KIAA0179 protein |
| NM_018660 | −0.475548 | LOC55893 | papillomavirus regulatory factor PRF-1 |
| AB004857 | 0.473440 | SLC11A2 | solute carrier family 11 (proton-coupled divalent metal ion transporters), member 2 |
| NM_002250 | 0.472900 | KCNN4 | potassium intermediate/small conductance calcium-activated channel, subfamily N, member 4 |

TABLE 4-continued 100 preferred markers from Table 3 distinguishing BRCA1-related tumors from sporadic tumors.

| Identifier | Correlation | Sequence Name | Description |
|---|---|---|---|
| Contig56143_RC | −0.472611 | | ESTs, Weakly similar to A54849 collagen alpha 1(VII) chain precursor [*H. sapiens*] |
| NM_001960 | 0.471502 | EEF1D | eukaryotic translation elongation factor 1 delta (guanine nucleotide exchange protein) |
| Contig52405_RC | −0.470705 | | ESTs, Weakly similar to ALU8_HUMAN ALU SUBFAMILY SX SEQUENCE CONTAMINATION WARNING ENTRY [*H. sapiens*] |
| Contig30092_RC | −0.469977 | | *Homo sapiens* PR-domain zinc finger protein 6 isoform B (PRDM6) mRNA, partial cds; alternatively spliced |
| NM_003462 | −0.468753 | P28 | dynein, axonemal, light intermediate polypeptide |
| Contig60393 | 0.468475 | | ESTs |
| Contig842_RC | 0.468158 | | ESTs |
| NM_002982 | 0.466362 | SCYA2 | small inducible cytokine A2 (monocyte chemotactic protein 1, homologous to mouse Sig-je) |
| Contig14390_RC | 0.464150 | | ESTs |
| NM_001770 | 0.463847 | CD19 | CD19 antigen |
| AK000617 | −0.463158 | | *Homo sapiens* mRNA; cDNA DKFZp434L235 (from clone DKFZp434L235) |
| AF073299 | −0.463007 | SLC9A2 | solute carrier family 9 (sodium/hydrogen exchanger), isoform 2 |
| NM_019049 | 0.461990 | FLJ20054 | hypothetical protein |
| AL137347 | −0.460778 | DKFZP761M1511 | hypothetical protein |
| NM_000396 | −0.460263 | CTSK | cathepsin K (pycnodysostosis) |
| NM_018373 | −0.459268 | FLJ11271 | hypothetical protein FLJ11271 |
| NM_002709 | 0.458500 | PPP1CB | protein phosphatase 1, catalytic subunit, beta isoform |
| NM_016820 | 0.457516 | OGG1 | 8-oxoguanine DNA glycosylase |
| Contig10268_RC | 0.456933 | | Human DNA sequence from clone RP11-196N14 on chromosome 20 Contains ESTs, STSs, GSSs and CpG islands. Contains three novel genes, part of a gene for a novel protein similar to protein serine/threonine phosphatase 4 regulatory subunit 1 (PP4R1) and a gene for a novel protein with an ankyrin domain |
| NM_014521 | −0.456733 | SH3BP4 | SH3-domain binding protein 4 |
| AJ272057 | −0.456548 | STRAIT11499 | hypothetical protein STRAIT11499 |
| NM_015964 | −0.456187 | LOC51673 | brain specific protein |
| Contig16759_RC | −0.456169 | | ESTs |
| NM_015937 | −0.455954 | LOC51604 | CGI-06 protein |
| NM_007246 | −0.455500 | KLHL2 | kelch (*Drosophila*)-like 2 (Mayven) |
| NM_001985 | −0.453024 | ETFB | electron-transfer-flavoprotein, beta polypeptide |
| NM_000984 | −0.452935 | RPL23A | ribosomal protein L23a |
| Contig51953_RC | −0.451695 | | ESTs |
| NM_015984 | 0.450491 | UCH37 | ubiquitin C-terminal hydrolase UCH37 |
| NM_000903 | −0.450371 | DIA4 | diaphorase (NADH/NADPH) (cytochrome b-5 reductase) |
| NM_001797 | −0.449862 | CDH11 | cadherin 11, type 2, OB-cadherin (osteoblast) |
| NM_014878 | 0.449818 | KIAA0020 | KIAA0020 gene product |
| NM_002742 | −0.449590 | PRKCM | protein kinase C, mu |

TABLE 5

231 gene markers that distinguish patients with good prognosis from patients with poor prognosis.

| GenBank Accession Number | SEQ ID NO |
| --- | --- |
| AA555029_RC | SEQ ID NO 1 |
| AB020689 | SEQ ID NO 37 |
| AB032973 | SEQ ID NO 55 |
| AB033007 | SEQ ID NO 58 |
| AB033043 | SEQ ID NO 62 |
| AB037745 | SEQ ID NO 75 |
| AB037863 | SEQ ID NO 88 |
| AF052159 | SEQ ID NO 120 |
| AF052162 | SEQ ID NO 121 |
| AF055033 | SEQ ID NO 124 |
| AF073519 | SEQ ID NO 137 |
| AF148505 | SEQ ID NO 169 |
| AF155117 | SEQ ID NO 173 |
| AF161553 | SEQ ID NO 177 |
| AF201951 | SEQ ID NO 183 |
| AF257175 | SEQ ID NO 189 |
| AJ224741 | SEQ ID NO 196 |
| AK000745 | SEQ ID NO 219 |
| AL050021 | SEQ ID NO 257 |
| AL050090 | SEQ ID NO 259 |
| AL080059 | SEQ ID NO 270 |
| AL080079 | SEQ ID NO 271 |
| AL080110 | SEQ ID NO 272 |
| AL133603 | SEQ ID NO 306 |
| AL133619 | SEQ ID NO 307 |
| AL137295 | SEQ ID NO 315 |
| AL137502 | SEQ ID NO 326 |
| AL137514 | SEQ ID NO 327 |
| AL137718 | SEQ ID NO 336 |
| AL355708 | SEQ ID NO 353 |
| D25328 | SEQ ID NO 357 |
| L27560 | SEQ ID NO 390 |
| M21551 | SEQ ID NO 394 |
| NM_000017 | SEQ ID NO 416 |
| NM_000096 | SEQ ID NO 430 |
| NM_000127 | SEQ ID NO 436 |
| NM_000158 | SEQ ID NO 442 |
| NM_000224 | SEQ ID NO 453 |
| NM_000286 | SEQ ID NO 462 |
| NM_000291 | SEQ ID NO 463 |
| NM_000320 | SEQ ID NO 469 |
| NM_000436 | SEQ ID NO 487 |
| NM_000507 | SEQ ID NO 491 |
| NM_000599 | SEQ ID NO 503 |
| NM_000788 | SEQ ID NO 527 |
| NM_000849 | SEQ ID NO 530 |
| NM_001007 | SEQ ID NO 550 |
| NM_001124 | SEQ ID NO 562 |
| NM_001168 | SEQ ID NO 566 |
| NM_001216 | SEQ ID NO 574 |
| NM_001280 | SEQ ID NO 588 |
| NM_001282 | SEQ ID NO 589 |
| NM_001333 | SEQ ID NO 597 |
| NM_001673 | SEQ ID NO 645 |
| NM_001809 | SEQ ID NO 673 |
| NM_001827 | SEQ ID NO 676 |
| NM_001905 | SEQ ID NO 691 |
| NM_002019 | SEQ ID NO 711 |
| NM_002073 | SEQ ID NO 721 |
| NM_002358 | SEQ ID NO 764 |
| NM_002570 | SEQ ID NO 787 |
| NM_002808 | SEQ ID NO 822 |
| NM_002811 | SEQ ID NO 823 |
| NM_002900 | SEQ ID NO 835 |
| NM_002916 | SEQ ID NO 838 |
| NM_003158 | SEQ ID NO 881 |
| NM_003234 | SEQ ID NO 891 |
| NM_003239 | SEQ ID NO 893 |
| NM_003258 | SEQ ID NO 896 |
| NM_003376 | SEQ ID NO 906 |
| NM_003600 | SEQ ID NO 929 |
| NM_003607 | SEQ ID NO 930 |
| NM_003662 | SEQ ID NO 938 |
| NM_003676 | SEQ ID NO 941 |
| NM_003748 | SEQ ID NO 951 |
| NM_003862 | SEQ ID NO 960 |
| NM_003875 | SEQ ID NO 962 |
| NM_003878 | SEQ ID NO 963 |
| NM_003882 | SEQ ID NO 964 |
| NM_003981 | SEQ ID NO 977 |
| NM_004052 | SEQ ID NO 985 |
| NM_004163 | SEQ ID NO 995 |
| NM_004336 | SEQ ID NO 1022 |
| NM_004358 | SEQ ID NO 1026 |
| NM_004456 | SEQ ID NO 1043 |
| NM_004480 | SEQ ID NO 1046 |
| NM_004504 | SEQ ID NO 1051 |
| NM_004603 | SEQ ID NO 1064 |
| NM_004701 | SEQ ID NO 1075 |
| NM_004702 | SEQ ID NO 1076 |
| NM_004798 | SEQ ID NO 1087 |
| NM_004911 | SEQ ID NO 1102 |
| NM_004994 | SEQ ID NO 1108 |
| NM_005196 | SEQ ID NO 1127 |
| NM_005342 | SEQ ID NO 1143 |
| NM_005496 | SEQ ID NO 1157 |
| NM_005563 | SEQ ID NO 1173 |
| NM_005915 | SEQ ID NO 1215 |
| NM_006096 | SEQ ID NO 1240 |
| NM_006101 | SEQ ID NO 1241 |
| NM_006115 | SEQ ID NO 1245 |
| NM_006117 | SEQ ID NO 1246 |
| NM_006201 | SEQ ID NO 1254 |
| NM_006265 | SEQ ID NO 1260 |
| NM_006281 | SEQ ID NO 1263 |
| NM_006372 | SEQ ID NO 1273 |
| NM_006681 | SEQ ID NO 1306 |
| NM_006763 | SEQ ID NO 1315 |
| NM_006931 | SEQ ID NO 1341 |
| NM_007036 | SEQ ID NO 1349 |
| NM_007203 | SEQ ID NO 1362 |
| NM_012177 | SEQ ID NO 1390 |
| NM_012214 | SEQ ID NO 1392 |
| NM_012261 | SEQ ID NO 1397 |
| NM_012429 | SEQ ID NO 1413 |
| NM_013262 | SEQ ID NO 1425 |
| NM_013296 | SEQ ID NO 1427 |
| NM_013437 | SEQ ID NO 1439 |
| NM_014078 | SEQ ID NO 1449 |
| NM_014109 | SEQ ID NO 1451 |
| NM_014321 | SEQ ID NO 1477 |
| NM_014363 | SEQ ID NO 1480 |
| NM_014750 | SEQ ID NO 1527 |
| NM_014754 | SEQ ID NO 1528 |
| NM_014791 | SEQ ID NO 1535 |
| NM_014875 | SEQ ID NO 1545 |
| NM_014889 | SEQ ID NO 1548 |
| NM_014968 | SEQ ID NO 1554 |
| NM_015416 | SEQ ID NO 1559 |
| NM_015417 | SEQ ID NO 1560 |
| NM_015434 | SEQ ID NO 1562 |
| NM_015984 | SEQ ID NO 1587 |
| NM_016337 | SEQ ID NO 1636 |
| NM_016359 | SEQ ID NO 1638 |
| NM_016448 | SEQ ID NO 1645 |
| NM_016569 | SEQ ID NO 1655 |
| NM_016577 | SEQ ID NO 1656 |
| NM_017779 | SEQ ID NO 1708 |
| NM_018004 | SEQ ID NO 1725 |
| NM_018098 | SEQ ID NO 1739 |
| NM_018104 | SEQ ID NO 1743 |
| NM_018120 | SEQ ID NO 1745 |
| NM_018136 | SEQ ID NO 1748 |
| NM_018265 | SEQ ID NO 1766 |
| NM_018354 | SEQ ID NO 1774 |
| NM_018401 | SEQ ID NO 1782 |

TABLE 5-continued

231 gene markers that distinguish patients with good prognosis from patients with poor prognosis.

| GenBank Accession Number | SEQ ID NO |
| --- | --- |
| NM_018410 | SEQ ID NO 1783 |
| NM_018454 | SEQ ID NO 1786 |
| NM_018455 | SEQ ID NO 1787 |
| NM_019013 | SEQ ID NO 1809 |
| NM_020166 | SEQ ID NO 1825 |
| NM_020188 | SEQ ID NO 1830 |
| NM_020244 | SEQ ID NO 1835 |
| NM_020386 | SEQ ID NO 1838 |
| NM_020675 | SEQ ID NO 1842 |
| NM_020974 | SEQ ID NO 1844 |
| R70506_RC | SEQ ID NO 1868 |
| U45975 | SEQ ID NO 1878 |
| U58033 | SEQ ID NO 1881 |
| U82987 | SEQ ID NO 1891 |
| U96131 | SEQ ID NO 1896 |
| X05610 | SEQ ID NO 1903 |
| X94232 | SEQ ID NO 1927 |
| Contig753_RC | SEQ ID NO 1954 |
| Contig1778_RC | SEQ ID NO 1979 |
| Contig2399_RC | SEQ ID NO 1989 |
| Contig2504_RC | SEQ ID NO 1991 |
| Contig3902_RC | SEQ ID NO 2017 |
| Contig4595 | SEQ ID NO 2022 |
| Contig8581_RC | SEQ ID NO 2037 |
| Contig13480_RC | SEQ ID NO 2052 |
| Contig17359_RC | SEQ ID NO 2068 |
| Contig20217_RC | SEQ ID NO 2072 |
| Contig21812_RC | SEQ ID NO 2082 |
| Contig24252_RC | SEQ ID NO 2087 |
| Contig25055_RC | SEQ ID NO 2090 |
| Contig25343_RC | SEQ ID NO 2092 |
| Contig25991 | SEQ ID NO 2098 |
| Contig27312_RC | SEQ ID NO 2108 |
| Contig28552_RC | SEQ ID NO 2120 |
| Contig32125_RC | SEQ ID NO 2155 |
| Contig32185_RC | SEQ ID NO 2156 |
| Contig33814_RC | SEQ ID NO 2169 |
| Contig34634_RC | SEQ ID NO 2180 |
| Contig35251_RC | SEQ ID NO 2185 |
| Contig37063_RC | SEQ ID NO 2206 |
| Contig37598 | SEQ ID NO 2216 |
| Contig38288_RC | SEQ ID NO 2223 |
| Contig40128_RC | SEQ ID NO 2248 |
| Contig40831_RC | SEQ ID NO 2260 |
| Contig41413_RC | SEQ ID NO 2266 |
| Contig41887_RC | SEQ ID NO 2276 |
| Contig42421_RC | SEQ ID NO 2291 |
| Contig43747_RC | SEQ ID NO 2311 |
| Contig44064_RC | SEQ ID NO 2315 |
| Contig44289_RC | SEQ ID NO 2320 |
| Contig44799_RC | SEQ ID NO 2330 |
| Contig45347_RC | SEQ ID NO 2344 |
| Contig45816_RC | SEQ ID NO 2351 |
| Contig46218_RC | SEQ ID NO 2358 |
| Contig46223_RC | SEQ ID NO 2359 |
| Contig46653_RC | SEQ ID NO 2369 |
| Contig46802_RC | SEQ ID NO 2372 |
| Contig47405_RC | SEQ ID NO 2384 |
| Contig48328_RC | SEQ ID NO 2400 |
| Contig49670_RC | SEQ ID NO 2434 |
| Contig50106_RC | SEQ ID NO 2445 |
| Contig50410 | SEQ ID NO 2453 |
| Contig50802_RC | SEQ ID NO 2463 |
| Contig51464_RC | SEQ ID NO 2481 |
| Contig51519_RC | SEQ ID NO 2482 |
| Contig51749_RC | SEQ ID NO 2486 |
| Contig51963 | SEQ ID NO 2494 |
| Contig53226_RC | SEQ ID NO 2525 |
| Contig53268_RC | SEQ ID NO 2529 |
| Contig53646_RC | SEQ ID NO 2538 |
| Contig53742_RC | SEQ ID NO 2542 |
| Contig55188_RC | SEQ ID NO 2586 |
| Contig55313_RC | SEQ ID NO 2590 |
| Contig55377_RC | SEQ ID NO 2591 |
| Contig55725_RC | SEQ ID NO 2600 |
| Contig55813_RC | SEQ ID NO 2607 |
| Contig55829_RC | SEQ ID NO 2608 |
| Contig56457_RC | SEQ ID NO 2630 |
| Contig57595 | SEQ ID NO 2655 |
| Contig57864_RC | SEQ ID NO 2663 |
| Contig58368_RC | SEQ ID NO 2668 |
| Contig60864_RC | SEQ ID NO 2676 |
| Contig63102_RC | SEQ ID NO 2684 |
| Contig63649_RC | SEQ ID NO 2686 |
| Contig64688 | SEQ ID NO 2690 |

TABLE 6

70 Preferred prognosis markers drawn from Table 5.

| Identifier | Correlation | Sequence Name | Description |
| --- | --- | --- | --- |
| AL080059 | −0.527150 | | *Homo sapiens* mRNA for KIAA1750 protein, partial cds |
| Contig63649_RC | −0.468130 | | ESTs |
| Contig46218_RC | −0.432540 | | ESTs |
| NM_016359 | −0.424930 | LOC51203 | clone HQ0310 PRO0310p1 |
| AA555029_RC | −0.424120 | | ESTs |
| NM_003748 | 0.420671 | ALDH4 | aldehyde dehydrogenase 4 (glutamate gamma-semialdehyde dehydrogenase; pyrroline-5-carboxylate dehydrogenase) |
| Contig38288_RC | −0.414970 | | ESTs, Weakly similar to ISHUSS protein disulfide-isomerase [*H. sapiens*] |
| NM_003862 | 0.410964 | FGF18 | fibroblast growth factor 18 |
| Contig28552_RC | −0.409260 | | *Homo sapiens* mRNA; cDNA DKFZp434C0931 (from clone DKFZp434C0931); partial cds |

TABLE 6-continued

70 Preferred prognosis markers drawn from Table 5.

| Identifier | Correlation | Sequence Name | Description |
|---|---|---|---|
| Contig32125_RC | 0.409054 | | ESTs |
| U82987 | 0.407002 | BBC3 | Bcl-2 binding component 3 |
| AL137718 | −0.404980 | | *Homo sapiens* mRNA; cDNA DKFZp434C0931 (from clone DKFZp434C0931); partial cds |
| AB037863 | 0.402335 | KIAA1442 | KIAA1442 protein |
| NM_020188 | −0.400070 | DC13 | DC13 protein |
| NM_020974 | 0.399987 | CEGP1 | CEGP1 protein |
| NM_000127 | −0.399520 | EXT1 | exostoses (multiple) 1 |
| NM_002019 | −0.398070 | FLT1 | fms-related tyrosine kinase 1 (vascular endothelial growth factor/vascular permeability factor receptor) |
| NM_002073 | −0.395460 | GNAZ | guanine nucleotide binding protein (G protein), alpha z polypeptide |
| NM_000436 | −0.392120 | OXCT | 3-oxoacid CoA transferase |
| NM_004994 | −0.391690 | MMP9 | matrix metalloproteinase 9 (gelatinase B, 92 kD gelatinase, 92 kD type IV collagenase) |
| Contig55377_RC | 0.390600 | | ESTs |
| Contig35251_RC | −0.390410 | | *Homo sapiens* cDNA: FLJ22719 fis, clone HSI14307 |
| Contig25991 | −0.390370 | ECT2 | epithelial cell transforming sequence 2 oncogene |
| NM_003875 | −0.386520 | GMPS | guanine monphosphate synthetase |
| NM_006101 | −0.385890 | HEC | highly expressed in cancer, rich in leucine heptad repeats |
| NM_003882 | 0.384479 | WISP1 | WNT1 inducible signaling pathway protein 1 |
| NM_003607 | −0.384390 | PK428 | Ser-Thr protein kinase related to the myotonic dystrophy protein kinase |
| AF073519 | −0.383340 | SERF1A | small EDRK-rich factor 1A (telomeric) |
| AF052162 | −0.380830 | FLJ12443 | hypothetical protein FLJ12443 |
| NM_000849 | 0.380831 | GSTM3 | glutathione S-transferase M3 (brain) |
| Contig32185_RC | −0.379170 | | *Homo sapiens* cDNA FLJ13997 fis, clone Y79AA1002220 |
| NM_016577 | −0.376230 | RAB6B | RAB6B, member RAS oncogene family |
| Contig48328_RC | 0.375252 | | ESTs, Weakly similar to T17248 hypothetical protein DKFZp586G1122.1 [*H. sapiens*] |
| Contig46223_RC | 0.374289 | | ESTs |
| NM_015984 | −0.373880 | UCH37 | ubiquitin C-terminal hydrolase UCH37 |
| NM_006117 | 0.373290 | PECI | peroxisomal D3,D2-enoyl-CoA isomerase |
| AK000745 | −0.373060 | | *Homo sapiens* cDNA FLJ20738 fis, clone HEP08257 |
| Contig40831_RC | −0.372930 | | ESTs |
| NM_003239 | 0.371524 | TGFB3 | transforming growth factor, beta 3 |
| NM_014791 | −0.370860 | KIAA0175 | KIAA0175 gene product |
| X05610 | −0.370860 | COL4A2 | collagen, type IV, alpha 2 |
| NM_016448 | −0.369420 | L2DTL | L2DTL protein |
| NM_018401 | 0.368349 | HSA250839 | gene for serine/threonine protein kinase |
| NM_000788 | −0.367700 | DCK | deoxycytidine kinase |
| Contig51464_RC | −0.367450 | FLJ22477 | hypothetical protein FLJ22477 |
| AL080079 | −0.367390 | DKFZP564D0462 | hypothetical protein DKFZp564D0462 |
| NM_006931 | −0.366490 | SLC2A3 | solute carrier family 2 (facilitated glucose transporter), member 3 |
| AF257175 | 0.365900 | | *Homo sapiens* hepatocellular carcinoma-associated antigen 64 (HCA64) mRNA, complete cds |
| NM_014321 | −0.365810 | ORC6L | origin recognition complex, subunit 6 (yeast homolog)-like |
| NM_002916 | −0.365590 | RFC4 | replication factor C (activator 1) 4 (37 kD) |

TABLE 6-continued

70 Preferred prognosis markers drawn from Table 5.

| Identifier | Correlation | Sequence Name | Description |
| --- | --- | --- | --- |
| Contig55725_RC | −0.365350 | | ESTs, Moderately similar to T50635 hypothetical protein DKFZp762L0311.1 [*H. sapiens*] |
| Contig24252_RC | −0.364990 | | ESTs |
| AF201951 | 0.363953 | CFFM4 | high affinity immunoglobulin epsilon receptor beta subunit |
| NM_005915 | −0.363850 | MCM6 | minichromosome maintenance deficient (mis5, *S. pombe*) 6 |
| NM_001282 | 0.363326 | AP2B1 | adaptor-related protein complex 2, beta 1 subunit |
| Contig56457_RC | −0.361650 | TMEFF1 | transmembrane protein with EGF-like and two follistatin-like domains 1 |
| NM_000599 | −0.361290 | IGFBP5 | insulin-like growth factor binding protein 5 |
| NM_020386 | −0.360780 | LOC57110 | H-REV107 protein-related protein |
| NM_014889 | −0.360040 | MP1 | metalloprotease 1 (pitrilysin family) |
| AF055033 | −0.359940 | IGFBP5 | insulin-like growth factor binding protein 5 |
| NM_006681 | −0.359700 | NMU | neuromedin U |
| NM_007203 | −0.359570 | AKAP2 | A kinase (PRKA) anchor protein 2 |
| Contig63102_RC | 0.359255 | FLJ11354 | hypothetical protein FLJ11354 |
| NM_003981 | −0.358260 | PRC1 | protein regulator of cytokinesis 1 |
| Contig20217_RC | −0.357880 | | ESTs |
| NM_001809 | −0.357720 | CENPA | centromere protein A (17 kD) |
| Contig2399_RC | −0.356600 | SM-20 | similar to rat smooth muscle protein SM-20 |
| NM_004702 | −0.356600 | CCNE2 | cyclin E2 |
| NM_007036 | −0.356540 | ESM1 | endothelial cell-specific molecule 1 |
| NM 018354 | −0.356000 | FLJ11190 | hypothetical protein FLJ11190 |

The sets of markers listed in Tables 1-6 partially overlap; in other words, some markers are present in multiple sets, while other markers are unique to a set (FIG. 1). Thus, in one embodiment, the invention provides a set of 256 genetic markers that can distinguish between ER(+) and ER(−), and also between BRCA1 tumors and sporadic tumors (i.e., classify a tumor as ER(−) or ER(−) and BRCA1-related or sporadic). In a more specific embodiment, the invention provides subsets of at least 20, at least 50, at least 100, or at least 150 of the set of 256 markers, that can classify a tumor as ER(−) or ER(−) and BRCA1-related or sporadic. In another embodiment, the invention provides 165 markers that can distinguish between ER(+) and ER(−), and also between patients with good versus poor prognosis (i.e., classify a tumor as either ER(−) or ER(+) and as having been removed from a patient with a good prognosis or a poor prognosis). In a more specific embodiment, the invention further provides subsets of at least 20, 50, 100 or 125 of the full set of 165 markers, which also classify a tumor as either ER(−) or ER(+) and as having been removed from a patient with a good prognosis or a poor prognosis The invention further provides a set of twelve markers that can distinguish between BRCA1 tumors and sporadic tumors, and between patients with good versus poor prognosis. Finally, the invention provides eleven markers capable of differentiating all three statuses. Conversely, the invention provides 2,050 of the 2,460 ER-status markers that can determine only ER status, 173 of the 430 BRCA1 v. sporadic markers that can determine only BRCA1 v. sporadic status, and 65 of the 231 prognosis markers that can only determine prognosis. In more specific embodiments, the invention also provides for subsets of at least 20, 50, 100, 200, 500, 1,000, 1,500 or 2,000 of the 2,050 ER-status markers that also determine only ER status. The invention also provides subsets of at least 20, 50, 100 or 150 of the 173 markers that also determine only BRCA1 v. sporadic status. The invention further provides subsets of at least 20, 30, 40, or 50 of the 65 prognostic markers that also determine only prognostic status.

Any of the sets of markers provided above may be used alone specifically or in combination with markers outside the set. For example, markers that distinguish ER-status may be used in combination with the BRCA1 vs. sporadic markers, or with the prognostic markers, or both. Any of the marker sets provided above may also be used in combination with other markers for breast cancer, or for any other clinical or physiological condition.

The relationship between the marker sets is diagramed in FIG. 1.

5.3.2 Identification of Markers

The present invention provides sets of markers for the identification of conditions or indications associated with breast cancer. Generally, the marker sets were identified by determining which of ~25,000 human markers had expression patters that correlated with the conditions or indications.

In one embodiment, the method for identifying marker sets is as follows. After extraction and labeling of target polynucleotides, the expression of all markers (genes) in a sample X is compared to the expression of all markers in a standard or control. In one embodiment, the standard or control comprises target polynucleotide molecules derived from a sample from a normal individual (i.e., an individual not afflicted with breast cancer). In a preferred embodiment, the standard or control is a pool of target polynucleotide molecules. The pool may derived from collected samples from a number of normal individuals. In a preferred embodiment, the pool comprises samples taken from a number of individuals having sporadic-type tumors. In another preferred embodiment, the pool comprises an artificially-generated population of nucleic acids designed to approximate the level of nucleic acid derived from each marker found in a pool of marker-derived nucleic acids derived from tumor samples. In yet another embodiment, the pool is derived from normal or breast cancer cell lines or cell line samples.

The comparison may be accomplished by any means known in the art. For example, expression levels of various markers may be assessed by separation of target polynucleotide molecules (e.g., RNA or cDNA) derived from the markers in agarose or polyacrylamide gels, followed by hybridization with marker-specific oligonucleotide probes. Alternatively, the comparison may be accomplished by the labeling of target polynucleotide molecules followed by separation on a sequencing gel. Polynucleotide samples are placed on the gel such that patient and control or standard polynucleotides are in adjacent lanes. Comparison of expression levels is accomplished visually or by means of densitometer. In a preferred embodiment, the expression of all markers is assessed simultaneously by hybridization to a microarray. In each approach, markers meeting certain criteria are identified as associated with breast cancer.

A marker is selected based upon significant difference of expression in a sample as compared to a standard or control condition. Selection may be made based upon either significant up- or down regulation of the marker in the patient sample. Selection may also be made by calculation of the statistical significance (i.e., the p-value) of the correlation between the expression of the marker and the condition or indication. Preferably, both selection criteria are used. Thus, in one embodiment of the present invention, markers associated with breast cancer are selected where the markers show both more than two-fold change (increase or decrease) in expression as compared to a standard, and the p-value for the correlation between the existence of breast cancer and the change in marker expression is no more than 0.01 (i.e., is statistically significant).

The expression of the identified breast cancer-related markers is then used to identify markers that can differentiate tumors into clinical types. In a specific embodiment using a number of tumor samples, markers are identified by calculation of correlation coefficients between the clinical category or clinical parameter(s) and the linear, logarithmic or any transform of the expression ratio across all samples for each individual gene. Specifically, the correlation coefficient is calculated as $$\rho = (\vec{c} \bullet \vec{c})/(\|\vec{c}\| \cdot \|\vec{r}\|) \quad \text{Equation (2)}$$

where $\vec{c}$ represents the clinical parameters or categories and $\vec{r}$ represents the linear, logarithmic or any transform of the ratio of expression between sample and control. Markers for which the coefficient of correlation exceeds a cutoff are identified as breast cancer-related markers specific for a particular clinical type. Such a cutoff or threshold corresponds to a certain significance of discriminating genes obtained by Monte Carlo simulations. The threshold depends upon the number of samples used; the threshold can be calculated as $3 \times 1/\sqrt{n-3}$, where $1/\sqrt{n-3}$ is the distribution width and n=the number of samples. In a specific embodiment, markers are chosen if the correlation coefficient is greater than about 0.3 or less than about −0.3.

Next, the significance of the correlation is calculated. This significance may be calculated by any statistical means by which such significance is calculated. In a specific example, a set of correlation data is generated using a Monte-Carlo technique to randomize the association between the expression difference of a particular marker and the clinical category. The frequency distribution of markers satisfying the criteria through calculation of correlation coefficients is compared to the number of markers satisfying the criteria in the data generated through the Monte-Carlo technique. The frequency distribution of markers satisfying the criteria in the Monte-Carlo runs is used to determine whether the number of markers selected by correlation with clinical data is significant. See Example 4.

Once a marker set is identified, the markers may be rank-ordered in order of significance of discrimination. One means of rank ordering is by the amplitude of correlation between the change in gene expression of the marker and the specific condition being discriminated. Another, preferred means is to use a statistical metric. In a specific embodiment, the metric is a Fisher-like statistic:

$$t = (\langle x_1 \rangle - \langle x_2 \rangle)/\sqrt{[\sigma_1^2(n_1-1) + \sigma_2^2(n_2-1)]/(n_1+n_2-1)(1/n_1+1/n_2)} \quad \text{Equation (3)}$$

In this equation, $\langle x_1 \rangle$ is the error-weighted average of the log ratio of transcript expression measurements within a first diagnostic group (e.g., ER(−)), $\langle x_2 \rangle$ is the error-weighted average of log ratio within a second, related diagnostic group (e.g., ER(+)), $\sigma_1$ is the variance of the log ratio within the ER(−) group and $n_1$ is the number of samples for which valid measurements of log ratios are available. $\sigma_2$ is the variance of log ratio within the second diagnostic group (e.g., ER(+)), and $n_2$ is the number of samples for which valid measurements of log ratios are available. The t-value represents the variance-compensated difference between two means.

The rank-ordered marker set may be used to optimize the number of markers in the set used for discrimination. This is accomplished generally in a "leave one out" method as follows. In a first run, a subset, for example 5, of the markers from the top of the ranked list is used to generate a template, where out of X samples, X-1 are used to generate the template, and the status of the remaining sample is predicted. This process is repeated for every sample until every one of the X samples is predicted once. In a second run, additional markers, for example 5, are added, so that a template is now generated from 10 markers, and the outcome of the remaining sample is predicted. This process is repeated until the entire set of markers is used to generate the template. For each of the runs, type 1 error (false negative) and type 2 errors (false positive) are counted; the optimal number of markers is that number where the type 1 error rate, or type 2 error rate, or preferably the total of type 1 and type 2 error rate is lowest.

For prognostic markers, validation of the marker set may be accomplished by an additional statistic, a survival model. This statistic generates the probability of tumor distant metastases as a function of time since initial diagnosis. A number of models may be used, including Weibull, normal, log-normal, log logistic, log-exponential, or log-Rayleigh (Chapter 12 "Life Testing", S-PLUS 2000 GUIDE TO STATISTICS, Vol. 2, p. 368 (2000)). For the "normal" model, the probability of distant metastases P at time t is calculated as $$P = \alpha \times \exp(-t^2/\tau^2) \quad \text{Equation (4)}$$

where $\alpha$ is fixed and equal to 1, and $\tau$ is a parameter to be fitted and measures the "expected lifetime".

It will be apparent to those skilled in the art that the above methods, in particular the statistical methods, described above, are not limited to the identification of markers associated with breast cancer, but may be used to identify set of marker genes associated with any phenotype. The phenotype can be the presence or absence of a disease such as cancer, or the presence or absence of any identifying clinical condition associated with that cancer. In the disease context, the phenotype may be a prognosis such as a survival time, probability of distant metastases of a disease condition, or likelihood of a particular response to a therapeutic or prophylactic regimen. The phenotype need not be cancer, or a disease; the phenotype may be a nominal characteristic associated with a healthy individual.

5.3.3 Sample Collection

In the present invention, target polynucleotide molecules are extracted from a sample taken from an individual afflicted with breast cancer. The sample may be collected in any clinically acceptable manner, but must be collected such that marker-derived polynucleotides (i.e., RNA) are preserved. mRNA or nucleic acids derived therefrom (i.e., cDNA or amplified DNA) are preferably labeled distinguishably from standard or control polynucleotide molecules, and both are simultaneously or independently hybridized to a microarray comprising some or all of the markers or marker sets or subsets described above. Alternatively, mRNA or nucleic acids derived therefrom may be labeled with the same label as the standard or control polynucleotide molecules, wherein the intensity of hybridization of each at a particular probe is compared. A sample may comprise any clinically relevant tissue sample, such as a tumor biopsy or fine needle aspirate, or a sample of bodily fluid, such as blood, plasma, serum, lymph, ascitic fluid, cystic fluid, urine or nipple exudate. The sample may be taken from a human, or, in a veterinary context, from non-human animals such as ruminants, horses, swine or sheep, or from domestic companion animals such as felines and canines.

Methods for preparing total and poly(A)+ RNA are well known and are described generally in Sambrook et al., MOLECULAR CLONING—A LABORATORY MANUAL (2ND ED.), Vols. 1-3, Cold Spring Harbor Laboratory, Cold Spring Harbor, N.Y. (1989)) and Ausubel et al., CURRENT PROTOCOLS IN MOLECULAR BIOLOGY, vol. 2, Current Protocols Publishing, New York (1994)).

RNA may be isolated from eukaryotic cells by procedures that involve lysis of the cells and denaturation of the proteins contained therein. Cells of interest include wild-type cells (i.e., non-cancerous), drug-exposed wild-type cells, tumor- or tumor-derived cells, modified cells, normal or tumor cell line cells, and drug-exposed modified cells.

Additional steps may be employed to remove DNA. Cell lysis may be accomplished with a nonionic detergent, followed by microcentrifugation to remove the nuclei and hence the bulk of the cellular DNA. In one embodiment, RNA is extracted from cells of the various types of interest using guanidinium thiocyanate lysis followed by CsCl centrifugation to separate the RNA from DNA (Chirgwin et al., *Biochemistry* 18:5294-5299 (1979)). Poly(A)+ RNA is selected by selection with oligo-dT cellulose (see Sambrook et al, MOLECULAR CLONING—A LABORATORY MANUAL (2ND ED.), Vols. 1-3, Cold Spring Harbor Laboratory, Cold Spring Harbor, N.Y. (1989). Alternatively, separation of RNA from DNA can be accomplished by organic extraction, for example, with hot phenol or phenol/chloroform/isoamyl alcohol.

If desired, RNase inhibitors may be added to the lysis buffer. Likewise, for certain cell types, it may be desirable to add a protein denaturation/digestion step to the protocol.

For many applications, it is desirable to preferentially enrich mRNA with respect to other cellular RNAs, such as transfer RNA (tRNA) and ribosomal RNA (rRNA). Most mRNAs contain a poly(A) tail at their 3' end. This allows them to be enriched by affinity chromatography, for example, using oligo(dT) or poly(U) coupled to a solid support, such as cellulose or Sephadex™ (see Ausubel et al., CURRENT PROTOCOLS IN MOLECULAR BIOLOGY, vol. 2, Current Protocols Publishing, New York (1994). Once bound, poly(A)+ mRNA is eluted from the affinity column using 2 mM EDTA/0.1% SDS.

The sample of RNA can comprise a plurality of different mRNA molecules, each different mRNA molecule having a different nucleotide sequence. In a specific embodiment, the mRNA molecules in the RNA sample comprise at least 100 different nucleotide sequences. More preferably, the mRNA molecules of the RNA sample comprise mRNA molecules corresponding to each of the marker genes. In another specific embodiment, the RNA sample is a mammalian RNA sample.

In a specific embodiment, total RNA or mRNA from cells are used in the methods of the invention. The source of the RNA can be cells of a plant or animal, human, mammal, primate, non-human animal, dog, cat, mouse, rat, bird, yeast, eukaryote, prokaryote, etc. In specific embodiments, the method of the invention is used with a sample containing total mRNA or total RNA from $1 \times 10^6$ cells or less. In another embodiment, proteins can be isolated from the foregoing sources, by methods known in the art, for use in expression analysis at the protein level.

Probes to the homologs of the marker sequences disclosed herein can be employed preferably wherein non-human nucleic acid is being assayed.

5.4 Methods of Using Breast Cancer Marker Sets 5.4.1 Diagnostic Methods

The present invention provides for methods of using the marker sets to analyze a sample from an individual so as to determine the individual's tumor type or subtype at a molecular level, whether a tumor is of the ER(+) or ER(−) type, and whether the tumor is BRCA1-associated or sporadic. The individual need not actually be afflicted with breast cancer. Essentially, the expression of specific marker genes in the individual, or a sample taken therefrom, is compared to a standard or control. For example, assume two breast cancer-related conditions, X and Y. One can compare the level of expression of breast cancer prognostic markers for condition X in an individual to the level of the marker-derived polynucleotides in a control, wherein the level represents the level of expression exhibited by samples having condition X. In this instance, if the expression of the markers in the individual's sample is substantially (i.e., statistically) different from that of the control, then the individual does not have condition X. Where, as here, the choice is bimodal (i.e., a sample is either X or Y), the individual can additionally be said to have condition Y. Of course, the comparison to a control representing condition Y can also be performed. Preferably both are performed simultaneously, such that each control acts as both a positive and a negative control. The distinguishing result may thus either be a demonstrable difference from the expression levels (i.e., the amount of marker-derived RNA, or polynucleotides derived therefrom) represented by the control, or no significant difference.

Thus, in one embodiment, the method of determining a particular tumor-related status of an individual comprises the steps of (1) hybridizing labeled target polynucleotides from an individual to a microarray containing one of the above marker sets; (2) hybridizing standard or control polynucleotides molecules to the microarray, wherein the standard or control molecules are differentially labeled from the target molecules; and (3) determining the difference in transcript levels, or lack thereof, between the target and standard or control, wherein the difference, or lack thereof, determines the individual's tumor-related status. In a more specific embodiment, the standard or control molecules comprise marker-derived polynucleotides from a pool of samples from normal individuals, or a pool of tumor samples from individuals having sporadic-type tumors. In a preferred embodiment, the standard or control is an artificially-generated pool of marker-derived polynucleotides, which pool is designed to mimic the level of marker expression exhibited by clinical samples of normal or breast cancer tumor tissue having a particular clinical indication (i.e., cancerous or non-cancerous; ER(+) or ER(−) tumor; BRCA1—or sporadic type tumor). In another specific embodiment, the control molecules comprise a pool derived from normal or breast cancer cell lines.

The present invention provides sets of markers useful for distinguishing ER(+) from ER(−) tumor types. Thus, in one embodiment of the above method, the level of polynucleotides (i.e., mRNA or polynucleotides derived therefrom) in a sample from an individual, expressed from the markers provided in Table 1 are compared to the level of expression of the same markers from a control, wherein the control comprises marker-related polynucleotides derived from ER(+) samples, ER(−) samples, or both. Preferably, the comparison is to both ER(+) and ER(−), and preferably the comparison is to polynucleotide pools from a number of ER(+) and ER(−) samples, respectively. Where the individual's marker expression most closely resembles or correlates with the ER(+) control, and does not resemble or correlate with the ER(−) control, the individual is classified as ER(+). Where the pool is not pure ER(+) or ER(−), for example, a sporadic pool is used. A set of experiments using individuals with known ER status should be hybridized against the pool, in order to define the expression templates for the ER(+) and ER(−) group. Each individual with unknown ER status is hybridized against the same pool and the expression profile is compared to the templates (s) to determine the individual's ER status.

The present invention provides sets of markers useful for distinguishing BRCA1—related tumors from sporadic tumors. Thus, the method can be performed substantially as for the ER(+/−) determination, with the exception that the markers are those listed in Tables 3 and 4, and the control markers are a pool of marker-derived polynucleotides BRCA1 tumor samples, and a pool of marker-derived polynucleotides from sporadic tumors. A patient is determined to have a BRCA1 germline mutation where the expression of the individual's marker-derived polynucleotides most closely resemble, or are most closely correlated with, that of the BRCA1 control. Where the control is not pure BRCA1 or sporadic, two templates can be defined in a manner similar to that for ER status, as described above.

For the above two embodiments of the method, the full set of markers may be used (i.e., the complete set of markers for Tables 1 or 3). In other embodiments, subsets of the markers may be used. In a preferred embodiment, the preferred markers listed in Tables 2 or 4 are used.

The similarity between the marker expression profile of an individual and that of a control can be assessed a number of ways. In the simplest case, the profiles can be compared visually in a printout of expression difference data. Alternatively, the similarity can be calculated mathematically.

In one embodiment, the similarity measure between two patients x and y, or patient x and a template y, can be calculated using the following equation:

$$S = 1 - \left[ \sum_{i=1}^{N_V} \frac{(x_i - \bar{x})}{\sigma_{x_i}} \frac{(y_i - \bar{y})}{\sigma_{yi}} \Bigg/ \sqrt{\sum_{i=1}^{N_V} \left(\frac{x_i - \bar{x}}{\sigma_{x_i}}\right)^2 \sum_{i=1}^{N_V} \left(\frac{y_i - \bar{y}}{\sigma_{yi}}\right)^2} \right]$$

Equation (5)

In this equation, x and y are two patients with components of log ratio $x_i$ and $y_i$, i=1, ..., N=4,986. Associated with every value $x_i$ is error $\sigma_{x_i}$. The smaller the value $\sigma_{x_i}$, the more reliable the measurement $$\bar{x} = \sum_{i=1}^{N_V} \frac{x_i}{\sigma_{x_i}^2} \Bigg/ \sum_{i=1}^{N_V} \frac{1}{\sigma_{x_i}^2}$$

is the error-weighted arithmetic mean.

In a preferred embodiment, templates are developed for sample comparison. The template is defined as the error-weighted log ratio average of the expression difference for the group of marker genes able to differentiate the particular breast cancer-related condition. For example, templates are defined for ER(+) samples and for ER(−) samples. Next, a classifier parameter is calculated. This parameter may be calculated using either expression level differences between the sample and template, or by calculation of a correlation coefficient. Such a coefficient, $P_i$, can be calculated using the following equation:

$$P_i = (\vec{z}_i \bullet \vec{y}) / (\|\vec{z}_i\| \cdot \|\vec{y}\|)$$

Equation (1)

where $Z_i$ is the expression template i, and y is the expression profile of a patient.

Thus, in a more specific embodiment, the above method of determining a particular tumor-related status of an individual comprises the steps of (1) hybridizing labeled target polynucleotides from an individual to a microarray containing one of the above marker sets; (2) hybridizing standard or control polynucleotides molecules to the microarray, wherein the standard or control molecules are differentially labeled from the target molecules; and (3) determining the ratio (or difference) of transcript levels between two channels (individual and control), or simply the transcript levels of the individual; and (4) comparing the results from (3) to the predefined templates, wherein said determining is accomplished by means of the statistic of Equation 1 or Equation 5, and wherein the difference, or lack thereof, determines the individual's tumor-related status.

5.4.2 Prognostic Methods

The present invention provides sets of markers useful for distinguishing samples from those patients with a good prognosis from samples from patients with a poor prognosis. Thus, the invention further provides a method for using these markers to determine whether an individual afflicted with breast cancer will have a good or poor clinical prognosis. In one embodiment, the invention provides for method of determining whether an individual afflicted with breast cancer will likely experience a relapse within five years of initial diagnosis (i.e., whether an individual has a poor prognosis) comprising (1) comparing the level of expression of the markers listed in Table 5 in a sample taken from the individual to the level of the same markers in a standard or control, where the standard or control levels represent those found in an individual with a poor prognosis; and (2) determining whether the level of the marker-related polynucleotides in the sample from the individual is significantly different than that of the control, wherein if no substantial difference is found, the patient has a poor prognosis, and if a substantial difference is found, the patient has a good prognosis. Persons of skill in the art will readily see that the markers associated with good prognosis can also be used as controls. In a more specific embodiment, both controls are run. In case the pool is not pure 'good prognosis' or 'poor prognosis', a set of experiments of individuals with known outcome should be hybridized against the pool to define the expression templates for the good prognosis and poor prognosis group. Each individual with unknown outcome is hybridized against the same pool and the resulting expression profile is compared to the templates to predict its outcome.

Poor prognosis of breast cancer may indicate that a tumor is relatively aggressive, while good prognosis may indicate that a tumor is relatively nonaggressive. Therefore, the invention provides for a method of determining a course of treatment of a breast cancer patient, comprising determining whether the level of expression of the 231 markers of Table 5, or a subset thereof, correlates with the level of these markers in a sample representing a good prognosis expression pattern or a poor prognosis pattern; and determining a course of treatment, wherein if the expression correlates with the poor prognosis pattern, the tumor is treated as an aggressive tumor.

As with the diagnostic markers, the method can use the complete set of markers listed in Table 5. However, subsets of the markers may also be used. In a preferred embodiment, the subset listed in Table 6 is used.

Classification of a sample as "good prognosis" or "poor prognosis" is accomplished substantially as for the diagnostic markers described above, wherein a template is generated to which the marker expression levels in the sample are compared.

The use of marker sets is not restricted to the prognosis of breast cancer-related conditions, and may be applied in a variety of phenotypes or conditions, clinical or experimental, in which gene expression plays a role. Where a set of markers has been identified that corresponds to two or more phenotypes, the marker sets can be used to distinguish these phenotypes. For example, the phenotypes may be the diagnosis and/or prognosis of clinical states or phenotypes associated with other cancers, other disease conditions, or other physiological conditions, wherein the expression level data is derived from a set of genes correlated with the particular physiological or disease condition.

5.4.3 Improving Sensitivity to Expression Level Differences

In using the markers disclosed herein, and, indeed, using any sets of markers to differentiate an individual having one phenotype from another individual having a second phenotype, one can compare the absolute expression of each of the markers in a sample to a control; for example, the control can be the average level of expression of each of the markers, respectively, in a pool of individuals. To increase the sensitivity of the comparison, however, the expression level values are preferably transformed in a number of ways.

For example, the expression level of each of the markers can be normalized by the average expression level of all markers the expression level of which is determined, or by the average expression level of a set of control genes. Thus, in one embodiment, the markers are represented by probes on a microarray, and the expression level of each of the markers is normalized by the mean or median expression level across all of the genes represented on the microarray, including any non-marker genes. In a specific embodiment, the normalization is carried out by dividing the median or mean level of expression of all of the genes on the microarray. In another embodiment, the expression levels of the markers is normalized by the mean or median level of expression of a set of control markers. In a specific embodiment, the control markers comprise a set of housekeeping genes. In another specific embodiment, the normalization is accomplished by dividing by the median or mean expression level of the control genes.

The sensitivity of a marker-based assay will also be increased if the expression levels of individual markers are compared to the expression of the same markers in a pool of samples. Preferably, the comparison is to the mean or median expression level of each the marker genes in the pool of samples. Such a comparison may be accomplished, for example, by dividing by the mean or median expression level of the pool for each of the markers from the expression level each of the markers in the sample. This has the effect of accentuating the relative differences in expression between markers in the sample and markers in the pool as a whole, making comparisons more sensitive and more likely to produce meaningful results that the use of absolute expression levels alone. The expression level data may be transformed in any convenient way; preferably, the expression level data for all is log transformed before means or medians are taken.

In performing comparisons to a pool, two approaches may be used. First, the expression levels of the markers in the sample may be compared to the expression level of those markers in the pool, where nucleic acid derived from the sample and nucleic acid derived from the pool are hybridized during the course of a single experiment. Such an approach requires that new pool nucleic acid be generated for each comparison or limited numbers of comparisons, and is therefore limited by the amount of nucleic acid available. Alternatively, and preferably, the expression levels in a pool, whether normalized and/or transformed or not, are stored on a computer, or on computer-readable media, to be used in comparisons to the individual expression level data from the sample (i.e., single-channel data).

Thus, the current invention provides the following method of classifying a first cell or organism as having one of at least two different phenotypes, where the different phenotypes comprise a first phenotype and a second phenotype. The level of expression of each of a plurality of genes in a first sample from the first cell or organism is compared to the level of expression of each of said genes, respectively, in a pooled sample from a plurality of cells or organisms, the plurality of cells or organisms comprising different cells or organisms exhibiting said at least two different phenotypes, respectively, to produce a first compared value. The first compared value is then compared to a second compared value, wherein said second compared value is the product of a method comprising comparing the level of expression of each of said genes in a sample from a cell or organism characterized as having said first phenotype to the level of expression of each of said genes, respectively, in the pooled sample. The first compared value is then compared to a third compared value, wherein said third compared value is the product of a method comprising comparing the level of expression of each of the genes in a sample from a cell or organism characterized as having the second phenotype to the level of expression of each of the genes, respectively, in the pooled sample. Optionally, the first compared value can be compared to additional compared values, respectively, where each additional compared value is the product of a method comprising comparing the level of expression of each of said genes in a sample from a cell or organism characterized as having a phenotype different from said first and second phenotypes but included among the at least two different phenotypes, to the level of expression of each of said genes, respectively, in said pooled sample. Finally, a determination is made as to which of said second, third, and, if present, one or more additional compared values, said first compared value is most similar, wherein the first cell or organism is determined to have the phenotype of the cell or organism used to produce said compared value most similar to said first compared value.

In a specific embodiment of this method, the compared values are each ratios of the levels of expression of each of said genes. In another specific embodiment, each of the levels of expression of each of the genes in the pooled sample are normalized prior to any of the comparing steps. In a more specific embodiment, the normalization of the levels of expression is carried out by dividing by the median or mean level of the expression of each of the genes or dividing by the mean or median level of expression of one or more housekeeping genes in the pooled sample from said cell or organism. In another specific embodiment, the normalized levels of expression are subjected to a log transform, and the comparing steps comprise subtracting the log transform from the log of the levels of expression of each of the genes in the sample. In another specific embodiment, the two or more different phenotypes are different stages of a disease or disorder. In still another specific embodiment, the two or more different phenotypes are different prognoses of a disease or disorder. In yet another specific embodiment, the levels of expression of each of the genes, respectively, in the pooled sample or said levels of expression of each of said genes in a sample from the cell or organism characterized as having the first phenotype, second phenotype, or said phenotype different from said first and second phenotypes, respectively, are stored on a computer or on a computer-readable medium.

In another specific embodiment, the two phenotypes are ER(+) or ER(−) status. In another specific embodiment, the two phenotypes are BRCA1 or sporadic tumor-type status. In yet another specific embodiment, the two phenotypes are good prognosis and poor prognosis.

Of course, single-channel data may also be used without specific comparison to a mathematical sample pool. For example, a sample may be classified as having a first or a second phenotype, wherein the first and second phenotypes are related, by calculating the similarity between the expression of at least 5 markers in the sample, where the markers are correlated with the first or second phenotype, to the expression of the same markers in a first phenotype template and a second phenotype template, by (a) labeling nucleic acids derived from a sample with a fluorophore to obtain a pool of fluorophore-labeled nucleic acids; (b) contacting said fluorophore-labeled nucleic acid with a microarray under conditions such that hybridization can occur, detecting at each of a plurality of discrete loci on the microarray a flourescent emission signal from said fluorophore-labeled nucleic acid that is bound to said microarray under said conditions; and (c) determining the similarity of marker gene expression in the individual sample to the first and second templates, wherein if said expression is more similar to the first template, the sample is classified as having the first phenotype, and if said expression is more similar to the second template, the sample is classified as having the second phenotype.

5.5 Determination of Marker Gene Expression Levels 5.5.1 Methods

The expression levels of the marker genes in a sample may be determined by any means known in the art. The expression level may be determined by isolating and determining the level (i.e., amount) of nucleic acid transcribed from each marker gene. Alternatively, or additionally, the level of specific proteins translated from mRNA transcribed from a marker gene may be determined.

The level of expression of specific marker genes can be accomplished by determining the amount of mRNA, or polynucleotides derived therefrom, present in a sample. Any method for determining RNA levels can be used. For example, RNA is isolated from a sample and separated on an agarose gel. The separated RNA is then transferred to a solid support, such as a filter. Nucleic acid probes representing one or more markers are then hybridized to the filter by northern hybridization, and the amount of marker-derived RNA is determined. Such determination can be visual, or machine-aided, for example, by use of a densitometer. Another method of determining RNA levels is by use of a dot-blot or a slot-blot. In this method, RNA, or nucleic acid derived therefrom, from a sample is labeled. The RNA or nucleic acid derived therefrom is then hybridized to a filter containing oligonucleotides derived from one or more marker genes, wherein the oligonucleotides are placed upon the filter at discrete, easily-identifiable locations. Hybridization, or lack thereof, of the labeled RNA to the filter-bound oligonucleotides is determined visually or by densitometer. Polynucleotides can be labeled using a radiolabel or a fluorescent (i.e., visible) label.

These examples are not intended to be limiting; other methods of determining RNA abundance are known in the art.

The level of expression of particular marker genes may also be assessed by determining the level of the specific protein expressed from the marker genes. This can be accomplished, for example, by separation of proteins from a sample on a polyacrylamide gel, followed by identification of specific marker-derived proteins using antibodies in a western blot. Alternatively, proteins can be separated by two-dimensional gel electrophoresis systems. Two-dimensional gel electrophoresis is well-known in the art and typically involves isoelectric focusing along a first dimension followed by SDS-PAGE electrophoresis along a second dimension. See, e.g., Hames et al, 1990, GEL ELECTROPHORESIS OF PROTEINS: A PRACTICAL APPROACH, IRL Press, New York; Shevchenko et al., *Proc. Nat'l Acad. Sci.* USA 93:1440-1445 (1996); Sagliocco et al., *Yeast* 12:1519-1533 (1996); Lander, *Science* 274:536-539 (1996). The resulting electropherograms can be analyzed by numerous techniques, including mass spectrometric techniques, western blotting and immunoblot analysis using polyclonal and monoclonal antibodies.

Alternatively, marker-derived protein levels can be determined by constructing an antibody microarray in which binding sites comprise immobilized, preferably monoclonal, antibodies specific to a plurality of protein species encoded by the cell genome. Preferably, antibodies are present for a substantial fraction of the marker-derived proteins of interest. Methods for making monoclonal antibodies are well known (see, e.g., Harlow and Lane, 1988, ANTIBODIES: A LABORATORY MANUAL, Cold Spring Harbor, N.Y., which is incorporated in its entirety for all purposes). In one embodiment, monoclonal antibodies are raised against synthetic peptide fragments designed based on genomic sequence of the cell. With such an antibody array, proteins from the cell are contacted to the array. and their binding is assayed with assays known in the art. Generally, the expression, and the level of expression, of proteins of diagnostic or prognostic interest can be detected through immunohistochemical staining of tissue slices or sections.

Finally, expression of marker genes in a number of tissue specimens may be characterized using a "tissue array" (Kononen et al., *Nat. Med* 4(7):844-7 (1998)). In a tissue array, multiple tissue samples are assessed on the same microarray. The arrays allow in situ detection of RNA and protein levels; consecutive sections allow the analysis of multiple samples simultaneously.

5.5.2 Microarrays

In preferred embodiments, polynucleotide microarrays are used to measure expression so that the expression status of each of the markers above is assessed simultaneously. In a specific embodiment, the invention provides for oligonucleotide or cDNA arrays comprising probes hybridizable to the genes corresponding to each of the marker sets described above (i.e., markers to determine the molecular type or subtype of a tumor; markers to distinguish ER status; markers to distinguish BRCA1 from sporadic tumors; markers to distinguish patients with good versus patients with poor prognosis; markers to distinguish both ER(+) from ER(−), and BRCA1 tumors from sporadic tumors; markers to distinguish ER(+) from ER(−), and patients with good prognosis from patients with poor prognosis; markers to distinguish BRCA1 tumors from sporadic tumors, and patients with good prognosis from patients with poor prognosis; and markers able to distinguish ER(+) from ER(−), BRCA1 tumors from sporadic tumors, and patients with good prognosis from patients with poor prognosis; and markers unique to each status).

The microarrays provided by the present invention may comprise probes hybridizable to the genes corresponding to markers able to distinguish the status of one, two, or all three of the clinical conditions noted above. In particular, the invention provides polynucleotide arrays comprising probes to a subset or subsets of at least 50, 100, 200, 300, 400, 500, 750, 1,000, 1,250, 1,500, 1,750, 2,000 or 2,250 genetic markers, up to the full set of 2,460 markers, which distinguish ER(+) and ER(−) patients or tumors. The invention also provides probes to subsets of at least 20, 30, 40, 50, 75, 100, 150, 200, 250, 300, 350 or 400 markers, up to the full set of 430 markers, which distinguish between tumors containing a BRCA1 mutation and sporadic tumors within an ER(−) group of tumors. The invention also provides probes to subsets of at least 20, 30, 40, 50, 75, 100, 150 or 200 markers, up to the full set of 231 markers, which distinguish between patients with good and poor prognosis within sporadic tumors. In a specific embodiment, the array comprises probes to marker sets or subsets directed to any two of the clinical conditions. In a more specific embodiment, the array comprises probes to marker sets or subsets directed to all three clinical conditions.

In yet another specific embodiment, microarrays that are used in the methods disclosed herein optionally comprise markers additional to at least some of the markers listed in Tables 1-6. For example, in a specific embodiment, the microarray is a screening or scanning array as described in Altschuler et al., International Publication WO 02/18646, published Mar. 7, 2002 and Scherer et al., International Publication WO 02/16650, published Feb. 28, 2002. The scanning and screening arrays comprise regularly-spaced, positionally-addressable probes derived from genomic nucleic acid sequence, both expressed and unexpressed. Such arrays may comprise probes corresponding to a subset of, or all of, the markers listed in Tables 1-6, or a subset thereof as described above, and can be used to monitor marker expression in the same way as a microarray containing only markers listed in Tables 1-6.

In yet another specific embodiment, the microarray is a commercially-available cDNA microarray that comprises at least five of the markers listed in Tables 1-6. Preferably, a commercially-available cDNA microarray comprises all of the markers listed in Tables 1-6. However, such a microarray may comprise 5, 10, 15, 25, 50, 100, 150, 250, 500, 1000 or more of the markers in any of Tables 1-6, up to the maximum number of markers in a Table, and may comprise all of the markers in any one of Tables 1-6 and a subset of another of Tables 1-6, or subsets of each as described above. In a specific embodiment of the microarrays used in the methods disclosed herein, the markers that are all or a portion of Tables 1-6 make up at least 50%, 60%, 70%, 80%, 90%, 95% or 98% of the probes on the microarray.

General methods pertaining to the construction of microarrays comprising the marker sets and/or subsets above are described in the following sections.

5.5.2.1 Construction of Microarrays

Microarrays are prepared by selecting probes which comprise a polynucleotide sequence, and then immobilizing such probes to a solid support or surface. For example, the probes may comprise DNA sequences, RNA sequences, or copolymer sequences of DNA and RNA. The polynucleotide sequences of the probes may also comprise DNA and/or RNA analogues, or combinations thereof. For example, the polynucleotide sequences of the probes may be full or partial fragments of genomic DNA. The polynucleotide sequences of the probes may also be synthesized nucleotide sequences, such as synthetic oligonucleotide sequences. The probe sequences can be synthesized either enzymatically in vivo, enzymatically in vitro (e.g., by PCR), or non-enzymatically in vitro.

The probe or probes used in the methods of the invention are preferably immobilized to a solid support which may be either porous or non-porous. For example, the probes of the invention may be polynucleotide sequences which are attached to a nitrocellulose or nylon membrane or filter covalently at either the 3' or the 5' end of the polynucleotide. Such hybridization probes are well known in the art (see, e.g., Sambrook et al., MOLECULAR CLONING—A LABORATORY MANUAL (2ND ED.), Vols. 1-3, Cold Spring Harbor Laboratory, Cold Spring Harbor, N.Y. (1989). Alternatively, the solid support or surface may be a glass or plastic surface. In a particularly preferred embodiment, hybridization levels are measured to microarrays of probes consisting of a solid phase on the surface of which are immobilized a population of polynucleotides, such as a population of DNA or DNA mimics, or, alternatively, a population of RNA or RNA mimics. The solid phase may be a nonporous or, optionally, a porous material such as a gel.

In preferred embodiments, a microarray comprises a support or surface with an ordered array of binding (e.g., hybridization) sites or "probes" each representing one of the markers described herein. Preferably the microarrays are addressable arrays, and more preferably positionally addressable arrays. More specifically, each probe of the array is preferably located at a known, predetermined position on the solid support such that the identity (i.e., the sequence) of each probe can be determined from its position in the array (i.e., on the support or surface). In preferred embodiments, each probe is covalently attached to the solid support at a single site.

Microarrays can be made in a number of ways, of which several are described below. However produced, microarrays share certain characteristics. The arrays are reproducible, allowing multiple copies of a given array to be produced and easily compared with each other. Preferably, microarrays are made from materials that are stable under binding (e.g., nucleic acid hybridization) conditions. The microarrays are preferably small, e.g., between 1 cm² and 25 cm², between 12 cm² and 13 cm², or 3 Cm². However, large arrays are also contemplated and may be preferable, e.g., for use in screening arrays. Preferably, a given binding site or unique set of binding sites in the microarray will specifically bind (e.g., hybridize) to the product of a single gene in a cell (e.g., to a specific mRNA, or to a specific cDNA derived therefrom). However, in general, other related or similar sequences will cross hybridize to a given binding site.

The microarrays of the present invention include one or more test probes, each of which has a polynucleotide sequence that is complementary to a subsequence of RNA or DNA to be detected. Preferably, the position of each probe on the solid surface is known. Indeed, the microarrays are preferably positionally addressable arrays. Specifically, each probe of the array is preferably located at a known, predetermined position on the solid support such that the identity (i.e., the sequence) of each probe can be determined from its position on the array (i.e., on the support or surface).

According to the invention, the microarray is an array (i.e., a matrix) in which each position represents one of the markers described herein. For example, each position can contain a DNA or DNA analogue based on genomic DNA to which a particular RNA or cDNA transcribed from that genetic marker can specifically hybridize. The DNA or DNA analogue can be, e.g., a synthetic oligomer or a gene fragment. In one embodiment, probes representing each of the markers is present on the array. In a preferred embodiment, the array comprises the 550 of the 2,460 RE-status markers, 70 of the BRCA1/sporadic markers, and all 231 of the prognosis markers.

5.5.2.2 Preparing Probes for Microarrays

As noted above, the "probe" to which a particular polynucleotide molecule specifically hybridizes according to the invention contains a complementary genomic polynucleotide sequence. The probes of the microarray preferably consist of nucleotide sequences of no more than 1,000 nucleotides. In some embodiments, the probes of the array consist of nucleotide sequences of 10 to 1,000 nucleotides. In a preferred embodiment, the nucleotide sequences of the probes are in the range of 10-200 nucleotides in length and are genomic sequences of a species of organism, such that a plurality of different probes is present, with sequences complementary and thus capable of hybridizing to the genome of such a species of organism, sequentially tiled across all or a portion of such genome. In other specific embodiments, the probes are in the range of 10-30 nucleotides in length, in the range of 10-40 nucleotides in length, in the range of 20-50 nucleotides in length, in the range of 40-80 nucleotides in length, in the range of 50-150 nucleotides in length, in the range of 80-120 nucleotides in length, and most preferably are 60 nucleotides in length.

The probes may comprise DNA or DNA "mimics" (e.g., derivatives and analogues) corresponding to a portion of an organism's genome. In another embodiment, the probes of the microarray are complementary RNA or RNA mimics. DNA mimics are polymers composed of subunits capable of specific, Watson-Crick-like hybridization with DNA, or of specific hybridization with RNA. The nucleic acids can be modified at the base moiety, at the sugar moiety, or at the phosphate backbone. Exemplary DNA mimics include, e.g., phosphorothioates.

DNA can be obtained, e.g., by polymerase chain reaction (PCR) amplification of genomic DNA or cloned sequences. PCR primers are preferably chosen based on a known sequence of the genome that will result in amplification of specific fragments of genomic DNA. Computer programs that are well known in the art are useful in the design of primers with the required specificity and optimal amplification properties, such as Oligo version 5.0 (National Biosciences). Typically each probe on the microarray will be between 10 bases and 50,000 bases, usually between 300 bases and 1,000 bases in length. PCR methods are well known in the art, and are described, for example, in Innis et al., eds., PCR PROTOCOLS: A GUIDE TO METHODS AND APPLICATIONS, Academic Press Inc., San Diego, Calif. (1990). It will be apparent to one skilled in the art that controlled robotic systems are useful for isolating and amplifying nucleic acids.

An alternative, preferred means for generating the polynucleotide probes of the microarray is by synthesis of synthetic polynucleotides or oligonucleotides, e.g., using N-phosphonate or phosphoramidite chemistries (Froehler et al., *Nucleic Acid Res.* 14:5399-5407 (1986); McBride et al., *Tetrahedron Lett.* 24:246-248 (1983)). Synthetic sequences are typically between about 10 and about 500 bases in length, more typically between about 20 and about 100 bases, and most preferably between about 40 and about 70 bases in length. In some embodiments, synthetic nucleic acids include non-natural bases, such as, but by no means limited to, inosine. As noted above, nucleic acid analogues may be used as binding sites for hybridization. An example of a suitable nucleic acid analogue is peptide nucleic acid (see, e.g., Egholm et al., *Nature* 363:566-568 (1993); U.S. Pat. No. 5,539,083). Probes are preferably selected using an algorithm that takes into account binding energies, base composition, sequence complexity, cross-hybridization binding energies, and secondary structure (see Friend et al., International Patent Publication WO 01/05935, published Jan. 25, 2001; Hughes et al., *Nat. Biotech.* 19:342-7 (2001)).

A skilled artisan will also appreciate that positive control probes, e.g., probes known to be complementary and hybridizable to sequences in the target polynucleotide molecules, and negative control probes, e.g., probes known to not be complementary and hybridizable to sequences in the target polynucleotide molecules, should be included on the array. In one embodiment, positive controls are synthesized along the perimeter of the array. In another embodiment, positive controls are synthesized in diagonal stripes across the array. In still another embodiment, the reverse complement for each probe is synthesized next to the position of the probe to serve as a negative control. In yet another embodiment, sequences from other species of organism are used as negative controls or as "spike-in" controls.

5.5.2.3 Attaching Probes to the Solid Surface

The probes are attached to a solid support or surface, which may be made, e.g., from glass, plastic (e.g., polypropylene, nylon), polyacrylamide, nitrocellulose, gel, or other porous or nonporous material. A preferred method for attaching the nucleic acids to a surface is by printing on glass plates, as is described generally by Schena et al, *Science* 270:467-470 (1995). This method is especially useful for preparing microarrays of cDNA (See also, DeRisi et al, *Nature Genetics* 14:457-460 (1996); Shalon et al., *Genome Res.* 6:639-645 (1996); and Schena et al., *Proc. Natl. Acad. Sci. U.S.A.* 93:10539-11286 (1995)).

A second preferred method for making microarrays is by making high-density oligonucleotide arrays. Techniques are known for producing arrays containing thousands of oligonucleotides complementary to defined sequences, at defined locations on a surface using photolithographic techniques for synthesis in situ (see, Fodor et al., 1991, *Science* 251:767-773; Pease et al, 1994, *Proc. Natl. Acad. Sci. U.S.A.* 91:5022-5026; Lockhart et al., 1996, *Nature Biotechnology* 14:1675; U.S. Pat. Nos. 5,578,832; 5,556,752; and 5,510,270) or other methods for rapid synthesis and deposition of defined oligonucleotides (Blanchard et al., *Biosensors & Bioelectronics* 11:687-690). When these methods are used, oligonucleotides (e.g., 60-mers) of known sequence are synthesized directly on a surface such as a derivatized glass slide. Usually, the array produced is redundant, with several oligonucleotide molecules per RNA.

Other methods for making microarrays, e.g., by masking (Maskos and Southern, 1992, *Nuc. Acids. Res.* 20:1679-1684), may also be used. In principle, and as noted supra, any type of array, for example, dot blots on a nylon hybridization membrane (see Sambrook et al., MOLECULAR CLONING—A LABORATORY MANUAL (2ND ED.), Vols. 1-3, Cold Spring Harbor Laboratory, Cold Spring Harbor, N.Y. (1989)) could be used. However, as will be recognized by those skilled in the art, very small arrays will frequently be preferred because hybridization volumes will be smaller.

In one embodiment, the arrays of the present invention are prepared by synthesizing polynucleotide probes on a support. In such an embodiment, polynucleotide probes are attached to the support covalently at either the 3' or the 5' end of the polynucleotide.

In a particularly preferred embodiment, microarrays of the invention are manufactured by means of an ink jet printing device for oligonucleotide synthesis, e.g., using the methods and systems described by Blanchard in U.S. Pat. No. 6,028,189; Blanchard et al., 1996, *Biosensors and Bioelectronics* 11:687-690; Blanchard, 1998, in SYNTHETIC DNA ARRAYS IN GENETIC ENGINEERING, Vol. 20, J. K. Setlow, Ed., Plenum Press, New York at pages 111-123. Specifically, the oligonucleotide probes in such microarrays are preferably synthesized in arrays, e.g., on a glass slide, by serially depositing individual nucleotide bases in "microdroplets" of a high surface tension solvent such as propylene carbonate. The microdroplets have small volumes (e.g., 100 pL or less, more preferably 50 pL or less) and are separated from each other on the microarray (e.g., by hydrophobic domains) to form circular surface tension wells which define the locations of the array elements (i.e., the different probes). Microarrays manufactured by this ink-jet method are typically of high density, preferably having a density of at least about 2,500 different probes per 1 cm$^2$. The polynucleotide probes are attached to the support covalently at either the 3' or the 5' end of the polynucleotide.

5.5.2.4 Target Polynucleotide Molecules

The polynucleotide molecules which may be analyzed by the present invention (the "target polynucleotide molecules") may be from any clinically relevant source, but are expressed RNA or a nucleic acid derived therefrom (e.g., cDNA or amplified RNA derived from cDNA that incorporates an RNA polymerase promoter), including naturally occurring nucleic acid molecules, as well as synthetic nucleic acid molecules. In one embodiment, the target polynucleotide molecules comprise RNA, including, but by no means limited to, total cellular RNA, poly(A)$^+$ messenger RNA (mRNA) or fraction thereof, cytoplasmic mRNA, or RNA transcribed from cDNA (i.e., cRNA; see, e.g., Linsley & Schelter, U.S. patent application Ser. No. 09/411,074, filed Oct. 4, 1999, or U.S. Pat. Nos. 5,545,522, 5,891,636, or 5,716,785). Methods for preparing total and poly(A)$^+$ RNA are well known in the art, and are described generally, e.g., in Sambrook et al., MOLECULAR CLONING—A LABORATORY MANUAL (2ND ED.), Vols. 1-3, Cold Spring Harbor Laboratory, Cold Spring Harbor, N.Y. (1989).

In one embodiment, RNA is extracted from cells of the various types of interest in this invention using guanidinium thiocyanate lysis followed by CsCl centrifugation (Chirgwin et al., 1979, *Biochemistry* 18:5294-5299). In another embodiment, total RNA is extracted using a silica gel-based column, commercially available examples of which include RNeasy (Qiagen, Valencia, Calif.) and StrataPrep (Stratagene, La Jolla, Calif.). In an alternative embodiment, which is preferred for *S. cerevisiae*, RNA is extracted from cells using phenol and chloroform, as described in Ausubel et al., eds., 1989, CURRENT PROTOCOLS IN MOLECULAR BIOLOGY, Vol III, Green Publishing Associates, Inc., John Wiley & Sons, Inc., New York, at pp. 13.12.1-13.12.5). Poly(A)$^+$ RNA can be selected, e.g., by selection with oligo-dT cellulose or, alternatively, by oligo-dT primed reverse transcription of total cellular RNA. In one embodiment, RNA can be fragmented by methods known in the art, e.g., by incubation with $ZnCl_2$, to generate fragments of RNA. In another embodiment, the polynucleotide molecules analyzed by the invention comprise cDNA, or PCR products of amplified RNA or cDNA.

In one embodiment, total RNA, mRNA, or nucleic acids derived therefrom, is isolated from a sample taken from a person afflicted with breast cancer. Target polynucleotide molecules that are poorly expressed in particular cells may be enriched using normalization techniques (Bonaldo et al., 1996, *Genome Res.* 6:791-806).

As described above, the target polynucleotides are detectably labeled at one or more nucleotides. Any method known in the art may be used to detectably label the target polynucleotides. Preferably, this labeling incorporates the label uniformly along the length of the RNA, and more preferably, the labeling is carried out at a high degree of efficiency. One embodiment for this labeling uses oligo-dT primed reverse transcription to incorporate the label; however, conventional methods of this method are biased toward generating 3' end fragments. Thus, in a preferred embodiment, random primers (e.g., 9-mers) are used in reverse transcription to uniformly incorporate labeled nucleotides over the fill length of the target polynucleotides. Alternatively, random primers may be used in conjunction with PCR methods or T7 promoter-based in vitro transcription methods in order to amplify the target polynucleotides.

In a preferred embodiment, the detectable label is a luminescent label. For example, fluorescent labels, bio-luminescent labels, chemi-luminescent labels, and colorimetric labels may be used in the present invention. In a highly preferred embodiment, the label is a fluorescent label, such as a fluorescein, a phosphor, a rhodamine, or a polymethine dye derivative. Examples of commercially available fluorescent labels include, for example, fluorescent phosphoramidites such as FluorePrime (Amersham Pharmacia, Piscataway, N.J.), Fluoredite (Millipore, Bedford, Mass.), FAM (ABI, Foster City, Calif.), and Cy3 or Cy5 (Amersham Pharmacia, Piscataway, N.J.). In another embodiment, the detectable label is a radiolabeled nucleotide.

In a further preferred embodiment, target polynucleotide molecules from a patient sample are labeled differentially from target polynucleotide molecules of a standard. The standard can comprise target polynucleotide molecules from normal individuals (i.e., those not afflicted with breast cancer). In a highly preferred embodiment, the standard comprises target polynucleotide molecules pooled from samples from normal individuals or tumor samples from individuals having sporadic-type breast tumors. In another embodiment, the target polynucleotide molecules are derived from the same individual, but are taken at different time points, and thus indicate the efficacy of a treatment by a change in expression of the markers, or lack thereof during and after the course of treatment (i.e., chemotherapy, radiation therapy or cryotherapy), wherein a change in the expression of the markers from a poor prognosis pattern to a good prognosis pattern indicates that the treatment is efficacious. In this embodiment, different timepoints are differentially labeled.

5.5.2.5 Hybridization to Microarrays

Nucleic acid hybridization and wash conditions are chosen so that the target polynucleotide molecules specifically bind or specifically hybridize to the complementary polynucleotide sequences of the array, preferably to a specific array site, wherein its complementary DNA is located.

Arrays containing double-stranded probe DNA situated thereon are preferably subjected to denaturing conditions to render the DNA single-stranded prior to contacting with the target polynucleotide molecules. Arrays containing single-stranded probe DNA (e.g., synthetic oligodeoxyribonucleic acids) may need to be denatured prior to contacting with the target polynucleotide molecules, e.g., to remove hairpins or dimers which form due to self complementary sequences.

Optimal hybridization conditions will depend on the length (e.g., oligomer versus polynucleotide greater than 200 bases) and type (e.g., RNA, or DNA) of probe and target nucleic acids. One of skill in the art will appreciate that as the oligonucleotides become shorter, it may become necessary to adjust their length to achieve a relatively uniform melting temperature for satisfactory hybridization results. General parameters for specific (i.e., stringent) hybridization conditions for nucleic acids are described in Sambrook et al., MOLECULAR CLONING—A LABORATORY MANUAL (2ND ED.), Vols. 1-3, Cold Spring Harbor Laboratory, Cold Spring Harbor, N.Y. (1989), and in Ausubel et al., CURRENT PROTOCOLS IN MOLECULAR BIOLOGY, vol. 2, Current Protocols Publishing, New York (1994). Typical hybridization conditions for the cDNA microarrays of Schena et al. are hybridization in 5×SSC plus 0.2% SDS at 65° C. for four hours, followed by washes at 25° C. in low stringency wash buffer (1×SSC plus 0.2% SDS), followed by 10 minutes at 25° C. in higher stringency wash buffer (0.1×SSC plus 0.2% SDS) (Schena et al., Proc. Natl. Acad. Sci. U.S.A. 93:10614 (1993)). Useful hybridization conditions are also provided in, e.g., Tijessen, 1993, HYBRIDIZATION WITH NUCLEIC ACID PROBES, Elsevier Science Publishers B. V.; and Kricka, 1992, NONISOTOPIC DNA PROBE TECHNIQUES, Academic Press, San Diego, Calif.

Particularly preferred hybridization conditions include hybridization at a temperature at or near the mean melting temperature of the probes (e.g., within 5° C., more preferably within 2° C.) in 1 M NaCl, 50 mM MES buffer (pH 6.5), 0.5% sodium sarcosine and 30% formamide.

5.5.2.6 Signal Detection and Data Analysis

When fluorescently labeled probes are used, the fluorescence emissions at each site of a microarray may be, preferably, detected by scanning confocal laser microscopy. In one embodiment, a separate scan, using the appropriate excitation line, is carried out for each of the two fluorophores used. Alternatively, a laser may be used that allows simultaneous specimen illumination at wavelengths specific to the two fluorophores and emissions from the two fluorophores can be analyzed simultaneously (see Shalon et al., 1996, "A DNA microarray system for analyzing complex DNA samples using two-color fluorescent probe hybridization," Genome Research 6:639-645, which is incorporated by reference in its entirety for all purposes). In a preferred embodiment, the arrays are scanned with a laser fluorescent scanner with a computer controlled X-Y stage and a microscope objective. Sequential excitation of the two fluorophores is achieved with a multi-line, mixed gas laser and the emitted light is split by wavelength and detected with two photomultiplier tubes. Fluorescence laser scanning devices are described in Schena et al., Genome Res. 6:639-645 (1996), and in other references cited herein. Alternatively, the fiber-optic bundle described by Ferguson et al., Nature Biotech. 14:1681-1684 (1996), may be used to monitor mRNA abundance levels at a large number of sites simultaneously.

Signals are recorded and, in a preferred embodiment, analyzed by computer, e.g., using a 12 or 16 bit analog to digital board. In one embodiment the scanned image is despeckled using a graphics program (e.g., Hijaak Graphics Suite) and then analyzed using an image gridding program that creates a spreadsheet of the average hybridization at each wavelength at each site. If necessary, an experimentally determined correction for "cross talk" (or overlap) between the channels for the two fluors may be made. For any particular hybridization site on the transcript array, a ratio of the emission of the two fluorophores can be calculated. The ratio is independent of the absolute expression level of the cognate gene, but is useful for genes whose expression is significantly modulated in association with the different breast cancer-related condition.

5.6 Computer-Facilitated Analysis

The present invention further provides for kits comprising the marker sets above. In a preferred embodiment, the kit contains a microarray ready for hybridization to target polynucleotide molecules, plus software for the data analyses described above.

The analytic methods described in the previous sections can be implemented by use of the following computer systems and according to the following programs and methods. A Computer system comprises internal components linked to external components. The internal components of a typical computer system include a processor element interconnected with a main memory. For example, the computer system can be an Intel 8086-, 80386-, 80486-, Pentium™, or Pentium™-based processor with preferably 32 MB or more of main memory.

The external components may include mass storage. This mass storage can be one or more hard disks (which are typically packaged together with the processor and memory). Such hard disks are preferably of 1 GB or greater storage capacity. Other external components include a user interface device, which can be a monitor, together with an inputting device, which can be a "mouse", or other graphic input devices, and/or a keyboard. A printing device can also be attached to the computer.

Typically, a computer system is also linked to network link, which can be part of an Ethernet link to other local computer systems, remote computer systems, or wide area communication networks, such as the Internet. This network link allows the computer system to share data and processing tasks with other computer systems.

Loaded into memory during operation of this system are several software components, which are both standard in the art and special to the instant invention. These software components collectively cause the computer system to function according to the methods of this invention. These software components are typically stored on the mass storage device. A software component comprises the operating system, which is responsible for managing computer system and its network interconnections. This operating system can be, for example, of the Microsoft Windows® family, such as Windows 3.1, Windows 95, Windows 98, Windows 2000, or Windows NT. The software component represents common languages and functions conveniently present on this system to assist programs implementing the methods specific to this invention. Many high or low level computer languages can be used to program the analytic methods of this invention. Instructions can be interpreted during run-time or compiled. Preferred languages include C/C++, FORTRAN and JAVA. Most preferably, the methods of this invention are programmed in mathematical software packages that allow symbolic entry of equations and high-level specification of processing, including some or all of the algorithms to be used, thereby freeing a user of the need to procedurally program individual equations or algorithms. Such packages include Mathlab from Mathworks (Natick, Mass.), Mathematica® from Wolfram Research (Champaign, Ill.), or S-Plus® from Math Soft (Cambridge, Mass.). Specifically, the software component includes the analytic methods of the invention as programmed in a procedural language or symbolic package.

The software to be included with the kit comprises the data analysis methods of the invention as disclosed herein. In particular, the software may include mathematical routines for marker discovery, including the calculation of correlation coefficients between clinical categories (i.e., ER status) and marker expression. The software may also include mathematical routines for calculating the correlation between sample marker expression and control marker expression, using array-generated fluorescence data, to determine the clinical classification of a sample.

In an exemplary implementation, to practice the methods of the present invention, a user first loads experimental data into the computer system. These data can be directly entered by the user from a monitor, keyboard, or from other computer systems linked by a network connection, or on removable storage media such as a CD-ROM, floppy disk (not illustrated), tape drive (not illustrated), ZIP® drive (not illustrated) or through the network. Next the user causes execution of expression profile analysis software which performs the methods of the present invention.

In another exemplary implementation, a user first loads experimental data and/or databases into the computer system. This data is loaded into the memory from the storage media or from a remote computer, preferably from a dynamic geneset database system, through the network. Next the user causes execution of software that performs the steps of the present invention.

Alternative computer systems and software for implementing the analytic methods of this invention will be apparent to one of skill in the art and are intended to be comprehended within the accompanying claims. In particular, the accompanying claims are intended to include the alternative program structures for implementing the methods of this invention that will be readily apparent to one of skill in the art.

6. EXAMPLES

Materials and Methods 117 tumor samples from breast cancer patients were collected. RNA samples were then prepared, and each RNA sample was profiled using inkjet-printed microarrays. Marker genes were then identified based on expression patterns; these genes were then used to train classifiers, which used these marker genes to classify tumors into diagnostic and prognostic categories. Finally, these marker genes were used to predict the diagnostic and prognostic outcome for a group of individuals.

1. Sample Collection 117 breast cancer patients treated at The Netherlands Cancer Institute/Antoni van Leeuwenhoek Hospital, Amsterdam, The Netherlands, were selected on the basis of the following clinical criteria (data extracted from the medical records of the NKI/AvL Tumor Register, Biometrics Department).

Group 1 (n=97, 78 for training, 19 for independent tests) was selected on the basis of: (1) primary invasive breast carcinoma <5 cm (T1 or T2); (2) no axillary metastases (N0); (3) age at diagnosis <55 years; (4) calender year of diagnosis 1983-1996; and (5) no prior malignancies (excluding carcinoma in situ of the cervix or basal cell carcinoma of the skin). All patients were treated by modified radical mastectomy (n=34) or breast conserving treatment (n=64), including axillary lymph node dissection. Breast conserving treatment consisted of excision of the tumor, followed by radiation of the whole breast to a dosis of 50 Gy, followed by a boost varying from 15 to 25 Gy. Five patients received adjuvant systemic therapy consisting of chemotherapy (n=3) or hormonal therapy (n=2), all other patients did not receive additional treatment. All patients were followed at least annually for a period of at least 5 years. Patient follow-up information was extracted from the Tumor Registry of the Biometrics Department.

Group 2 (n=20) was selected as: (1) carriers of a germline mutation in BRCA1 or BRCA2; and (2) having primary invasive breast carcinoma. No selection or exclusion was made based on tumor size, lymph node status, age at diagnosis, calender year of diagnosis, other malignancies. Germline mutation status was known prior to this research protocol.

Information about individual from which tumor samples were collected include: year of birth; sex; whether the individual is pre- or post-menopausal; the year of diagnosis; the number of positive lymph nodes and the total number of nodes; whether there was surgery, and if so, whether the surgery was breast-conserving or radical; whether there was radiotherapy, chemotherapy or hormonal therapy. The tumor was graded according to the formula P=TNM, where T is the tumor size (on a scale of 0-5); N is the number of nodes that are positive (on a scale of 0-4); and M is metastases (0=absent, 1=present). The tumor was also classified according to stage, tumor type (in situ or invasive; lobular or ductal; grade) and the presence or absence of the estrogen and progesterone receptors. The progression of the cancer was described by (where applicable): distant metastases; year of distant metastases, year of death, year of last follow-up; and BRCA1 genotype.

2. Tumors:

Germline mutation testing of BRCA1 and BRCA2 on DNA isolated from peripheral blood lymphocytes includes mutation screening by a Protein Truncation Test (PTT) of exon 11 of BRCA1 and exon 10 and 11 of BRCA2, deletion PCR of BRCA1 genomic deletion of exon 13 and 22, as well Denaturing Gradient Gel Electrophoresis (DGGE) of the remaining exons. Aberrant bands were all confirmed by genomic sequencing analyzed on a ABI3700 automatic sequencer and confirmed on a independent DNA sample.

From all, tumor material was snap frozen in liquid nitrogen within one hour after surgery. Of the frozen tumor material an H&E (hematoxylin-eosin) stained section was prepared prior to and after cutting slides for RNA isolation. These H&E frozen sections were assessed for the percentage of tumor cells; only samples with >50% tumor cells were selected for further study.

For all tumors, surgical specimens fixed in formaldehyde and embedded in paraffin were evaluated according to standard histopathological procedures. H&E stained paraffin sections were examined to assess tumor type (e.g., ductal or lobular according to the WHO classification); to assess histologic grade according the method described by Elston and Ellis (grade 1-3); and to assess the presence of lymphangio-invasive growth and the presence of an extensive lymphocytic infiltrate. All histologic factors were independently assessed by two pathologists (MV and JL); consensus on differences was reached by examining the slides together. A representative slide of each tumor was used for immunohistochemical staining with antibodies directed against the estrogen- and progesterone receptor by standard procedures. The staining result was scored as the percentage of positively staining nuclei (0%, 10%, 20%, etc., up to 100%).

3. Amplification, Labeling, and Hybridization

The outline for the production of marker-derived nucleic acids and hybridization of the nucleic acids to a microarray are outlined in FIG. 2. 30 frozen sections of 30 μM thickness were used for total RNA isolation of each snap frozen tumor specimen. Total RNA was isolated with RNAzol™ B (Campro Scientific, Veenendaal, The Netherlands) according to the manufacturers protocol, including homogenization of the tissue using a Polytron PT-MR2100 (Merck, Amsterdam, The Netherlands) and finally dissolved in RNAse-free $H_2O$. The quality of the total RNA was assessed by A260/A280 ratio and had to be between 1.7 and 2.1 as well as visual inspection of the RNA on an agarose gel which should indicate a stronger 28S ribosomal RNA band compared to the 18S ribosomal RNA band. subsequently, 25 μg of total RNA was DNase treated using the Qiagen RNase-free DNase kit and RNeasy spin columns (Qiagen Inc, GmbH, Germany) according to the manufacturers protocol. DNase treated total RNA was dissolved in RNase-free $H_2O$ to a final concentration of 0.2 μg/μl.

5 μg total RNA was used as input for cRNA synthesis. An oligo-dT primer containing a T7 RNA polymerase promoter sequence was used to prime first strand cDNA synthesis, and random primers (pdN6) were used to prime second strand cDNA synthesis by MMLV reverse transcriptase. This reaction yielded a double-stranded cDNA that contained the T7 RNA polymerase (T7RNAP) promoter. The double-stranded cDNA was then transcribed into cRNA by T7RNAP.

cRNA was labeled with Cy3 or Cy5 dyes using a two-step process. First, allylamine-derivitized nucleotides were enzymatically incorporated into cRNA products. For cRNA labeling, a 3:1 mixture of 5-(3-Aminoallyl)uridine 5'-triphosphate (Sigma) and UTP was substituted for UTP in the in vitro transcription (IVT) reaction. Allylamine-derivitized cRNA products were then reacted with N-hydroxy succinimide esters of Cy3 or Cy5 (CyDye, Amersham Pharmacia Biotech). 5 μg Cy5-labeled cRNA from one breast cancer patient was mixed with the same amount of Cy3-labeled product from a pool of equal amount of cRNA from each individual sporadic patient.

Microarray hybridizations were done in duplicate with fluor reversals. Before hybridization, labeled cRNAs were fragmented to an average size of ~50-100 nt by heating at 60° C. in the presence of 10 mM ZnCl2. Fragmented cRNAs were added to hybridization buffer containing 1 M NaCl, 0.5% sodium sarcosine and 50 mM MES, pH 6.5, which stringency was regulated by the addition of formamide to a final concentration of 30%. Hybridizations were carried out in a final volume of 3 mls at 40° C. on a rotating platform in a hybridization oven (Robbins Scientific) for 48 h. After hybridization, slides were washed and scanned using a confocal laser scanner (Agilent Technologies). Fluorescence intensities on scanned images were quantified, normalized and corrected.

4. Pooling of Samples

The reference cRNA pool was formed by pooling equal amount of cRNAs from each individual sporadic patient, for a total of 78 tumors.

5.25 k Human Microarray

Surface-bound oligonucleotides were synthesized essentially as proposed by Blanchard et al., Biosens. Bioelectron. 6(7):687-690 (1996); see also Hughes et al., Nature Biotech. 19(4):342-347 (2000). Hydrophobic glass surfaces (3 inches by 3 inches) containing exposed hydroxyl groups were used as substrates for nucleotide synthesis. Phosphoramidite monomers were delivered to computer-defined positions on the glass surfaces using ink-jet printer heads. Unreacted monomers were then washed away and the ends of the extended oligonucleotides were deprotected. This cycle of monomer coupling, washing and deprotection was repeated for each desired layer of nucleotide synthesis. Oligonucleotide sequences to be printed were specified by computer files.

Microarrays containing approximately 25,000 human gene sequences (Hu25K microarrays) were used for this study. Sequences for microarrays were selected from RefSeq (a collection of non-redundant mRNA sequences, located on the Internet at nlm.nih.gov/LocusLink/refseq.html) and Phil Green EST contigs, which is a collection of EST contigs assembled by Dr. Phil Green et al at the University of Washington (Ewing and Green, Nat. Genet. 25(2):232-4 (2000)), available on the Internet at phrap.org/est_assembly/index.html. Each mRNA or EST contig was represented on Hu25K microarray by a single 60mer oligonucleotide essentially as described in Hughes et al., Nature Biotech. 19(4): 342-347 and in International Publication WO 01/06013, published Jan. 25, 2001, and in International Publication WO 01/05935, published Jan. 25, 2001, except that the rules for oligo screening were modified to remove oligonucleotides with more than 30% C or with 6 or more contiguous C residues.

Example 1

Differentially Regulated Gene Sets and, Overall Expression Patterns of Breast Cancer Tumors Of the approximately 25,000 sequences represented on the microarray, a group of approximately 5,000 genes that were significantly regulated across the group of samples was selected. A gene was determined to be significantly differentially regulated with cancer of the breast if it showed more than two-fold of transcript changes as compared to a sporadic tumor pool, and if the p-value for differential regulation (Hughes et al., Cell 102:109-126 (2000)) was less than 0.01 either upwards or downwards in at least five out of 98 tumor samples.

An unsupervised clustering algorithm allowed us to cluster patients based on their similarities measured over this set of ~5,000 significant genes. The similarity measure between two patients x and y is defined as $$S = 1 - \left[ \sum_{i=1}^{N_V} \frac{(x_i - \bar{x})}{\sigma_{x_i}} \frac{(y_i - \bar{y})}{\sigma_{y_i}} \right] \Big/ \qquad \text{Equation (5)}$$

$$\sqrt{\left[\sum_{i=1}^{N_V}\left(\frac{x_i-\overline{x}}{\sigma_{x_i}}\right)^2 \sum_{i=1}^{N_V}\left(\frac{y_i-\overline{y}}{\sigma_{yi}}\right)^2\right]}$$

In Equation (5), x and y are two patients with components of log ratio $x_i$ and $Y_i$, i=1, . . . , N=5,100. Associated with every value $x_i$ is error $\sigma_{x_i}$. The smaller the value $\sigma_{x_i}$, the more reliable the measurement $$\overline{x} = \sum_{i=1}^{N_V} \frac{x_i}{\sigma_{x_i}^2} \Bigg/ \sum_{i=1}^{N_V} \frac{1}{\sigma_{x_i}^2}$$

is the error-weighted arithmetic mean. The use of correlation as similarity metric emphasizes the importance of co-regulation in clustering rather than the amplitude of regulations.

The set of approximately 5,000 genes can be clustered based on their similarities measured over the group of 98 tumor samples. The similarity measure between two genes was defined in the same way as in Equation (1) except that now for each gene, there are 98 components of log ratio measurements.

The result of such a two-dimensional clustering is displayed in FIG. 3. Two distinctive patterns emerge from the clustering. The first pattern consists of a group of patients in the lower part of the plot whose regulations are very different from the sporadic pool. The other pattern is made of a group of patients in the upper part of the plot whose expressions are only moderately regulated in comparison with the sporadic pool. These dominant patterns suggest that the tumors can be unambiguously divided into two distinct types based on this set of ~5,000 significant genes.

To help understand these patterns, they were associated with estrogen-receptor (ER), proestrogen receptor (PR), tumor grade, presence of lymphocytic infiltrate, and angioinvasion (FIG. 3). The lower group in FIG. 3, which features the dominant pattern, consists of 36 patients. Of the 39 ER-negative patients, 34 patients are clustered together in this group. From FIG. 4, it was observed that the expression of estrogen receptor alpha gene ESR1 and a large group of co-regulated genes are consistent with this expression pattern.

From FIG. 3 and FIG. 4, it was concluded that gene expression patterns can be used to classify tumor samples into subgroups of diagnostic interest. Thus, genes co-regulated across 98 tumor samples contain information about the molecular basis of breast cancers. The combination of clinical data and microarray measured gene abundance of ESR1 demonstrates that the distinct types are related to, or at least are reported by, the ER status.

Example 2

Identification of Genetic Markers Distinguishing Estrogen Receptor (+) From Estrogen Receptor (−) Patients The results described in this Example allow the identification of expression marker genes that differentiate two major types of tumor cells: "ER-negative" group and "ER-positive" group. The differentiation of samples by ER(+) status was accomplished in three steps: (1) identification of a set of candidate marker genes that correlate with ER level; (2) rank-ordering these candidate genes by strength of correlation; (3) optimization of the number of marker genes; and (4) classifying samples based on these marker genes.

1. Selection of Candidate Discriminating Genes

In the first step, a set of candidate discriminating genes was identified based on gene expression data of training samples. Specifically, we calculated the correlation coefficients ρ between the category numbers or ER level and logarithmic expression ratio $\vec{r}$ across all the samples for each individual gene:

$$\rho = (\vec{c} \bullet \vec{r})/(\|\vec{c}\| \cdot \|\vec{r}\|) \qquad \text{Equation (2)}$$

The histogram of resultant correlation coefficients is shown in FIG. 5A as a gray line. While the amplitude of correlation or anti-correlation is small for the majority of genes, the amplitude for some genes is as great as 0.5. Genes whose expression ratios either correlate or anti-correlate well with the diagnostic category of interest are used as reporter genes for the category.

Genes having a correlation coefficient larger than 0.3 ("correlated genes") or less than −0.3 ("anti-correlated genes") were selected as reporter genes. The threshold of 0.3 was selected based on the correlation distribution for cases where there is no real correlation (one can use permutations to determine this distribution). Statistically, this distribution width depends upon the number of samples used in the correlation calculation. The distribution width for control cases (no real correlation) is approximately $1/\sqrt{n-3}$, where n=the number of samples. In our case, n=98. Therefore, a threshold of 0.3 roughly corresponds to 3−σ in the distribution (3×1/$\sqrt{n-3}$).

2,460 such genes were found to satisfy this criterion. In order to evaluate the significance of the correlation coefficient of each gene with the ER level, a bootstrap technique was used to generate Monte-Carlo data that randomize the association between gene expression data of the samples and their categories. The distribution of correlation coefficients obtained from one Monte-Carlo trial is shown as a dashed line in FIG. 5A. To estimate the significance of the 2,460 marker genes as a group, 10,000 Monte-Carlo runs were generated. The collection of 10,000 such Monte-Carlo trials forms the null hypothesis. The number of genes that satisfy the same criterion for Monte-Carlo data varies from run to run. The frequency distribution from 10,000 Monte-Carlo runs of the number of genes having correlation coefficients of >0.3 or <−0.3 is displayed in FIG. 5B. Both the mean and maximum value are much smaller than 2,460. Therefore, the significance of this gene group as the discriminating gene set between ER(+) and ER(−) samples is estimated to be greater than 99.99%.

2. Rank-Ordering of Candidate Discriminating Genes

In the second step, genes on the candidate list were rank-ordered based on the significance of each gene as a discriminating gene. The markers were rank-ordered either by amplitude of correlation, or by using a metric similar to a Fisher statistic:

$$t = (\langle x_1 \rangle - \langle x_2 \rangle) / \sqrt{[\sigma_1^2(n_1-1) + \sigma_2^2(n_2-1)]/(n_1+n_2-1)(1/n_1+1/n_2)} \qquad \text{Equation (3)}$$

In Equation (3), $\langle x_1 \rangle$ is the error-weighted average of log ratio within the ER(−), and $\langle x_2 \rangle$ is the error-weighted average of log ratio within the ER(+) group. $\sigma_1$ is the variance of log ratio within the ER(−) group and $n_1$ is the number of samples that had valid measurements of log ratios. $\sigma_2$ is the variance of log ratio within the ER(+) group and $n_2$ is the number of samples that had valid measurements of log ratios. The t-value in Equation (3) represents the variance-compensated difference between two means. The confidence level of each gene in the candidate list was estimated with respect to a null hypothesis derived from the actual data set using a bootstrap technique; that is, many artificial data sets were generated by randomizing the association between the clinical data and the gene expression data.

3. Optimization of the Number of Marker Genes

The leave-one-out method was used for cross validation in order to optimize the discriminating genes. For a set of marker genes from the rank-ordered candidate list, a classifier was trained with 97 samples, and was used to predict the status of the remaining sample. The procedure was repeated for each of the samples in the pool, and the number of cases where the prediction for the one left out is wrong or correct was counted.

The above performance evaluation from leave-one-out cross validation was repeated by successively adding more marker genes from the candidate list. The performance as a function of the number of marker genes is shown in FIG. 6. The error rates for type 1 and type 2 errors varied with the number of marker genes used, but were both minimal while the number of the marker genes is around 550. Therefore, we consider this set of 550 genes is considered the optimal set of marker genes that can be used to classify breast cancer tumors into "ER-negative" group and "ER-positive" group. FIG. 7 shows the classification of patients as ER(+) or ER(−) based on this 550 marker set. FIG. 8 shows the correlation of each tumor to the ER-negative template verse the correlation of each tumor to the ER-positive template.

4. Classification Based on Marker Genes

In the third step, a set of classifier parameters was calculated for each type of training data set based on either of the above ranking methods. A template for the ER(−) group ($\vec{z}_1$) was generated using the error-weighted log ratio average of the selected group of genes. Similarly, a template for ER(+) group (called $\vec{z}_2$) was generated using the error-weighted log ratio average of the selected group of genes. Two classifier parameters ($P_1$ and $P_2$) were defined based on either correlation or distance. $P_1$ measures the similarity between one sample $\vec{y}$ and the ER(−) template $\vec{z}_1$ over this selected group of genes. $P_2$ measures the similarity between one sample $\vec{y}$ and the ER(+) template $\vec{z}_2$ over this selected group of genes. The correlation $P_i$ is defined as:

$$P_i = (\vec{z}_i \bullet \vec{y})/(\|\vec{z}_i\| \cdot \|\vec{y}\|) \qquad \text{Equation (1)}$$

A "leave-one-out" method was used to cross-validate the classifier built based on the marker genes. In this method, one sample was reserved for cross validation each time the classifier was trained. For the set of 550 optimal marker genes, the classifier was trained with 97 of the 98 samples, and the status of the remaining sample was predicted. This procedure was performed with each of the 98 patients. The number of cases where the prediction was wrong or correct was counted. It was further determined that subsets of as few as ~50 of the 2,460 genes are able classify tumors as ER(+) or ER(−) nearly as well as using the total set.

In a small number of cases, there was disagreement between classification by the 550 marker set and a clinical classification. In comparing the microarray measured log ratio of expression for ESR1 to the clinical binary decision (negative or positive) of ER status for each patient, it was seen that the measured expression is consistent with the qualitative category of clinical measurements (mixture of two methods) for the majority of tumors. For example, two patients who were clinically diagnosed as ER(+) actually exhibited low expression of ESR1 from microarray measurements and were classified as ER negative by 550 marker genes. Additionally, 3 patients who were clinically diagnosed as ER(−) exhibited high expression of ESR1 from microarray measurements and were classified as ER(+) by the same 550 marker genes. Statistically, however, microarray measured gene expression of ESR1 correlates with the dominant pattern better than clinically determined ER status.

Example 3

Identification of Genetic Markers Distinguishing BRCA1 Tumors From Sporadic Tumors in Estrogen Receptor (−) Patients The BRCA1 mutation is one of the major clinical categories in breast cancer tumors. It was determined that of tumors of 38 patients in the ER(−) group, 17 exhibited the BRCA1 mutation, while 21 were sporadic tumors. A method was therefore developed that enabled the differentiation of the 17 BRCA1 mutation tumors from the 21 sporadic tumors in the ER(−) group.

1. Selection of Candidate Discriminating Genes

In the first step, a set of candidate genes was identified based on the gene expression patterns of these 38 samples. We first calculated the correlation between the BRCA1-mutation category number and the expression ratio across all 38 samples for each individual gene by Equation (2). The distribution of the correlation coefficients is shown as a histogram defined by the solid line in FIG. 9A. We observed that, while the majority of genes do not correlate with BRCA1 mutation status, a small group of genes correlated at significant levels. It is likely that genes with larger correlation coefficients would serve as reporters for discriminating tumors of BRCA1 mutation carriers from sporadic tumors within the ER(−) group.

In order to evaluate the significance of each correlation coefficient with respect to a null hypothesis that such correlation coefficient could be found by chance, a bootstrap technique was used to generate Monte-Carlo data that randomizes the association between gene expression data of the samples and their categories. 10,000 such Monte-Carlo runs were generated as a control in order to estimate the significance of the marker genes as a group. A threshold of 0.35 in the absolute amplitude of correlation coefficients (either correlation or anti-correlation) was applied both to the real data and the Monte-Carlo data. Following this method, 430 genes were found to satisfy this criterion for the experimental data. The p-value of the significance, as measured against the 10,000 Monte-Carlo trials, is approximately 0.0048 (FIG. 9B). That is, the probability that this set of 430 genes contained useful information about BRCA1-like tumors vs sporadic tumors exceeds 99%.

2. Rank-ordering of Candidate Discriminating Genes

In the second step, genes on the candidate list were rank-ordered based on the significance of each gene as a discriminating gene. Here, we used the absolute amplitude of correlation coefficients to rank order the marker genes.

3 Optimization of Discriminating Genes

In the third step, a subset of genes from the top of this rank-ordered list was used for classification. We defined a BRCA1 group template (called $\vec{z}_1$) by using the error-weighted log ratio average of the selected group of genes. Similarly, we defined a non-BRCA1 group template (called $\vec{z}_2$) by using the error-weighted log ratio average of the selected group of genes. Two classifier parameters (P1 and P2) were defined based on either correlation or distance. P1 measures the similarity between one sample $\vec{y}$ and the BRCA1 template $\vec{z}_1$ over this selected group of genes. P2 measures the similarity between one sample $\vec{y}$ and the non-BRCA1 template $\vec{z}_2$ over this selected group of genes. For correlation, P1 and P2 were defined in the same way as in Equation (4).

The leave-one-out method was used for cross validation in order to optimize the discriminating genes as described in Example 2. For a set of marker genes from the rank-ordered candidate list, the classifier was trained with 37 samples the remaining one was predicted. The procedure was repeated for all the samples in the pool, and the number of cases where the prediction for the one left out is wrong or correct was counted.

To determine the number of markers constituting a viable subset, the above performance evaluation from leave-one-out cross validation was repeated by cumulatively adding more marker genes from the candidate list. The performance as a function of the number of marker genes is shown in FIG. 10. The error rates for type 1 (false negative) and type 2 (false positive) errors (Bendat & Piersol, RANDOM DATA ANALYSIS AND MEASUREMENT PROCEDURES, 2D ED., Wiley Interscience, p. 89) reached optimal ranges when the number of the marker genes is approximately 100. Therefore, a set of about 100 genes is considered to be the optimal set of marker genes that can be used to classify tumors in the ER(−) group as either BRCA1-related tumors or sporadic tumors.

The classification results using the optimal 100 genes are shown in FIGS. 11A and 11B. As shown in FIG. 11A, the co-regulation patterns of the sporadic patients differ from those of the BRCA1 patients primarily in the amplitude of regulation. Only one sporadic tumor was classified into the BRCA1 group. Patients in the sporadic group are not necessarily BRCA1 mutation negative; however, it is estimated that only approximately 5% of sporadic tumors are indeed BRCA1-mutation carriers.

Example 4

Identification of Genetic Markers Distinguishing Sporadic Tumor Patients with >5 Year Versus <5 Year Survival Times 78 tumors from sporadic breast cancer patients were used to explore prognostic predictors from gene expression data. Of the 78 samples in this sporadic breast cancer group, 44 samples were known clinically to have had no distant metastases within 5 years since the initial diagnosis ("no distant metastases group") and 34 samples had distant metastases within 5 years since the initial diagnosis ("distant metastases group"). A group of 231 markers, and optimally a group of 70 markers, was identified that allowed differentiation between these two groups.

1. Selection of Candidate Discriminating Genes

In the first step, a set of candidate discriminating genes was identified based on gene expression data of these 78 samples. The correlation between the prognostic category number (distant metastases vs no distant metastases) and the logarithmic expression ratio across all samples for each individual gene was calculated using Equation (2). The distribution of the correlation coefficients is shown as a solid line in FIG. 12A. FIG. 12A also shows the result of one Monte-Carlo run as a dashed line. We observe that even though the majority of genes do not correlate with the prognostic categories, a small group of genes do correlate. It is likely that genes with larger correlation coefficients would be more useful as reporters for the prognosis of interest—distant metastases group and no distant metastases group.

In order to evaluate the significance of each correlation coefficient with respect to a null hypothesis that such correlation coefficient can be found by chance, we used a bootstrap technique to generate data from 10,000 Monte-Carlo runs as a control (FIG. 12B). We then selected genes that either have the correlation coefficient larger than 0.3 ("correlated genes") or less than −0.3 ("anti-correlated genes"). The same selection criterion was applied both to the real data and the Monte-Carlo data. Using this comparison, 231 markers from the experimental data were identified that satisfy this criterion. The probability of this gene set for discriminating patients between the distant metastases group and the no distant metastases group being chosen by random fluctuation is approximately 0.003.

2. Rank-Ordering of Candidate Discriminating Genes

In the second step, genes on the candidate list were rank-ordered based on the significance of each gene as a discriminating gene. Specifically, a metric similar to a "Fisher" statistic, defined in Equation (3), was used for the purpose of rank ordering. The confidence level of each gene in the candidate list was estimated with respect to a null hypothesis derived from the actual data set using the bootstrap technique. Genes in the candidate list can also be ranked by the amplitude of correlation coefficients.

3. Optimization of Discriminating Genes

In the third step, a subset of 5 genes from the top of this rank-ordered list was selected to use as discriminating genes to classify 78 tumors into a "distant metastases group" or a "no distant metastases group". The leave-one-out method was used for cross validation. Specifically, 77 samples defined a classifier based on the set of selected discriminating genes, and these were used to predict the remaining sample. This procedure was repeated so that each of the 78 samples was predicted. The number of cases in which predictions were correct or incorrect were counted. The performance of the classifier was measured by the error rates of type 1 and type 2 for this selected gene set.

We repeated the above performance evaluation procedure, adding 5 more marker genes each time from the top of the candidate list, until all 231 genes were used. As shown in FIG. 13, the number of mis-predictions of type 1 and type 2 errors changes dramatically with the number of marker genes employed. The combined error rate reached a minimum when 70 marker genes from the top of our candidate list were used. Therefore, this set of 70 genes is the optimal, preferred set of marker genes useful for the classification of sporadic tumor patients into either the distant metastases or no distant metastases group. Fewer or more markers also act as predictors, but are less efficient, either because of higher error rates, or the introduction of statistical noise.

4. Reoccurrence Probability Curves

The prognostic classification of 78 patients with sporadic breast cancer tumors into two distinct subgroups was predicted based on their expression of the 70 optimal marker genes (FIGS. 14 and 15).

Figure 19B:
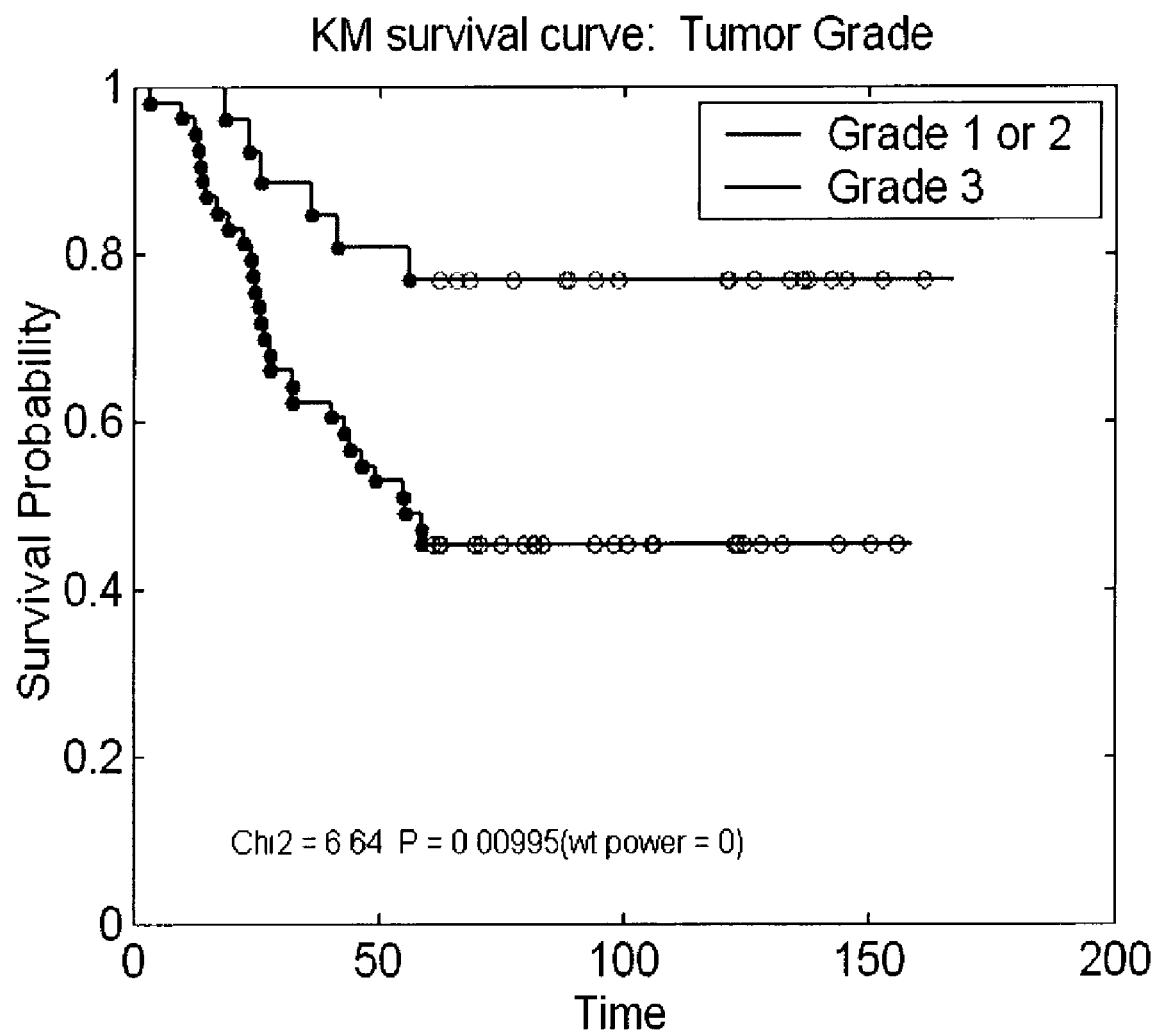

To evaluate the prognostic classification of sporadic patients, we predicted the outcome of each patient by a classifier trained by the remaining 77 patients based on the 70 optimal marker genes. FIG. 16 plots the distant metastases probability as a function of the time since initial diagnosis for the two predicted groups. The difference between these two reoccurrence curves is significant. Using the $\chi^2$ test (S-PLUS 2000 Guide to Statistics, vol.2, MathSoft, p. 44), the p-value is estimated to be $\sim 10^{-9}$. The distant metastases probability as a function of the time since initial diagnosis was also compared between ER(+) and ER(−) individuals (FIG. 17), PR(+) and PR(−) individuals (FIG. 18), and between individuals with different tumor grades (FIGS. 19A, 19B). In comparison, the p-values for the differences between two prognostic groups based on clinical data are much less significant than that based on gene expression data, ranging from $10^{-3}$ to 1.

To parameterize the reoccurrence probability as a function of time since initial diagnosis, the curve was fitted to one type of survival model—"normal":

$$P=\alpha\exp(-t^2/\tau^2) \qquad (4)$$

For fixed $\alpha=1$, we found that $\tau=125$ months for patients in the no distant metastases group and $\tau=36$ months for patients in the distant metastases group. Using tumor grades, we found $\tau=100$ months for patients with tumor grades 1 and 2 and $\tau=60$ for patients with tumor grade 3. It is accepted clinical practice that tumor grades are the best available prognostic predictor. However, the difference between the two prognostic groups classified based on 70 marker genes is much more significant than those classified by the best available clinical information.

5. Prognostic Prediction for 19 Independent Sporadic Tumors

To confirm the proposed prognostic classification method and to ensure the reproducibility, robustness, and predicting power of the 70 optimal prognostic marker genes, we applied the same classifier to 19 independent tumor samples from sporadic breast cancer patients, prepared separately at The Netherlands Cancer Institute (NKI). The same reference pool was used.

The classification results of 19 independent sporadic tumors are shown in FIG. 20. FIG. 20A shows the log ratio of expression regulation of the same 70 optimum marker genes. Based on our classifier model, we expected the misclassification of 19*(6+7)/78=3.2 tumors. Consistently, (1+3)=4 of 19 tumors were misclassified.

6. Clinical Parameters as a Group vs. Microarray Data—Results of Logistic Regression In the previous section, the predictive power of each individual clinical parameter was compared with that of the expression data. However, it is more meaningful to combine all the clinical parameters as a group, and then compare them to the expression data. This requires multi-variant modeling; the method chosen was logistic regression. Such an approach also demonstrates how much improvement the microarray approach adds to the results of the clinical data.

The clinical parameters used for the multi-variant modeling were: (1) tumor grade; (2) ER status; (3) presence or absence of the progestogen receptor (PR); (4) tumor size; (5) patient age; and (6) presence or absence of angioinvasion. For the microarray data, two correlation coefficients were used. One is the correlation to the mean of the good prognosis group (C1) and the other is the correlation to the mean of the bad prognosis group (C2). When calculating the correlation coefficients for a given patient, this patient is excluded from either of the two means.

The logistic regression optimizes the coefficient of each input parameter to best predict the outcome of each patient. One way to judge the predictive power of each input parameter is by how much deviance (similar to Chi-square in the linear regression, see for example, Hasomer & Lemeshow, APPLIED LOGISTIC REGRESSION, John Wiley & Sons, (2000)) the parameter accounts for. The best predictor should account for most of the deviance. To fairly assess the predictive power, each parameter was modeled independently. The microarray parameters explain most of the deviance, and hence are powerful predictors.

The clinical parameters, and the two microarray parameters, were then monitored as a group. The total deviance explained by the six clinical parameters was 31.5, and total deviance explained by the microarray parameters was 39.4. However, when the clinical data was modeled first, and the two microarray parameters added, the final deviance accounted for is 57.0.

The logistic regression computes the likelihood that a patient belongs to the good or poor prognostic group. FIGS. 21A and 21B show the sensitivity vs. (1-specificity). The plots were generated by varying the threshold on the model predicted likelihood. The curve which goes through the top left corner is the best (high sensitivity with high specificity). The microarray outperformed the clinical data by a large margin. For example, at a fixed sensitivity of around 80%, the specificity was ~80% from the microarray data, and ~65% from the clinical data for the good prognosis group. For the poor prognosis group, the corresponding specificities were ~80% and ~70%, again at a fixed sensitivity of 80%. Combining the microarray data with the clinical data further improved the results. The result can also be displayed as the total error rate as the function of the threshold in FIG. 21C. At all possible thresholds, the error rate from the microarray was always smaller than that from the clinical data. By adding the microarray data to the clinical data, the error rate is further reduced, as one can see in FIG. 21C.

Odds ratio tables can be created from the prediction of the logistic regression. The probability of a patient being in the good prognosis group is calculated by the logistic regression based on different combinations of input parameters (clinical and/or microarray). Patients are divided into the following four groups according to the prediction and the true outcome: (1) predicted good and truly good, (2) predicted good but truly poor, (3) predicted poor but truly good, (4) predicted poor and truly poor. Groups (1) & (4) represent correct predictions, while groups (2) & (3) represent mis-predictions. The division for the prediction is set at probability of 50%, although other thresholds can be used. The results are listed in Table 7. It is clear from Table 7 that microarray profiling (Table 7.3 & 7.10) outperforms any single clinical data (Table 7.4-7.9) and the combination of the clinical data (Table 7.2). Adding the micro-array profiling in addition to the clinical data give the best results (Table 7.1).

For microarray profiling, one can also make a similar table (Table 7.11) without using logistic regression. In this case, the prediction was simply based on C1-C2 (greater than 0 means good prognosis, less than 0 mean bad prognosis).

TABLE 7.1

| | Prediction by clinical + microarray | |
|---|---|---|
| | Predicted good | Predicted poor |
| true good | 39 | 5 |
| true poor | 4 | 30 |

TABLE 7.2

Prediction by clinical alone

|  | Predicted good | Predicted poor |
|---|---|---|
| true good | 34 | 10 |
| true poor | 12 | 22 |

TABLE 7.3

Prediction by microarray

|  | predicted good | Predicted poor |
|---|---|---|
| true good | 39 | 5 |
| true poor | 10 | 24 |

TABLE 7.4

Prediction by grade

|  | Predicted good | Predicted poor |
|---|---|---|
| true good | 23 | 21 |
| true poor | 5 | 29 |

TABLE 7.5

Prediction by ER

|  | Predicted good | Predicted poor |
|---|---|---|
| true good | 35 | 9 |
| true poor | 21 | 13 |

TABLE 7.6

Prediction by PR

|  | Predicted good | Predicted poor |
|---|---|---|
| true good | 35 | 9 |
| true poor | 18 | 16 |

TABLE 7.2

Prediction by size

|  | Predicted good | Predicted poor |
|---|---|---|
| true good | 35 | 9 |
| true poor | 13 | 21 |

TABLE 7.8

Prediction by age

|  | Predicted good | Predicted poor |
|---|---|---|
| true good | 33 | 11 |
| true poor | 15 | 19 |

TABLE 7.9

Prediction by angioinvasion

|  | Predicted good | Predicted poor |
|---|---|---|
| true good | 37 | 7 |
| true poor | 19 | 15 |

TABLE 7.10

Prediction by dC (C1-C2)

|  | Predicted good | Predicted poor |
|---|---|---|
| true good | 36 | 8 |
| true poor | 6 | 28 |

TABLE 7.11

No logistic regression, simply judged by C1-C2

|  | Predicted good | Predicted poor |
|---|---|---|
| true good | 37 | 7 |
| true poor | 6 | 28 |

Example 5

Concept of Mini-array for Diagnosis Purposes.

All genes on the marker gene list for the purpose of diagnosis and prognosis can be synthesized on a small-scale microarray using ink-jet technology. A microarray with genes for diagnosis and prognosis can respectively or collectively be made. Each gene on the list is represented by single or multiple oligonucleotide probes, depending on its sequence uniqueness across the genome. This custom designed mini-array, in combination with sample preparation protocol, can be used as a diagnostic/prognostic kit in clinics.

Example 6

Biological Significance of Diagnostic Marker Genes

The public domain was searched for the available functional annotations for the 430 marker genes for BRCA1 diagnosis in Table 3. The 430 diagnostic genes in Table 3 can be divided into two groups: (1) 196 genes whose expressions are highly expressed in BRCA1-like group; and (2) 234 genes whose expression are highly expressed sporadic group. Of the 196 BRCA1 group genes, 94 are annotated. Of the 234 sporadic group genes, 100 are annotated. The terms "T-cell", "B-cell" or "immunoglobulin" are involved in 13 of the 94 annotated genes, and in 1 of the 100 annotated genes, respectively. Of 24,479 genes represented on the microarrays, there are 7,586 genes with annotations to date. "T-cell", "B-cell" and "immunoglobulin" are found in 207 of these 7,586 genes. Given this, the p-value of the 13 "T-cell", "B-cell" or "immunoglobulin" genes in the BRCA1 group is very significant (p-value=$1.1 \times 10-6$). In comparison, the observation of 1 gene relating to "T-cell", "B-cell", or "immunoglobulin" in the sporadic group is not significant (p-value=0.18).

The observation that BRCA1 patients have highly expressed lymphocyte (T-cell and B-cell) genes agrees with what has been seen from pathology that BRCA1 breast tumor has more frequently associated with high lymphocytic infiltration than sporadic cases (Chappuis et al., 2000, *Semin Surg Oncol* 18:287-295).

Example 7

Biological Significance of Prognosis Marker Genes

A search was performed for available functional annotations for the 231 prognosis marker genes (Table 5). The markers fall into two groups: (1) 156 markers whose expressions are highly expressed in poor prognostic group; and (2) 75 genes whose expression are highly expressed in good prognostic group. Of the 156 markers, 72 genes are annotated; of the 75 genes, 28 genes are annotated.

Twelve of the 72 markers, but none of the 28 markers, are, or are associated with, kinases. In contrast, of the 7,586 genes on the microarray having annotations to date, only 471 involve kinases. On this basis, the p-value that twelve kinase-related markers in the poor prognostic group is significant (p-value=0.001). Kinases are important regulators of intracellular signal transduction pathways mediating cell proliferation, differentiation and apoptosis. Their activity is normally tightly controlled and regulated. Overexpression of certain kinases is well known involving in oncogenesis, such as vascular endothelial growth factor receptor1 (VEGFR1 or FLT1), a tyrosine kinase in the poor prognosis group, which plays a very important role in tumor angiogenesis. Interestingly, vascular endothelial growth factor (VEGF), VEGFR's ligand, is also found in the prognosis group, which means both ligand and receptor are upregulated in poor prognostic individuals by an unknown mechanism.

Likewise, 16 of the 72 markers, and only two of the 28 markers, are, or are associated with, ATP-binding or GTP-binding proteins. In contrast, of the 7,586 genes on the microarray having annotations to date, only 714 and 153 involve ATP-binding and GTP-binding, respectively. On this basis, the p-value that 16 GTP- or ATP-binding-related markers in the poor prognosis group is significant (p-value 0.001 and 0.0038). Thus, the kinase- and ATP- or GTP-binding-related markers within the 72 markers can be used as prognostic indicators.

Cancer is characterized by deregulated cell proliferation. On the simplest level, this requires division of the cell or mitosis. By keyword searching, we found "cell division" or "mitosis" included in the annotations of 7 genes respectively in the 72 annotated markers from the 156 poor prognosis markers, but in none for the 28 annotated genes from 75 good prognosis markers. Of the 7,586 microarray markers with annotations, "cell division" is found in 62 annotations and "mitosis" is found in 37 annotations. Based on these findings, the p-value that seven cell division- or mitosis-related markers are found in the poor prognosis group is estimated to be highly significant (p-value=$3.5 \times 10^{-5}$). In comparison, the absence of cell division- or mitosis-related markers in the good prognosis group is not significant (p-value=0.69). Thus, the seven cell division- or mitosis-related markers may be used as markers for poor prognosis.

Example 8

Construction of an Artificial Reference Pool

The reference pool for expression profiling in the above Examples was made by using equal amount of cRNAs from each individual patient in the sporadic group. In order to have a reliable, easy-to-made, and large amount of reference pool, a reference pool for breast cancer diagnosis and prognosis can be constructed using synthetic nucleic acid representing, or derived from, each marker gene. Expression of marker genes for individual patient sample is monitored only against the reference pool, not a pool derived from other patients.

To make the reference pool, 60-mer oligonucleotides are synthesized according to 60-mer ink-jet array probe sequence for each diagnostic/prognostic reporter genes, then double-stranded and cloned into pBluescript SK– vector (Stratagene, La Jolla, Calif.), adjacent to the T7 promoter sequence. Individual clones are isolated, and the sequences of their inserts are verified by DNA sequencing. To generate synthetic RNAs, clones are linearized with EcoRI and a T7 in vitro transcription (IVT) reaction is performed according to the MegaScript kit (Ambion, Austin, Tex.). IVT is followed by DNase treatment of the product. Synthetic RNAs are purified on RNeasy columns (Qiagen, Valencia, Calif.). These synthetic RNAs are transcribed, amplified, labeled, and mixed together to make the reference pool. The abundance of those synthetic RNAs are adjusted to approximate the abundance of the corresponding marker-derived transcripts in the real tumor pool.

Example 9

Use of Single-channel Data and a Sample Pool Represented by Stored Values

1. Creation of a Reference Pool of Stored Values ("Mathematical Sample Pool")

The use of ratio-based data used in Examples 1-7, above, requires a physical reference sample. In the above Examples, a pool of sporadic tumor sample was used as the reference. Use of such a reference, while enabling robust prognostic and diagnostic predictions, can be problematic because the pool is typically a limited resource. A classifier method was therefore developed that does not require a physical sample pool, making application of this predictive and diagnostic technique much simpler in clinical applications.

To test whether single-channel data could be used, the following procedure was developed. First, the single channel intensity data for the 70 optimal genes, described in Example 4, from the 78 sporadic training samples, described in the Materials and Methods, was selected from the sporadic sample vs. tumor pool hybridization data. The 78 samples consisted of 44 samples from patients having a good prognosis and 34 samples from patients having a poor prognosis. Next, the hybridization intensities for these samples were normalized by dividing by the median intensity of all the biological spots on the same microarray. Where multiple microarrays per sample were used, the average was taken across all of the microarrays. A log transform was performed on the intensity data for each of the 70 genes, or for the average intensity for each of the 70 genes where more than one microarray is hybridized, and a mean log intensity for each gene across the 78 sporadic samples was calculated. For each sample, the mean log intensities thus calculated were subtracted from the individual sample log intensity. This figure, the mean subtracted log(intensity) was then treated as the two color log(ratio) for the classifier by substitution into Equation (5). For new samples, the mean log intensity is subtracted in the same manner as noted above, and a mean subtracted log(intensity) calculated.

The creation of a set of mean log intensities for each gene hybridized creates a "mathematical sample pool" that replaces the quantity-limited "material sample pool." This mathematical sample pool can then be applied to any sample, including samples in hand and ones to be collected in the future. This "mathematical sample pool" can be updated as more samples become available.

2. Results

To demonstrate that the mathematical sample pool performs a function equivalent to the sample reference pool, the mean-subtracted-log(intensity) (single channel data, relative to the mathematical pool) vs. the log(ratio) (hybridizations, relative to the sample pool) was plotted for the 70 optimal reporter genes across the 78 sporadic samples, as shown in FIG. 22. The ratio and single-channel quantities are highly correlated, indicating both have the capability to report relative changes in gene expression. A classifier was then constructed using the mean-subtracted-log(intensity) following exactly the same procedure as was followed using the ratio data, as in Example 4.

As shown in FIGS. 23A and 23B, single-channel data was successful at classifying samples based on gene expression patterns. FIG. 23A shows samples grouped according to prognosis using single-channel hybridization data. The white line separates samples from patients classified as having poor prognoses (below) and good prognoses (above). FIG. 23B plots each sample as its expression data correlates with the good (open circles) or poor (filled squares) prognosis classifier parameter. Using the "leave-one-out" cross validation method, the classifier predicted 10 false positives out of 44 samples from patients having a good prognosis, and 6 false negatives out of 34 samples from patients having a poor prognosis, where a poor prognosis is considered a "positive." This outcome is comparable to the use of the ratio-based classifier, which predicted 7 out of 44, and 6 out of 34, respectively.

In clinical applications, it is greatly preferable to have few false positives, which results in fewer under-treated patients. To conform the results to this preference, a classifier was constructed by ranking the patient sample according to its coefficient of correlation to the "good prognosis" template, and chose a threshold for this correlation coefficient to allow approximately 10% false negatives, i.e., classification of a sample from a patient with poor prognosis as one from a patient with a good prognosis. Out of the 34 poor prognosis samples used herein, this represents a tolerance of 3 out of 34 poor prognosis patients classified incorrectly. This tolerance limit corresponds to a threshold 0.2727 coefficient of correlation to the "good prognosis" template. Results using this threshold are shown in FIGS. 24A and 24B. FIG. 24A shows single-channel hybridization data for samples ranked according to the coefficients of correlation with the good prognosis classifier; samples classified as "good prognosis" lie above the white line, and those classified as "poor prognosis" lie below. FIG. 24B shows a scatterplot of sample correlation coefficients, with three incorrectly classified samples lying to the right of the threshold correlation coefficient value. Using this threshold, the classifier had a false positive rate of 15 out of the 44 good prognosis samples. This result is not very different compared to the error rate of 12 out of 44 for the ratio based classifier.

In summary, the 70 reporter genes carry robust information about prognosis; the single channel data can predict the tumor outcome almost as well as the ratio based data, while being more convenient in a clinical setting.

7. REFERENCES CITED

All references cited herein are incorporated herein by reference in their entirety and for all purposes to the same extent as if each individual publication or patent or patent application was specifically and individually indicated to be incorporated by reference in its entirety for all purposes.

Many modifications and variations of the present invention can be made without departing from its spirit and scope, as will be apparent to those skilled in the art. The specific embodiments described herein are offered by way of example only, and the invention is to be limited only by the terms of the appended claims along with the full scope of equivalents to which such claims are entitled.

SEQUENCE LISTING (2699 sequences)

SEQ ID NO: 1 - DNA, 443 bp, Homo sapiens
  ref <308>: DATABASE ACCESSION NUMBER: AA555029
  ref <309>: DATABASE ENTRY DATE: 2001-06-18
tttttttttttttttccattaacccaacacaagtttatttactaagtcaagtcaaactgaggagtatttgtttctttggtagttggtagacaaagaatacatatacatattctatttcccattaagcattcgatcatgttacaaaacaatggcctagagaactatcattgaagatttaccaaatctgcctgaagcaaaatgtgataaactgcagaaatggtggagaatgacactggaagtcataaagttgattctcaaacacgggtttgaactgcataggaccgcttatatgcatattttgataaatatattgaaaatttttttggaaatttgcaacaatttaaaaaacttgcagatgcaccatgtagcttagaaatactgaaaaactaagaaaaaggtgtgtcatgaattcatataatatatgtagacactagtctatttta

SEQ ID NO: 2 - DNA, 3993 bp, Homo sapiens
  ref <308>: DATABASE ACCESSION NUMBER: AB000509
  ref <309>: DATABASE ENTRY DATE: 2001-06-18
gcagcagccgcgcctgcagaccggcctcgcggagcccgcgcgccgagccccacaatggcttattcagaagagcataaaggtatgccctgtggtttcatccgccagaattccggcaactccatttccttggactttgagcccagtatagagtaccagtttgtggagcggttggaagagcgctacaaatgtgccttctgccactcggtgcttcacaacccccaccagacaggatgtgggcaccgcttctgccagcactgcatcctgtccctgagagaattaaacacagtgccaatctgccctgtagataaagaggtcatcaaatctcaggaggtttttaaagacaattgttgcaaaagagaagtcctcaacttatatgtatattgcagcaatgctcctggatgtaatgccaaggttattctgggccggtaccaggatcaccttcagcagtgcttatttcaacctgtgcagtgttctaatgagaagtgccgggagccagtcctacggaaagacctgaaagagcatttgagtgcatcctgtcagtttcgaaaggaaaaatgcctttattgcaaaaaggatgtggtagtcatcaatctacagaatcatgaggaaaacttgtgtcctgaatacccagtattttgtcccaacaattgtgcgaagattattctaaaaactgaggtagatgaacacctggctgtatgtcctgaagctgagcaagactgtccttttaagcactatggctgtgctgtaacggataaacggaggaacctgcagcaacatgagcattcagccttacgggagcacatgcgtttggttttagaaaagaatgtccaattagaagaacagatttctgacttacacaagagcctagaacagaaagaaagtaaaatccagcagctagcagaaactataaagaaacttgaaaaggagttcaagcagtttgcacagttgtttggcaaaaatggaagcttcctcccaaacatccaggtttttgccagtcacattgacaagtcagcttggctagaagctcaagtgcatcaattattacaaatggttaaccagcaacaaaataaatttgacctgagacctttgatggaagcagttgatacagtgaaacagaaaattaccctgctagaaaacaatgatcaaagattagccgttttagaagaggaaactaacaaacatgatacccacattaatattcataaagcacagctgagtaaaaatgaagagcgatttaaactgctggagggtacttgctataatggaaagctcatttggaaggtgacagattacaagatgaagaagagagaggcggtggatgggcacacagtgtccatcttcagccagtccttctacaccagccgctgtggctaccggctctgtgctagagcatacctgaatggggatgggtcagggagggggtcacacctgtccctatactttgtggtcatgcgaggagagtttgactcactgttgcagtggccattcaggcagagggtgaccctgatgcttctggaccagagtggcaaaaagaacattatggagaccttcaaacctgaccccaatagcagcagctttaaaagacctgatggggagatgaacattgcatctggctgtccccgctttgtggctcattctgttttggagaatgccaagaacgcctacattaaagatgacactctgttcttgaaagtggccgtggacttaactgacctggaggatctctagtcactgttatggggtgataagaggacttcttggggccagaactgtggaggagagcacatttgattatcatattgacctggatttagactcaaagcacatttgtatttgcctttttccttaacgtttgaagtcagtttaaaacttctgaagtgctgtctttttacattttactctgtcccagtttgaaacttaaaactcttagaatattctcttattatttatatttttatatttcttgaaagatggtaagtttcttgaagtttttggggcgtttctcttttactggtgcttagcgcagtgtctcgggcactctaaatattgagtgttatggaggacacagaggtagcagaatcccagttgaaaatgttttgatattttattgtttggcctattgattctagacctggccttaagtctgcaaaagccatctttataaggtaggctgttccagttaagaagtgggtgatgtagttacaaagataatatgctcagtttggacctttttttcagttaaatgctaaatatatgaaaattactatacctctaagtattttcatgaaattcaccagcagtttgcaagcacagttttgcaaggctgcataagaactggtgaatggggtaagcattttcattcttcctgctgaagtaaagcagaaagtactgcatagtatatgagatatagccagctagctaaagttcagattttgttaggttcaaccctatgaaaaaaactattttcataggtcaaaaatggtaaaaaattagcagtttcataagattcaaccaaataaatatatatatacacacacacatacatatacacctatatatgtgtgtatacaaacagttcgaatgtattttggtgacagtaataaatcaatgtgaggatggatagaatttagtatatgatagagaaaatgtcataaatggataaaaggaatttacaacttgaggagaaaacctttacaatttcctatgggtgtcagaagtactctcagcgaaaactgatggctaaaacagtatctactattctctgataactttttttttgagacagagtttcattgtcacccaggctggagtacagtggcatgatctcagctcactgcaaactctgcctcccgaattcaagtgattctcctgcctcagcctcctgagtagctgggattacaggcgcccgtcaccacacccaggtaatttttgtatttttagtagagacggagttttgccatgttggccaagctgatctcaaactcctgacctcaagtgatctgcccgcctcggcctcccaaagtgctgagattacaggcatgacccaccgcgtcaagcctctgacaactattgaatttgtaagctgctatgcaaatgggcatttatataaacttgtgatgtttcttgtcagaattctgagtactctgtgaagaacagaaatgatcatattcttatgcatctatctgtatgggtctgaaggtgtatatacaaactgagatgagtccttatgactcttgataagcctgagtttaacaacaacaaaaatgccaagttgtcctgagcccttctgcgttgttatgccacttccctactgctcatatgcacgctggctcccctgggcacgcaaggatgagtatgggccatgggcccctgtagagctgcttacctggtgatgaccatgcaccttacaatttctgaacagttaaccctatagaagcatgctttatatgagtgtcttctgggaagaggaaccttcttaatctcttctgtgggattttcaaaatgctaaagactcacactgcagcaatcatcccagatgattaaattcaaagaaataggttcacaacaggaatatactgaagaactagagtgtcactgctggtgaactgtggcacggttgctcaacacatcacctcggacaaattcaggaagcatttctttagcccacaagtccagacccaggtgctctgtatgtttgtttttaatattcatcatatccaagttcactctgtcttcctgagcagtggaagatcatattgctgtaacttcttttaagtagttgatgtggaaaacattttaaagtgaatttgtcaaaatgctggttttgtgttttatccaacttttgtgcatatatataaagtatgtcatggcatggtttgcttaggagttcagagttccttcatcatcgaaatagtgattaagtgatcccagaacaaggaatactagagtaaaaagcacctctttttcagaaaaaaaaaaaaaaaaaaaaaaaaa

SEQ ID NO: 3 - DNA, 2358 bp, Homo sapiens
  Modified_base 1 ... 2358: n = a,c,g, or t
  ref <308>: DATABASE ACCESSION NUMBER: AB001451
  ref <309>: DATABASE ENTRY DATE: 2001-06-18
attcggggcagcaacgcgcagaaggtggtgggcgcctcgggctcggggggcgcgggcccccaacccgatccggcgggcccggggggcgtcccggcgctggcggccgccgtcctgggcgcctgcgagccccgctgcgccgcgccctgtcccctgcccgcgctcagccgctgtcggggcgcggggtcgcgggggtcgcggggcgggcggggggcggcggggtccggggacgccgccgccgccgccgagtggatccggaagggcagcttcatccacaaacccgcgcacggctggctacaccccgacgccagggtcctggggcccggggtctcctacgtcgtgcggtacatgggctgcatcgaggttctccgctctatgcgctccctggactttaacacgcgcacgcaggtgaccagggaagccatcaaccggctccatgaggccgtgcctggcgtccggggatcctggaagaaaaaggcccccaacaaggccctggcgtccgtcctgggcaagagcaaccttcgctttgccggcatgagcatctccatccacatctccactgatggcctcagcctctccgtgcctgccacgcgccaggtcatcgccaaccaccacatgccgtccatctccttcgcgtcaggcggagacacggacatgacggattacgtggcctacgtcgccaaggaccccatcaaccagagagcctgccacatcctggagtgctgtgagggcctggcacagagcatcatcagcaccgtgggccaagctttcgagctacgcttcaagcagtacctgcacagcccgcccaaggtggcgctgcccccagaaaggctggcagggccggaggagtcggcctggggggacgaggaggactctttggagcacaattactacaacagcatcccggggaaggagccgccgctgggcgggctagtggactccaggctggccctgacacagccctgcgccctcacggccctcgaccagggcccatctccttctctaagagatgcctgcagcctgccatgggacgtggggtccaccggtacagctccaccgggggacggctacgtgcaagcggacgcccggggccccccggaccacgaggagcacctgtatgtcaacacccagggtctggacgcccccgagccggaggacagccccaaaaaggatctgtttgacatgcgaccctttgaggatgccctgaagttgcatgagtgctcagtggcggcaggcgtgacagcagcccctcttcccttggaggaccagtggcccagcccccctacccgccgggcccctgtggcccccacggaggaacagctgcgtcaggagccctggtaccacggccggatgagccgccgggcggcagagaggatgcttcgagctgacggggacttccttgtgcgagacagcgtcaccaaccccgggcagtatgtcctcaccggcatgcacgccgggcagcccaagcacctgctgctcgtggaccccgagggcgtggtacggacgaaggacgtgctgtttgagagcatcagccacctgatcgaccaccacctgcagaacgggcagcccatcgtggccgccgagagtgagctgcacctgcgtggcgtggtctcacgggagccctgagccaggtgaccgttctcagccctggctcctgcctgttctcagccccagctcctgcctgtcatggccttggggctctcagccctcctcctggatcctggtcaggccgaaccaccgctgcctctccttcctccgcatgagcctctggcatggtccttcctccagctggccccgggctgggcagagcctcctcctgccggggcccctgcccaccccctcctttgcctggagtgagggtgttcataccaaagacggaaccatttcgcctttaaagaaaatatatccagaagcagccgctgcctcggagccctggcccgtgggtccccctctcgcctggctggttcggtctaacgccccggagagtcagagctcccaggaccctggggaggaggcggattccgggcctggctgggcttcctcttcccacctgaggactgggtgcacagttgtctttgaggggggacgcttaaggtgctttggggttctcaggccaggatacatgctggcgctgaagtgcaggcagccttgaggtcacctgggatctcggggtanccaggctgctccaagacagtggatatcgaggcagtcgtgaggcccctactccacctgggagcaggggaaggacgtggttgcctggcctgggctgcgcccagcagcttccccccaatcctgccctcccagctgtcgacccagatgggatgttcggatcggtttgtaattaaacctgggaatggccac

SEQ ID NO: 4 - DNA, 6629 bp, Homo sapiens
  ref <308>: DATABASE ACCESSION NUMBER: AB002301
  ref <309>: DATABASE ENTRY DATE: 2001-06-18
tggaatttgatccggaagaattttactacctattggaagcagcagaaggccatgccaaagaaggacagggtattaaaaccgacattcccaggtacatcattagccaactgggactcaataaggatcccttggaagaaatggctcatttgggaaactacgatagtgggacagcagaaacaccagaaacagatgaatcagtgagtagctctaatgcctccctgaaacttcgaaggaaacctcgggaaagtgattttgaaacgattaaattgattagcaatggagcctatggggcagtctactttgttcggcataaagaatcccggcagaggtttgccatgaagaagattaataaacagaacctcatccttcgaaaccagatccagcaggcctttgtggagcgggatatcctgacttttgcagaaaacccctttgttgtcagcatgtattgctcctttgaaacaaggcgccacttgtgcatggtcatggaatatgtggaagggggagactgtgctactttaatgaaaaacatgggtcctctccctgttgatatggccagaatgtactttgctgagacggtcttggccttggaatatttacataattatggaattgtacacagggatttgaaaccagacaacttgttggttacctccatggggcacataaagctgacagattttggattatctaaggtgggactaatgagcatgactaccaacctttacgagggtcatattgagaaggatgctagagagttcctggataaacaggtctgtggcacacctgaatacattgcaccagaagtgattctgaggcagggttatggaaagccggtggactggtgggccatggggattatcctctatgaatttctggttggatgcgtgccattctttggggatactccagaggagctatttggacaagtcatcagtgatgagatcaactggcctgagaaggatgaggcacccccacctgatgcccaggatctgattaccttactcctcaggcagaatcccctggagaggctgggaacaggtggtgcatatgaagtcaaacagcatcgattcttccgttctttagactggaacagtttgctgagacagaaggcagaatttattccccaactggaatctgaggatgacacaagttattttgatactcggtctgagaagtatcatcatatggaaacggaggaagaagatgacacaaatgatgaagactttaatgtggaaataaggcagttttcttcatgttcacacaggttttcaaaagttttcagcagtatagatcgaatcactcagaattcagcagaagagaaggaagactctgtggacaaaaccaaaagcaccaccttgccatccacagaaacactgagctggagttcagaatattctgaaatgcaacagctatcaacatccaactcttcagatactgaaagcaacagacataaactcagttctggcctacttcccaaactggctatttcaacagagggagagcaagatgaagctgcctcctgccctggagacccccatgaggagccaggaaagccagcccttcctcctgaagagtgtgcccaggaggagcctgaggtcaccaccccagccagcaccatcagcagctccaccctgtcagttggcagtttttcagagcacttggatcagataaatggacgaagcgagtgtgtggacagtacagataattcctcaaagccatccagtgaacccgcttctcacatggctcggcagcgattagaaagcacagaaaaaaagaaaatctcggggaaagtcacaaagtccctctctgccagtgctctttccctcatgatcccaggagatatgtttgctgtttcccctctgggaagtccaatgtctccccattccctgtcctcggacccttcttcttcacgagattcctctcccagccgagattcctcagcagcttctgccagtccacatcagccgattgtgatccacagttcggggaagaactacggctttaccatccgagccatccgggtgtatgtgggagacagtgacatctatacagtgcaccatatcgtctggaatgtagaagaaggaagtccggcatgccaggcaggactgaaggctggagatcttatcactcacatcaatggagaaccagtgcatggacttgtccacacagaagttatagaactcctactgaagagtgggaataaggtgtcaatcactactaccccatttgaaaacacatcaatcaaaactggaccagccaggagaaacagctataagagccggatggtgaggcggagcaagaaatccaagaagaaagaaagtctcgaaaggaggagatctcttttcaaaaagctagccaagcagccttctcctttactccacaccagccgaagtttctcctgcttgaacagatccctgtcatcgggtgagagcctcccaggttcccccactcatagcttgtctccccggtctccaacaccaagctaccgctccacccctgacttcccatctggtactaattcctcccagagcagctcccctagttctagtgcccccaattccccagcagggtccgggcacatccggcccagcactctccacggtcttgcacccaaactcggcgggcagcggtaccggtccggaaggcgaaagtccgccggcaacatcccactgtccccgctggcccggacgccctctccaaccccgcaacccacctccccgcagcggtcaccatcccctcttctgggacactcactgggcaattccaagatcgcgcaagcctttcccagcaagatgcactccccgcccaccatcgtcagacacatcgtgaggcccaagagtgcggagccccccaggtccccgctgctcaagcgcgtgcagtccgaggagaagctgtcgccctcttacggcagtgacaagaagcacctgtgctcccgcaagcacagcctggaggtgacccaagaggaggtgcagcgggagcagtcccagcgggaggcgccgctgcagagcctggatgagaacgtgtgcgacgtgccgccgctcagccgcgcccggccagtggagcaaggctgcctgaaacgcccagtctcccggaaggtgggccgccaggagtctgtggacgacctggaccgcgacaagctgaaggccaaggtggtggtgaagaaagcagacggcttcccagagaaacaggaatcccaccagaaatcccatggacccgggagtgatttggaaaactttgctctgtttaagctggaagagagagagaagaaagtctatccgaaggctgtggaaaggtcaagtacttttgaaaacaaagcgtctatgcaggaggcgccaccgctgggcagcctgctgaaggatgctcttcacaagcaggccagcgtgcgcgccagcgagggtgcgatgtcggatggcccggtgcctgcggagcaccgccagggtggcggggacttcagacgggcccccgctcctggcaccctccaggatggtctctgccactccctcgacaggggcatctctgggaagggggaaggcacggagaagtcctcccaggccaaggagcttctccgatgtgaaaagttagacagcaagctggccaacatcgattacctccgaaagaaaatgtcacttgaggacaaagaggacaacctctgccctgtgctgaagcccaagatgacagctggctcccacgaatgcctgccagggaacccagtccgacccacgggtgggcagcaggagcccccgccggcttctgagagccgagcttttgtcagcagcacccatgcagctcagatgagtgccgtctcttttgttcccctcaaggccttaacaggccgggtggacagtggaacggagaagcctggcttggttgctcctgagtcccctgttaggaagagcccctccgagtataagctggaaggtaggtctgtctcatgcctggagccgatcgagggcactctggacattgctctcctgtccggacctcaggcctccaagacagaactgccttccccagagtctgcacagagccccagcccaagtggtgacgtgagggcctctgtgccaccagttctccccagcagcagtgggaaaaagaacgataccaccagtgcaagagagctttctccttccagcttaaagatgaataaatcctacctgctggagccttggttcctgccccccagccgaggtctccagaattcaccagcagtttccctgcctgacccagagttcaagagggacaggaaaggtccccatcctactgccaggagccctggaacagtcatggaaagcaatccccaacagagagagggcagctcccctaaacaccaagaccacaccactgaccccaagcttctgacctgcctggggcagaacctccacagccctgacctggccaggccacgctgcccgctcccacctgaagcttccccctcaagggagaagccaggcctgagggaatcgtctgaaagaggccctcccacagccagaagcgagcgctctgctgcgagggctgacacatgcagagagccctccatggaactgtgctttccagaaactgcgaaaaccagtgacaactccaaaaatctcctctctgtgggaaggacccacccagatttctatacacagacccaggccatggagaaagcatgggcgccgggtgggaaaacgaaccacaaagatggcccaggtgaggcgaggcccccgcccagagacaactcctctctgcactcagctggaattccctgtgagaaggagctgggcaaggtgaggcgtggcgtggaacccaagcccgaagcgcttcttgccaggcggtctctgcagccacctggaattgagagtgagaagagtgaaaagctctccagtttcccatctttgcagaaagatggtgccaaggaacctgaaaggaaggagcagcctctacaaaggcatcccagcagcatccctccgccccctctgacggccaaagacctgtccagcccggctgccaggcagcattgcagttccccaagccacgcttctggcagagagccgggggccaagcccagcactgcagagcccagctcgagcccccaggaccctcccaagcctgttgctgcgcacagtgaaagcagcagccacaagccccggcctggccctgacccgggccctccaaagactaagcaccccgaccggtccctctcctctcagaaaccaagtgtcggggccacaaagggcaaagagcctgccactcagtccctcggtggctctagcagagaggggaagggccacagtaagagtgggccggatgtgtttcctgctaccccaggctcccagaacaaagccagcgatgggattggccagggagaaggtgggccctctgtcccactgcacactgacagggctcctctagacgccaagccacaacccaccagtggtgggcggcccctggaggtgctggagaagcctgtgcatttgccaaggccgggacacccagggcctagtgagccagcggaccagaaactgtccgctgttggtgaaaagcaaaccctgtctccaaagcaccccaaaccatccactgtgaaagattgccccaccctgtgcaaacagacagacaacagacagacagacaaaagcccgagtcagccggccgccaacaccgacagaagggcggaagggaagaaatgcactgaagcactttatgctccagcagagggcgacaagctcgaggccggcctttcctttgtgcatagcgagaaccggttgaaaggcgcggagcggccagccgcgggggtggggaagggcttccctgaggccagagggaaagggcccggtccccagaagccaccgacggaggcagacaagcccaatggcatgaaacggtccccctcagccactgggcagagttctttccgatccacggccctcccggaaaagtctctgagctgctcctccagcttccctgaaaccagggccggagttagagaggcctctgcagccagcagcgacacctcttctgccaaggccgccgggggcatgctggagcttccagcccccagcaacagggaccataggaaggctcagcctgccggggagggccgaacccacatgacaaagagtgactccctgccctccttccgggtctccaccctgcctctggagtcacaccaccccgacccaaacaccatgggcggggccagccaccgggacagggctctctcggtgactgccaccgtaggggaaaccaaagggaaggaccctgccccagcccagcctcccccagctaggaaacagaacgtgggcagagacgtgaccaagccatccccagccccaaacactgaccgccccatctctctttctaatgagaaggactttgtggtacggcagaggcgggggaaagagagtttgcgtagcagccctcacaaaaaggccttgtaacggggagggcccaggggcaggactgtggagacccgtcctgaacgggcgactgtgtcttgactacctttcaaaaccagcactgtgtgggaatgtccgccaggcagagctcggagcctcattgagacaggggagagagaaagacaaagaggggaccttcttccagatgccttcccagttgtaaccggtaaaactgttaccagatagtgtttgtac

SEQ ID NO: 5 - DNA, 5956 bp, Homo sapiens
  ref <308>: DATABASE ACCESSION NUMBER: AB002308
  ref <309>: DATABASE ENTRY DATE: 2001-06-18
ggggagaacacttctttgtctgggattccaaccagctctgtccttagcttgtctctgcctagcagtgttgcccaaagtaattttccacaaggttctggtgcttccgaaatggtttctaatcagcctgctaatttgctggttcaaccaccatcccagccagttccagagaacttggttccagaaagtcaaaaggatcgtaaggcaggaagtgctcttcccggatttgctaatagccctgctggaagcacaagtgtggtgttagttccacctgcacacggcaccctggtgcctgatggtaataaggcaaaccattccagtcatcaggaagacacttacggagccctagactttgccttaagcaggactttggaaaatcctgtaaacgtgtacaacccgtcccattctgacagcctcgcttctcagcaaagtgttgccagtcatcccagacaatctgggcctggggcgcctaaccttgaccgtttttatcagcaggtcacgaaagatgcccagggccagcctggcctcgaaagagcccagcaggagctggcgccaccccagcaacaggcttctcccccacaactacccaaagccatgttttcggagctgtcaaatccagaaagtctgcccgcacagggacaggcccagaactcagcacagtcaccagcaagtctggttctggtcgacgcgggtcagcagctgccccctcggcctcctcagtcctctagcgtgtctctggtgtccagtggctccggccaggcagctgtgccgtcagagcagccgtggccacagccagtgcctgcacttgcccccggcccaccgcctcaggacctggccgcctactactactaccggcctttgtacgatgcctaccagcctcagtactctttgccgtacccaccggagcctggcgcagcctccctctattaccaggatgtctacagcctctatgagcctcgatacaggccctatgatggtgctgcgtctgcttacgcccagaactaccgctatcccgagcccgagcggcccagctcccgagccagccactcctcggaacggccacctcccaggcaaggatatcctgaaggatactatagttccaaaagtggatggagcagtcagagcgattactatgcaagctattactccagccagtacgattatggagatccaggtcactgggatcgttaccactacagtgctagagtcagggacccccgcacctatgaccggaggtattggtgtgatgcagagtatgacgcatacaggagagagcactctgccttcggggacaggcccgagaaacgtgacaacaactggaggtacgatcctcgcttcacggggagttttgacgatgaccccgatccgcacagagacccttatggggaagaggtggaccggcgcagcgtccacagcgagcactcggcacggagcctgcacagcgcacacagcctggccagccgccgcagcagcctcagctcccactcgcaccagagtcagatttacagaagccacaatgtggctgccggttcctacgaggccccgcttcctccaggctcctttcacggcgattttgcctacggcacctaccgcagcaatttcagcagtggccccggcttcccagagtatggctaccctgccgacaccgtctggcctgccatggagcaagtttcatcaagaccaacttctcctgaaaaattttcagtgcctcatgtctgtgccaggtttggccctggcggtcagcttatcaaagtgattcccaatctgccttcagaaggacagccggccttggtggaggtccacagcatggaggccttgctgcagcacacgtctgagcaggaggagatgcgggcgttcccgggacccctggccaaagacgacacccataaggtggatgtcattaattttgcacagaacaaagctatgaaatgtttgcagaatgaaaacttaattgacaaagagtctgcaagtcttctttggaattttattgttctcttatgcagacaaaatgggaccgtggtagggaccgacattgcggagcttctgttacgagaccacagaacagtgtggcttcctgggaagtcgcccaatgaagcaaacctgattgatttcacgaatgaggcagtggagcaggtggaagaggaggagtctggtgaggcccagctctctttcctcactggtggtccggcggctgccgccagctcgctcgagagagagaccgagaggttcagggagctgttgctgtatggccgtaagaaggatgctttggagtctgcaatgaagaatggcctgtggggtcacgctctgctacttgcaagtaagatggacagccggacacacgcccgagtcatgaccaggtttgctaacagcctcccaatcaacgaccctctgcagacagtctaccagctcatgtccggacggatgcctgccgcgtccacgtgctgtggagacgagaaatggggagattggaggccgcacctcgccatggtcttgtccaacttgaacaacaacatggacgtcgagtccaggacgatggctaccatgggcgacactctggcttcaaggggcctcttggatgcggcccacttctgctacctcatggcccaggcgggatttggtgtttacacgaagaaaactacaaagcttgtcttaatcggatccaatcacagtttgccattcttaaagttcgcaaccaacgaagcaatccagaggacggaagcctatgagtacgcccagtccctgggtgccgagacctgccccctgcctagtttccaggtgtttaagttcatctactcctgccgcctggcggaaatggggctggccacgcaagccttccactactgtgaggccatcgcgaagagcatcctgacgcagccgcacctgtattccccggtgttgatcagccagcttgtgcagatggcttcccagttacgactcttcgatccccagctgaaagagaagccagaagaggagtccttggccgcacccacgtggctggttcacctgcagcaggtggagcggcagattaaggagggggctggagtatggcatcaggatggagccctcccgcagcagtgtcctggcactccgagttccgagatggagcagttggacaggccaggactcagtcagccaggagccctggggatcgccaaccctctgctggcggtgcctgcaccgagccctgagcactcgagcccgagcgtgcggctgctgccctcagctccgcagacgctccctgacggcccattggccagtcctgccagagtgccgatgttcccagtgccactgcccccggggcccctggagccgggtcctggctgtgtgaccccagggcctgcacttggcttcctggagccctccgggcctggcctcccacctggtgtgccacctctgcaggaaaggagacacttgctccaggaagccaggagcccagacccagggatagtgccgcaggaggcgcctgttggaaactcactttccgagctaagcgaagaaaattttgatggaaaatttgctaatctgaccccctcgaggacggtgccagactcggaggcccccccagggtgggatcgtgccgactcgggtcccacgcagccacctctgtctctctcacccgctcccgaaacaaagagacccggacaggcagccaagaaagaaacgaaggaacctaagaagggtgaatcctggttctttcgttggctacctggaaagaaaaagacagaagcttatttgccagatgacaagaacaaatcgattgtttgggatgaaaagaaaaaccagtgggtgaatttaaatgagccagaagaggagaagaaagccccgcccccacctccaacctcgatgcccaagactgtgcaagctgccccgcctgccctcccagggcctcctggagcccccgtgaacatgtactctagaagagcagcaggaaccagagctcgctacgttgacgtcctgaacccaagcgggacccagcggagcgagccggctctcgctcctgcggactttgtcgctccactcgcgccactcccaattccttctaacttgttcgtgccaaccccagatgcagaagaaccacagcttccagacgggactggcagggaagggcctgcagcagctaggggcctggccaatccagagcctgccccagagcccaaggctcctggcgacctccctgctgcagggggccctcccagcggggccatgcccttctacaaccctgctcagctggcacaggcctgcgccacctccgggagctcaaggctagggaggattggccagaggaagcacctggtgctgaactaggcttgccctgctgtgaacttgcacttggagccctgacgctgctgttctccccgaagaacccgaccgacctccgcgatctccgtcccgcccccagggagacacagcagtgactcagagctggtcgcacactgtgcctccctcctcaccgcccatcgtaatgaattattttgaaaattaattccaccatcctttcagattctggatggaaagactgaatctttgactcagaattgtttgccgaaaagaatgatgtgactttcttagtcatttaggatgatttaaggatatagtattcctggtcatttaagaatgttcattcattgaagccggagctgtctctgccacgggagagccacatggtcggtagtaaccagggcctctccaagcccagctgtgagtcactgcccagtgagtcccgcgcttcctttaaggtgctgggagcaaagagagggtgactgaggcagaccccaacccctgctctgcaccatctgggccctcgccgtgtttgaacctggctgaatgagtggagggcgctgtgttctcaatcagcgcctccgaggagccgtggggttccttcggcattagttcacggtttttgagagaggccctagttactgcagtgaatttctttcctgttgcagagacgcttccagcctcactttactttctgtggcctgatgaggaccatgggtgattttgtgtacccaaagcgctggggactgcccaccgtgtggcccagtcactgggaaggagccccagagagccggctgtctgacatgatggctcagggtggtcatccaggttgaaaactgaccgtgtgatgtttgatttgggcttcatttcgtgtgtaggagcacggttagactcactgttaaggaagctggatgcacttctctaaaaggctgcactttccgtgagcacttttcgtggtacaatccacatgacccactttctcccctgggggacgttggttcagaggttggtagcacttggggagagtatcttaacacagtttcttgacagcagctctggaacttagtatttctgccccgagttttgccacactgagactttgagtagctcctggtggactcaaccctgttcaactcagagacgggcctcctctcactgatgcaaagctttaaggcttctctgactgttctgaaactcttcgtattcttgtcaagtctaaagagactgaagaaaagatttaaatactaataaaaatcagtagataatttctgtaggttctgctggaggaatacaaactgtttggtgttttaaatttaagtgtagaaattgtagaatgtggaattagcacagatccttcctggctttctgtttcacttgatcatttagcccagaccacccaggatgttttccaaaatgttccacaggcgtgtcccgctggatccatttgtccttgtcacttggagaaaggccagtccctgtgacggggcagccctctctgtccctcggtcagctcgtgtgaatcctgggacctcttccggtcggctctgcccgctgttctggggtcgactgccacgacttttgattcaagaagcttcctccaggcgggagcggctatttttcctaaatgagaattgttacattgcaaattgttgaataaaatattttgcgctccttcaagcac

SEQ ID NO: 6 - DNA, 6651 bp, Homo sapiens
  ref <308>: DATABASE ACCESSION NUMBER: AB002351
  ref <309>: DATABASE ENTRY DATE: 2001-06-18
ggccgagtcgtggcgggagacggtgcagctgtacgaggacgaggtgcgcgagctggaggaggcgctgcggcgcggccaggagagcagactccaggcggaggaagagacgcggctgtgcgcgcaggaggcagaggcgctgcggcgcgaggcgctcgggttggagcagctgcgcgcgcggctggaggacgcgctgctgcggatgcgcgaggagtacgggatacaggccgaggagcggcagagagcgattgactgcctggaggatgagaaggcaaccctcaccttggccatggctgactggctgcgggactatcaggacctcctgcaggtgaagaccggcctcagtctggaggtggcgacctaccgggccttattggaaggagaaagtaatccagagatagtgatctgggctgagcacgttgaaaacatgccgtcagaattcagaaacaaatcctatcactataccgactcactactacagagggaaaatgaatggaatctattttcaaggcagaaagcacctttggcaagtttcaatcacagctcggcactgtattctaacctgtcagggcaccgtggatctcagacgggcacatctattggaggtgatgccagaagaggcttcttgggctcgggatattcttcctcggccactacccagcaggaaaactcatacggaaaagccgtcagcagtcaaaccaacgtcagaactttctctccaacctatggccttttaagaaatactgaggctcaagtgaaaacattccctgacagaccaaaagccggagatacaagggaggtccccgtttacataagtgaagattccacaattgcccgcgagtcgtaccgggatcgccgagacaaggtggcagcaggtgcttcggaaagcacacggtcaaatgagaggaccgtcattctgggaaagaaaacagaagtgaaagccacgagggagcaagaaagaaacagaccagaaaccatccgaacaaagccagaagagaaaatgttcgattctaaagagaaggcttctgaggagagaaacctaagatgggaagaattgacaaagttagataaggaagcgagacagagagaaagccagcagatgaaggagaaggctaaggagaaggactcaccgaaggagaagagtgtgcgagagagagaggtgccgattagtctagaagtatcccaggacagaagagcagaggtgtccccgaaaggtttgcagacgcctgtgaaggatgctggtggtgggaccggtagagaggcagaagcaagagagctacggttcaggttgggcaccagtgatgccactggttctctgcaaggcgattccatgacagaaaccgtagcagaaaacatcgttaccagtatcctgaagcagttcactcagtctccagagacagaagcatctgctgattcttttccagacacaaaagtcacttacgtggacaggaaagagcttcctggggaaaggaaaacaaagactgaaatagttgtggagtctaaactgactgaggatgttgatgtttccgatgaagctggcctggactaccttttaagcaaggatattaaggaagtggggctgaaaggcaagtcagccgagcagatgataggagacatcatcaacctcggcctgaaagggagggaggggagagcaaaggtcgtcaacgtggagatcgtggaggagcccgtgagttatgtcagcggggagaagccggaggagttttccgtcccattcaaagtggaggaggtcgaagatgtgtcgccaggcccctgggggttggttaaggaggaggaaggttatggagaaagcgatgtcacattctcagttaatcagcatcgaaggaccaagcagccccaggagaacacgactcacgtggaagaagtgacagaggcaggtgattcagagggcgagcagagttattttgtgtccactccagatgaacaccccggggggcacgacagagatgacggctcggtgtacgggcagatccacatcgaggaggaatccaccatcaggtactcttggcaggatgaaatcgtgcaggggactcgaaggaggacacagaaggacggtgcagtgggcgagaaggttgtgaagcccttggatgtcccagcgccctctctggagggggacctgggttccactcactggaaagaacaagctagaagcggtgaatttcatgccgaacccacagtcattgaaaaagaaattaaaataccccacgaattccacacctccatgaagggcatctcctccaaggagccccggcagcagctggtggaggtcatcgggcagctggaggaaacccttcccgagcgcatgagggaggagctgtccgccctcaccagagaggggcagggtgggccggggagcgtttccgtggatgtcaagaaggtccagggtgctggtggcagttccgtgaccctggttgctgaagtcaacgtctcacaaactgtggatgccgatcggttagacctggaggagctgagcaaagatgaggccagtgagatggagaaggctgtggagtcggtggttcgggagagcctgagcaggcaacgcagcccagcgcctggcagcccagatgaggaaggtggagcggaggccccggctgctggcattcgcttcaggcgttgggccacccgggagctgtacatcccttcaggcgagagcgaggttgctggtggggcctctcacagctcgggacagcgcactccccagggcccagtgtcggccactgtggaggtcagcagccccacaggctttgcccagtcacaggtgctggaggatgtgagccaggctgcaaggcacataaaactcggcccctctgaagtctggaggactgagcgaatgtcatatgaaggacccactgcagaagtggtggaggtaagtgcgggaggtgacctaagtcaggcagcgagcccgaccggagccagccggtctgtgaggcatgtcacgctgggtcccggtcaaagtccactgtccagagaagtcatcttcctaggccctgcccctgcctgtccagaggcatggggctcgccagaacctggcccagcagagtcttctgcagatatggacggatcagggaggcacagcacatttggctgcagacaatttcatgctgaaaaggagattatttttcagggccccatttctgctgcagggaaggttggtgattattttgcaacagaagagtcagtgggtacccagacttctgtcaggcaactccagttaggccctaaagaagggttcagtgggcaaatccagttcacagctccactttcagacaaggtggagttgggtgtcataggagattctgtacacatggaagggttgccagggagcagcacatccatcaggcacatcagcattgggcctcagaggcatcagaccacccagcagatagtttaccatgggctggttccccaactgggggaatctggtgactcagagagcactgtgcacggagagggctcagcagatgtgcaccaggccactcacagtcatacctcgggtagacaaaccgttatgactgaaaagagcaccttccaaagtgtcgtttctgaatctccccaggaggatagtgcaggggacacatcaggggcagaaatgacatcgggtgttagcagatcctttaggcacattcgactaggtcctacagaaacggaaacctctgaacacattgccatccgtggacccgtgtccagaacatttgtgcttgctggttcagcggactcccctgagctaggcaagttagcagacagcagcagaacgctaaggcacattgcaccagggcccaaagaaacttcgtttacctttcagatggatgtgagtaacgtagaggcgatccgcagccggacacaggaagcgggagctctcggtgtgtctgaccgtggttcctggagagacgcggacagtaggaatgaccaggcagttggtgtgagctttaaggcctctgctggggaaggagaccaggcccacagagaacagggcaaggagcaggccatgtttgataagaaggtgcagctccagagaatggtagaccaaaggtcggtgatttcagatgaaaagaaagttgccctcctctatctagacaatgaggaggaggagaatgatgggcattggttttaataagcagaaacattttgttttaatggcagcctgttggcgacgtgccaacatccaaaggccttaacttattttaagaggccgagggagtctatgaaaatctccccttttttacttttttaaagagtactcccggcatggtcaatttcctttatagttaatccgtaaaggtttccagttaattcatgccttaaaaggcactgcaattttatttttgagttgggacttttacaaaacacttttttccctggagtcttctctccacttctggagatgaatttctatgttttgcacctggtcacagacatggcttgcatctgtttgaaactacaattaattatagatgtcaaaacattaaccagattaaagtaatatatttaagagtaaattttgcttgcatgtgctaatatgaaataacagactaacattttaggggaaaaataaatacaatttagactctaaaaagtcttttcaaaaagaaatgggaaataggcagactgtttatgttaaaaaaattcttgctaaatgatttcatctttaggaaaaaattacttgccatatagagctaaattcatcttaagacttgaatgaattgctttctatgtacagaactttaaacaatatagtatttatggcgaggacagctgtagtctgttgtgatatttcacattctatttgcacaggttccctggcactggtagggtagatgattattgggaatcgcttacagtaccatttcattttttggcactaggtcattaagtagcacacagtctgaatgcccttttctggagtggccagttcctatcagactgtgcagacttgcgcttctctgcaccttatcccttagcacccaaacatttaatttcactggtgggaggtagaccttgaagacaatgaagagaatgccgatactcagactgcagctggaccggcaagctggctgtgtacaggaaaattggaagcacacagtggactgtgcctcttaaagatgcctttcccaaccctccattcatgggatgcaggtctttctgagctcaagggtgaaagatgaatacaataacaaccatgaacccacctcacggaagctttttttgcactttgaacagaagtcattgcagttggggtgttttgtccagggaaacagtttattaaatagaaggatgttttggggaaggaactggatatctctcctgcagcccagcaccgagatacccaggacgggcctggggggcgagaaaggcccccatgctcatgggccgcggagtgtggacctgtagataggcaccaccgagtttaagatactgggatgagcatgcttcattggattcattttattttacacgtcagtattgttttaaagtttctgtctgtaaagtgtagcatcatatataaaaagagtttcgctagcagcgcattttttttagttcaggctagcttctttcacataatgctgtctcagctgtatttccagtaacacagcatcatcacactgactgtggcgcactggggaataacagtctgagctagcaccaccctcagccaggctacaacgacagcactggagggtcttccctctcagattcacctggaggccctcagacccccagggtgcacgtctccccaggtcctgggagtggctaccgcaggtagtttctggagagcacgttttcttcattgataagtggaggagaaatgcagcacagctttcaagatactattttaaaaacaccatgaatcagatagggaaagaaagttgattggaatggcaagtttaaacctttgttgtccatctgccaaatgaactagtgattgtcagactggtatggaggtgactgctttgtaaggttttgtcgtttctaatacagacagagatgtgctgattttgttttagctgtaacaggtaatggtttttggatagatgattgactggtgagaatttggtcaaggtgacagcctcctgtctgatgacaggacagactggtggtgaggagtctaagtgggctcagtttgatgtcagtgtctgggctcatgacttgtaaatggaagctgatgtgaacaggtaattaatattatgacccacttctatttactttgggaaatatcttggatcttaattatcatctgcaagtttcaagaagtattctgccaaaagtatttacaagtatggactcatgagctattgttggttgctaaatgtgaatcacgcgggagtgagtgtgcccttcacactgtgacattgtgacattgtgacaagctccatgtcctttaaaatcagtcactctgcacacaagagaaatcaacttcgtggttggatggggccggaacacaaccagtctttttgtatttattgttactgagacaaaacagtactcactgagtgtttttcagtttcctactggtggttttgatattgtttgtttaagatgtatatttagaatgacatcatctaagaagctgattttgctaaactcctgttccctacaatgggaaatgtcacaagaatgtgcaaaaataaaaatctgagg

SEQ ID NO: 7 - DNA, 1270 bp, Homo sapiens
  Modified_base 1 ... 1270: n = a,c,g, or t
  ref <308>: DATABASE ACCESSION NUMBER: AB002448
  ref <309>: DATABASE ENTRY DATE: 2001-06-18
tcttttncaaggccagatctgttacagagtatcttttttctactacagaacatactgtagacagttattcagtggttaacttgtggaaataatcagaagatgcttttcacttttatgactggatatattttaatatttatcatattaagagaaacttaggttacttacagctcataaacgttgctatgaacatcattcatttattcacttatttatttttatggtgttcctagaaagaatttcctggactaaaggatttatgctttaaaaatattggtagttactgccaagaattgccatccagaaacagtgttagcccattccataaactccaacaacaaggtatgagagtgcctgtttcctcatatcctttgtgacaccggattttatcaagcttaaagttttttcattctaggtgggtgaaaatggtattccgttattgataatgtgtggaaatcaagttctaataagtttggggggaggttaattctttatatgtgctgtatgaattaatgccaactgtatgcctttgagagtgaaatcagaataatgtctctccactaaagcaggacttagagcactagttttccaaatgttgtctacagatggaaacactagcatcacctgggtactcgttagaaagtgcagattctctggcggtaccttagacctcctgaattaaaaactctgggggtagggttagacatttgtgttttaaacaagccctccaagtggtttcaatgcacattcaaagttgagaaccaatcactgatagagaaaaagcagcttgggtagaaacagttgattatttgcaaatttatattttaaaaagataggattcttaacagtaagctctttataattcaacaatgtgatctttactcctacccccgaaaaaactaatatgattttagtgtgtggtagctggatcgaaaacataataaatactcagatatggcggggangngnaggagcnnntnccaagaaaaaaaattcctgcggccgcaagggaattccacnggcccgccgttttaccaangttcnntgaactggggaaaaacccctgggcnttnaccccaactttaaatcccccctnggaaancannntcccccccttnccgccancntgggnttnatttaccaaaaaangccccncnccgaatccnccntccccaanntgttgncccnccctgnaagggcnaanngnaaatccnttggcangggcnggggtantttntnccggatttaccncanggccanttttggatcc

SEQ ID NO: 8 - DNA, 4103 bp, Homo sapiens
  ref <308>: DATABASE ACCESSION NUMBER: AB004857
  ref <309>: DATABASE ENTRY DATE: 2001-06-18
ggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccgttgcaaagcacactgtctttctcagcgttctctgcaagtcagtaggtgttagtatggttgcaaagttcactgtctcagcaaagttgaactgggctacctctctacagctgtttcctcagagggaaaaatcttgagaccatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttcc

SEQ ID NO: 9 - DNA, 2979 bp, Homo sapiens
  ref <308>: DATABASE ACCESSION NUMBER: AB006628
  ref <309>: DATABASE ENTRY DATE: 2001-06-18
atcttgacaggcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctgcggcgctcagtggaaaaatacaactcagcccgagctgactttgagcagaagatgctggactcagccctgcgcttccaagccatggaggagacacacctgaggcacatgaaggcactgctgggctcatatgctcactcggtggaggacacgcacgtgcagattgggcaggtgcatgaggaatttaagcagaacatcgagaacgtcagcgtggagatgctactcaggaagtttgcagagagtaagggcacaggccgggagaagcctggacctctggacttcgaggcatacagtgcggctgccctgcaggaagcgatgaaacgtttgcggggagccaaggcctttcgccttccaggactaagccggcgggagcgggagccagagccacctgcagctgtagatttcctggagcctgattcagggacatgtccagaggtggatgaagaaggtttcactgtccggcctgatgtgacccagaacagcacggccgagccctcccgtttctcgtccagcgactccgacttcgacgatgaagagccccgcaagttctatgtgcacatcaagcctgccccggcccgggctccagcctgcagccccgaggcagcagcggcacagctcagggccaccgcgggcagcctcatccttcctcctggcccagggggcaccatgaaacgccattcttcacgggacgctgctgggaaaccccagagacctcggtctgcccccagaaccagcagctgtgcagagagattgcagtcagaggagcaggtgtccaagaacctctttgggccgcccctggagtcagcctttgaccacgaagattttacaggctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggagacctgatgcctgcacctgctgaccccacagccagggagggcctggcagccccacccaggagacttcgctctaggaaggtgtcctgccctctcacacgtagcaatggggacctgtctcgttccctgagcccctccccactgggctcttcagccgccagcactgccttggaacggcccagcttcttatcccagacaggacacggagtctcccggggtccgagccctgtggtcctgggctcccaggatgccctgcccatagccacagccttcacggagtatgtccacgcctacttccgtggccacagccccagctgcctggctcgagtaactggggagctgaccatgaccttccctgctggcatcgtgcgtgtgttcagcgggaccccaccaccacctgtcctcagcttccggcttgtacacacaaccgctattgagcacttccagcccaacgccgatctgctgttcagtgacccctcccagagtgaccctgagaccaaagacttctggctcaacatggcagctctgaccgaagccctgcagcgccaggcagagcagaaccccactgcctcctactacaacgtggtgctgctgcgataccagttctcccgcccgggtccccagtctgtgcctctgcagctcagtgcccactggcagtgtggagccaccctcacccaggtctcagtggagtacggctaccggcccggtgccacggctgtgcccacaccactcacgaacgtccagatcctgctgcctgtgggggagcctgtgaccaacgtccgcttgcagccggctgccacctggaacctggaggagaagcggctcacttggaggcttccagatgtgtccgaggcaggcggttctggccgcctctctgccagctgggagccgctctcagggcccagcacacccagccccgtggctgcacagttcaccagcgaggggaccactctgtcgggcgtggacttggaactggtgggcagcggttaccgcatgtcgctggtgaagaggaggtttgccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctgagcccgagattcgctcctccccctcatgccaaccccacacaggtcccggccttttaatgttctttgaataaacactttattttctaataaaataaaaaaggaaaccttt

SEQ ID NO: 10 - DNA, 6542 bp, Homo sapiens
  ref <308>: DATABASE ACCESSION NUMBER: AB006630
  ref <309>: DATABASE ENTRY DATE: 2001-06-18
ctcctccttcccttcaccacagcgttttagccagtctggacagagctatgatggcagttacaatgtgaatgctggatctcagtatgaaggacacaatgtgggttctaatgcacaggcttatggaacacaatccaattacagctatcagcctcaatctatgaagaattttgaacaggcaaagattccacaagggacccaacaggggcagcagcagcagcaaccgcagcaacaacaacacccttctcagcatgtgatgcagtatactaacgctgccaccaagctgcccctgcaaagccaagtggggcagtacaaccagcctgaggttcctgtgaggtcccccatgcagtttcaccagaacttcagccccatttctaacccttctccagctgcctctgtggttcagtctccaagctgtagttctaccccatctcctctcatgcagactggggagaatctccagtgtgggcaaggcagtgtgcctatgggttccagaaacagaattttacagttaatgcctcaactcagtccaaccccatcaatgatgcccagtcctaattctcatgctgcaggcttcaaagggtttggactagaaggggtaccagaaaagcgactgacagatcctgggttgagtagtttgagtgctctgagtactcaagtggccaatcttcctaacactgtccagcacatgttactttctgatgccctgactcctcagaagaagacctccaagaggccctcatcttccaagaaagcagatagctgcacaaattctgaaggctcctcacaacctgaagaacagctgaagtcccctatggcagagtcattagatggaggctgctccagcagttcagaggatcaaggcgagagagtgcggcaactaagtggccagagcaccagctctgacaccacctacaagggtggagcctctgagaaagctggctcctcaccggcacaaggtgctcagaatgaaccccccagactcaatgctagtcctgccgcaagagaagaggccacctcaccaggcgctaaggacatgccattgtcatccgacgggaacccaaaggttaatgagaagactgttggggtgattgtctcccgggaagccatgacaggtcgggtagaaaagcctggtggacaagataaaggctcccaagaggatgatcctgcagccactcaaaggccacctagcaatggtggggcaaaggaaaccagtcatgcatcacttccccagccagagcctccaggaggaggagggagcaaaggaaacaagaatggcgataacaactccaaccataatggagaaggaaatggccagagtggccactctgcagcgggccctggttttacgagcagaactgagcctagcaaatctcctggaagtctgcgctatagttacaaagatagtttcgggtcagccgtgccacgaaatgtcagtggctttcctcagtatcctacagggcaagaaaagggagatttcactggccatggggaacgaaagggtagaaatgaaaaattcccaagcctcctgcaggaagtgcttcagggttaccaccaccaccctgacaggagatattctaggagtactcaagagcatcaggggatggctggtagcctagaaggaaccacaaggcccaatgtcttggttagtcaaaccaatgaattagctagcaggggccttctgaacaaaagcattgggtctctattagaaaatccccactggggcccctgggaaaggaaatcaagcagcacagctcctgaaatgaaacagatcaatttgactgactatccaattcccagaaagtttgaaatagagcctcagtcatcagcacatgagcctgggggttccctctctgaaagaagatcagtgatctgtgatatttctccactaagacagattgtcagggacccaggggctcactcactgggacacatgagtgccgacaccagaattgggaggaatgaccgtctcaatccaactttaagtcagtcggtcattcttcctggtggtttggtgtccatggaaaccaagctgaaatcccagagcgggcagataaaagaggaagactttgaacagtctaaatctcaagctagtttcaacaacaagaaatctggagaccactgccatcctcctagcatcaagcatgagtcttaccgcggcaatgccagccctggagcagcaacccatgattccctttcagactatggcccgcaagacagcagacccacgccaatgcggcgggtccctggcagagttggtggtcgggagggcatgaggggtcggtccccttctcaatatcatgactttgcagaaaaattgaaaatgtctcctgggcggagcagaggcccagggggagaccctcatcacatgaatccacacatgaccttttcagagagggctaaccggagttctttacacactcccttttctcccaactcagaaaccctggcctctgcttatcatgcaaatactcgggctcatgcttatggggaccctaacgcaggtttgaattctcagctgcattataagagacagatgtaccaacagcaaccagaggagtataaagactggagcagcggttctgctcagggagtaattgctgcagcacagcacaggcaggaggggccacggaagagtccaaggcagcagcagtttcttgacagagtacggagccctctgaaaaatgacaaagatggtatgatgtatggcccaccagtggggacttaccatgaccccagtgcccaggaggctgggcgctgcctaatgtctagtgatggtctgcctaacaagggcatggaattaaagcatggctcccagaagttacaagaatcctgttgggatctttctcggcaaacttctccagccaaaagcagcggtcctccaggaatgtccagtcaaaaaaggtatgggccgccccatgagactgatggacatggactagctgaggctacacagtcatccaaacctggtagtgttatgctgagacttccaggccaggaggatcattcttctcaaaaccccttaatcatgaggaggcgtgttcgttcttttatctctcccattcccagtaagagacagtcacaagatgtaaagaacagtagcactgaagataaaggtcgcctccttcactcatcaaaagaaggcgctgataaagcattcaattcctatgcccatctttctcacagtcaggatatcaagtctatccctaagagagattcctccaaggaccttccaagtccagatagtagaaactgccctgctgttaccctcacaagccctgctaagaccaaaatactgcccccacggaaaggacggggattgaaattggaagctatagttcagaagattacatccccaaatattaggaggagcgcatcttcgaacagtgcggaggctgggggagacacggttacgcttgatgatatactgtctttgaagagtggtcctcctgaaggtgggagtgttgctgttcaggatgctgacatagagaagagaaaaggtgaggtggcttcggacctagtcagtccagcaaaccaggagttgcacgtagagaaacctcttccaaggtcttcagaagagtggcgtggcagcgtggatgacaaagtgaagacagagacacatgcagaaacagttactgccggaaaggaaccccctggtgccatgacatccacaacctcacagaagcctggtagtaaccaagggagaccagatggttccctgggtggaacagcacctttaatctttccagactcaaagaatgtacctccagtgggcatattggcccctgaggcaaaccccaaggctgaagagaaggagaacgatacagtgacgatttcaccgaagcaagagggtttccctccaaagggatatttcccatcaggaaagaagaaggggagacccattggtagtgtgaataagcaaaagaaacagcagcagccaccgcctccaccccctcagcccccacagataccagaaggttctgcagatggagagccaaagccaaaaaaacagaggcaaaggagggagagaaggaagcctggggcccagccgaggaagcgaaaaaccaaacaagcagttcccattgtggaaccccaagaacctgagatcaaactaaaatatgccacccagccactggataaaactgatgccaagaacaagtctttttacccttacatccatgtagtaaataagtgtgaacttggagccgtttgtacaatcatcaatgctgaggaagaagaacagaccaaattagtgaggggcaggaagggtcagaggtcactgacccctccacctagcagcactgaaagcaaggcgctcccggcctcgtcctttatgctgcagggacctgttgtgacagagtcttcggttatggggcacctggtttgctgtctgtgtggcaagtgggccagttaccggaacatgggtgacctctttggacctttttatccccaagattatgcagccactctcccgaagaatccacctcctaagagggccacagaaatgcagagcaaagttaaggtacggcacaaaagtgcttctaatggctccaagacggacactgaggaggaggaagagcagcagcagcagcagaaggagcagagaagcctggccgcacaccccaggtttaagcggcgccaccgctcggaagactgtggtggaggccctcggtccctgtccagggggctcccttgtaaaaaagcagccactgagggcagcagtgaaaagactgttttggactcgaagccctccgtgcccaccacttcagaaggtggccctgagctggagttacaaatccctgaactacctcttgacagcaatgaattttgggtccatgagggttgtattctctgggccaatggaatctacctggtttgtggcaggctctatggcctgcaggaagcgctggaaatagccagagagatgaaatgttcccactgccaggaggcaggcgccaccttgggctgctacaacaaaggctgctccttccgataccattacccgtgtgccattgatgcagattgtttgctacatgaggagaacttctcggtgaggtgccctaagcacaagcctccccttccgtgccctctcccccccttgcagaacaagaccgcgaaaggcagcctcagcacagagcagtcggagcgggggtgaggggggcagtgtgctcgtgggaatggaaaggacagcaagcacaggtgagactgtggagatgagaaggtggtggacactcgtgatggaatggaaatcgtcctaccgtgcagccacaccctgccctgccccgccccgccccgcccgcgtgcctgcccatgccagcacttccttaagttctcacatcacactcaaaccagtgacaccacaggaaagaaagacccaagacgttggaatggctgtttccatggacacaatctccatagtgacaatgtggggggaggggggaggggtgggatgatggggaaagggtggggggaattaaaagggagggataaatatatatatataaatctatttttagtctggaaagactttgtttaaatgaaaggtgcgctatcccttttgattctgttttaaaattatctcgttaaagatctccaaatttgttccgatgacaagtgaaatttaaatgtgagattgaactgaacaaaccctcatctcatgaaggacggggtgtgtgtgtggcgttgatctttagcctgtctcacaccagttcagaaaacactagacccaggattgaaaaagcaaaccacagcagaaccatccttttgtcattaatttgtctcaaagtgggaaggttttgggggagggggaaatacagggatggtccatgttttcaagagtaggggaatgatgtttaaacacaaaaataaattttttttcatttccagaaacactatttatttatggttttttttttttaattttttctttttgggggtgaaattggcagatgcctgaggtcatagctgtgtcctgggtcactgtggctggtgaggacctcaaggaccccatcaagtgtacacagcagcagcaaaatcaagggatgaccctcctctggggccccctgtcctcagcacattccaggcagctgtgccctgacccacagggacccgtggggatgggaggaggtccaggcctgtgttgccagagctggcagtgtgagctgtaggcagggacggggagggactgtcgctgtgatcagagtgggttaagctgaccaggaacacccatttaacccctttttctttttgctttcatttttataaaggaaaagaggacctgtcagataggcagccccatgctacgtgattctttatgttgtgttgttttgttttgtaaattgtataatttttaaatatctgagttttaaaaaaagaaaaaagtacaaaaaaatcttgttatggccttaagaaggggttagtgcatctttcaggggtcactctgccatggggataaaatagctgtttcacaaacagttttatttaaaaaaacaaaaaacaaaaaaaatcaaaaaatcaaaaaaataataaacttcattttaaccttg

SEQ ID NO: 11 - DNA, 2077 bp, Homo sapiens
  ref <308>: DATABASE ACCESSION NUMBER: AB006746
  ref <309>: DATABASE ENTRY DATE: 2001-06-18
ccgagcgccagcgcggggaaccgggaaaaggaaaccgtgttgtgtacgtaagattcaggaaacgaaaccaggagccgcgggtgttggcgcaaaggttactcccagacccttttccggctgacttctgagaaggttgcgcacagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgt

SEQ ID NO: 12 - DNA, 439 bp, Homo sapiens
  ref <308>: DATABASE ACCESSION NUMBER: AB007458
  ref <309>: DATABASE ENTRY DATE: 2001-06-18
ctccagtgggcgtcttgggccccggctctattctgggctgcgggcctgggaagggctcgccgggtgccaaatgagctgtcctaactctgcggggctgcagcttcctgcatgatgctggggagcttggcgcctgacccaggatctagaaggcactctgggcaggccgcgctccgcccacgaaggtttaaccaccaaggactctgagagctggcaggtctgagtaaccctggtaacaattctcttcaccttatcaaaacctgagctaaaaccaatgcatcagctgatgatgacagcagagagtggcagggctgaggacccaaagtcatttcccaggctggcggagaataaactgccagggagaagaatgagaagacaggagacaaactgtttggaaagctaaatcttccctcttaatgaataaaggtttttgccttgtctt

SEQ ID NO: 13 - DNA, 7453 bp, Homo sapiens
  ref <308>: DATABASE ACCESSION NUMBER: AB007855
  ref <309>: DATABASE ENTRY DATE: 2001-06-18
acaaaaataagaaatctcatgaacagctgtcagctctgaaagggagcttctgtcggaaccagttcccagggcagagcgaagttgaacatctcacaaaagtgacgggcctcagtaccagagaggtgcggaaatggttcagtgatcgtagataccactgccggaacttgaagggctccagagcgatgatacctggagatcacagttccatcatcattgactctgtgccagaggtgtccttctccccatcgtccaaggtccctgaggtaacctgcattccgacaacagccacactagcaacccacccttctgccaaacgacaatcttggcaccagactcctgacttcacaccaaccaaatacaaggagagagcccctgagcagctcagagccctggagagcagttttgcacaaaaccctcttcctcttgatgaggaactggaccgcctgagaagtgaaaccaaaatgacccgacgagaaattgatagctggttttcagagagacggaaaaaagtgaatgctgaggagaccaagaaggctgaggagaatgcctctcaggaggaagaggaggctgctgaggatgagggtggagaagaggatttggccagtgagctaagggtctctggtgaaaatggctctctggaaatgcccagcagccatatcttggcagagcgcaaagtcagccccattaaaatcaacctgaagaacctgagggtcactgaagccaatggcaggaacgagattccagggctgggtgcctgtgaccctgaggatgatgagtcaaacaaactggcagagcagctcccaggcaaagtgagctgcaaaaagactgcccagcagcggcacttgctgcggcagctctttgtccagacacagtggccaagcaaccaggactatgactccatcatggcccagacgggtctgccacggccagaggtggtgcgctggtttggagatagcaggtacgcactgaagaacggccaactcaaatggtacgaagactataagcgaggcaacttcccaccagggctactggtcattgcccctggcaaccgggagctcctgcaggactattacatgacacacaagatgctgtatgaagaggacctgcagaacctctgtgacaagacccagatgagctcccagcaggtcaagcagtggtttgctgagaaaatgggggaggagaccagagccgtggcagacacaggcagtgaggaccagggccctggtactggtgagctcacagcagttcacaaagggatgggtgacacctattcagaggtgtctgagaacagtgagtcgtgggagccccgtgtccctgaggccagctcagagccctttgacacatcgagtccccaggctggacgtcagctcgaaacagactgaatttgatctgattaatgtgaaggactggccagtctgggaaaccgcctgccacgtggaagagccaaacccgactctctgctgccacatgccgttcccatgcccggctgctgggcacctgggagagcttccagaatcctcgcagacagcccagagcctgccgctaccctcggcctgcccaccaccaagcaagcagcaagcaagatggggttctcatcagttcttcctcccacaatgtaggacctttcctttaccttccaatggataaaatagttcagagttcatagtcatattcatagacacagaatcaagcttttaacatatacatccacctctatatgttaaataaaacatcagattatcaacactgtcattacgtagaaactttggttagccaagcagtgcattgtcagttacgtcatctctaaaaatgacctgtgtctgttctctggggattgctgggtcacaggtgcccctcaccttccacagtcaggcagggaagttataggcacaaagctacgtctggaacccctttgtgccccctttgtgttcctcaaggaagcagtacctttgaagagatctctgctgcattaagtgatgaccggctacgtttcatgtcaggcttgctttgccttgtgggctactcagtgcagaacctgctgtaaccctcagttcaaaaaatggactggcaatgtgattagcgttggatgctttaccattctctttagttgttaccgtaattctgctttttcatgggagtttgaatcatggaccataacttttcagttatcagatcaactaaagaaacatttgttgttaagcctaatgtgctgacctatgtgcctgcattttttttttaatctagacatgtttggagtgagagaaagatggaaaaaagacatggggtagggacgtaagtggaaatctatagccacagcctgaagctttgaccactgcggttttcagagccctttctccacactcatttcagagcctcctatggtttgggaaggaataacacactggcccattagtaagggtgaaggctggagggatttgttgacttcttggaattatcagaggtagggtggtctttagcacaaagacttgcatgcagagatccctggcagaacacccagagtgcccgtggctcccaccccagggtctggccggtgtgctggatgcatgcccaagggtgctgggcatcactggtccttgtgaggatgcttttaaagttttatatttatgtccccaaacttggaaacaagaactctactttagcctaaccctcatgtccttttttgaattgagaaaattacaggaaatggtgcctttgaaaattagaaaacttgcttacagagctgttctaaatggtaaatcctcaatttccccaagaccggttgctctgagagtagctggtaaagaggggcgaactaaagacctgtccacctgtagctccgctcatttcttagaaaccacctgcttcccagagtgccaagccacaagtaccaggcttcgtgggcacagacacctcctgggctgggcagagtgacagtgctagaagaccccagagagagggcaagggctttgggcaagaagcactggtggtgttttagggaccgtccttctcccctacccagggaactggacctggcagggcaccgtgctcatgtggctccaaggacaagcatggcggtggccccttctgccttccaggagaggtcttgcttttgaaactaaaatcatgttcttctaaagtgtcatcttctgccctccctgtcccaatagggaccacatcttatttgtctcaaacagggacttgtgagtacttggcaagttttgcagcctatttttgtattcttaatttggggagtaaagatgtttggtctcaaaaacctttgaggaattgccaagaatggcgagtgattgctttccttcagagaacagacacttggaatttctccttttagtgtttatatacgtgcagattaatttatatatatatatatacacacacacatatacagtataaatactcatttgattctcgtaaaacgcgcatctggcgtgtgcagttgagaaacttggtggcacatgggtgttgggggagtagcctgtgttggagggacaccagtgcactaggcagctggggcggcccaggctgaagccatctccgggtgtctgagaaaccacccagtgcctcacctccagatcctgctggcatcacctccagagccctgcatgcactggctgaagagttggtctgtggagaggattttcttggttacttgtattcacggttaatttacaacccaaacagcaaaacacagttggtggacaagttcatgcaggacctacagtgacccagccatgggcactagctcatctttcaggtggaaaagtacagtgctgcctgccctggtatgtttttcttatagatgttagccctgcccaacagccagggctacactacaaaaggcaagaatgcccatgtaaggagcccagcagtctggacagatccttcttcctctgctgttggatgagagtgagtgagtatggtctggaccttatccttgaaagatgatcaaaagcgatgatgagggaggcagtcatcacgcaggtgcttaaagggacattgtaggaggtactcaagggtttgggggcaaaaccctgaatccagccagtcgtgcacagagacacacccacactagcccagtggcagtgggggatgtgggatggcagcagccaggtatgtagccctgtcacaggacagctcactgtggttttgcacactgcctaagggttaaattgtgttgttgccttcagtagaaggcatttgtgggctgcagagttgagagttgggtgaggttagtctctcctgaagaaaaagcctataaaaagtggctaatcttatcccttttctctgtatgcagttggactcgtcagagatagtaaaatcatcttttagtgtttttttgttgctgatgtcttgtacccatttgttttttacatggggttgtagatcgagttctcaaaggtgaaaccagatgatcattctgataaaggaaatttaaatttgatacatatgctttgtatattttgattacttgttttcgtttttgactataaaggagctttttttcttgctcagagtttacctgggagatttcaccagtttgactcaccatttgcagatgtgcttttgtattaaatttaaattttcacatatcacatccattctcaaggtagttatatgctggagaagaaaaatcctctagacacatgaaggcccacatagtcaagtcttccagggcaaagccagcagcccacccaggtcaggtagccagcagggctcagttcccctcactccagacacggaccctcctcttcagggtctcttgacccagcttccttctctccttttacctgagagcacagacctctctcagccagcctgcccagaccacggggggctactcccatgtagtttggggagcacttgatctcagaaaagctccattgtctgagcaaatgggcagttgtggagctcaagcctttctcctgtgctcaagtcccttccccaagcaaggcttcaacctcatctacccaccatgtagttttctctggccatttaagtggggcggcagggacatggttgggccatgccacaccagggctggtgaggcaaccagttttgattttgacagagtggctggaggaaaagtggcaatcaaggtgctgcttggtttgctctgagtgcaaatggaaccaacaggtttctgctgcaatctgtgtgttcccagtgccaggtcacaccaggaggggtggggcagggctaaccaagtggtctctgaactcaccgagcgtctgcacttggttgtgaagttaatgggagtacagagagcgtctggccttggagaggggttgagagcctcctttttggttcttcattcctgagctcttgcctgcccacaaatctgacctctttgaatggggacgcagtccttcaacagagaagtttctatggcaaagaagtttctatttagctctagatccagcagagtcatccattctaactgccctgaagtctagagcaggggagggaacccagaggctggggatgagactaggcagaccctggttaccatatggacaaggacaggggaaagcacccccttcctcaatttctgaaagttctatctttgggttcgcaggactttgaggatgataaagaacatataggtactagcttgttgttgctggtccaaagcttccacagccctgagaatttggctttcgtggctgctctggcagctgagcgaagggaggaaggcagccgctctggtggggactctaggcaccttccctgctgtccacttggataggcggtgagccccagggtactgagaggagcctgagcatttacctgccattagtgcctcttccttcaggagactggcttgaaacgtgtgttcatgtgcgcgtgcacacacacacatgagcaactgtatgtgttaatgaatagtttttcttggttaatgctttttaacttctgttcctttccgtaagtggatgattcaaaattaacgtgacttggctgggcgcagtggctcacacctgtaatcccagcactttgggaggccaagggaggcggatcacctgaggtcaggagttcgagaccagcctgatcggcatggtgaaaccccgtttctactaaaaatacaaaaattagccgggcgtggtggtgcgcgcctgtaatcccagttactcaggaggctgaggaaggagaatcacttgaacccgggaggtggaggttgcagtgagctgagatcgtgccactgcactccagcctgggcgacagagcgaaactccgtctcaaaaaaaaaaaaaaaacttaatgtgactggagttaaaagtgaaatgtcaggttgtttagtcactgaatagagagctacaagtgcttggtctttcccaagaatcaaacctgagtagaaatacatttaaaagaaaaatctacatggtacctatgaatcctgtaatttgtttagggagatcttgtcactcatccctggttcctgcccatactgtttggtctcgttcttgcagtttgcttggaacagggccagagccccacatgagattgtcagcaggagtgaggagcgccagtccctactcctcagcagggacccagcacagcaatccggttgttctcggttagactgggtcggggccaggggagaagcagtcacccctgtgtagagggttcccgctgtgcttctgagcagttgctttgttcagaagtgttaggagggtcagattgtgccataattgttattaaagagaaaacacgcccaccttcctttctcccctgctggccattgttcattgagttttactgagggcagcctttgtggaagtcagggaggttgccaaaggcctgtagatgcctcctgacaaggtcttgattcctggttttctagcacccatttgcattttggtcttcagcacaaagccttgttccctgtggccggacttctgggcaataagactggggagtgactgttgagcagtctgctgtcaggagagatggctgaaaaggtgatcatcttggtgctaaacaagtaagaggcaactgccctgtttttgtttgttttgaggcacaatgaaactttagccaaactctgcaagagggtcccatctcctgccatggccaggtgtgagagaccaaaccgagaaaacagcatactctatcacttaagccttgggtagaatgggaattctttaccctgggtaaacgttttaacaaaaaaatggaacttaacttcggtttggactgtggtcgtgctgaggcaggagtggggttgccctcttggggctgaatctccaggcctcacgaggtcccctgtggggatgctgctatttctaagatgcaaattgcacatttcctagattttgtatctgtggatttggataagggaggggaacacggacaaattgcttgtacaatttgaaatgggcctcaatggtacttcaaaccttttgattattcctaaataaaaacataaatatatttc

SEQ ID NO: 14 - DNA, 4608 bp, Homo sapiens
  ref <308>: DATABASE ACCESSION NUMBER: AB007857
  ref <309>: DATABASE ENTRY DATE: 2001-06-18
gcggcgagggcgcgggggctctgaggaccgctcggcgccgcctcctgccacaccatgggcagcgcagaggacgcagtcaaagagaaactgctgtggaacgtgaagaaggaggtgaagcaaatcatggaggaggctgtcaccaggaagtttgtgcatgaagacagcagccacatcattgctttatgtggtgcagtggaggcttgcctcttgcatcagctgagacgccgtgccgctggcttcctgcgcagtgacaagatggcagccctgttcaccaaggtggggaagacgtgcccagtggcgggggagatttgccacaaggtacaggagctgcagcaacaagcagagggcaggaaaccctcaggggtcagccaggaggccctgcggagacagggctcagccagcgggaaggccccggccctcagccctcaggccttgaaacacgtatgggtacgcacggcgctcatcgagaaagttctggacaaggtcgtgcaatacctggcggaaaactgcagcaagtactacgagaaggaggcactgctggcagaccctgtgttcggcccgatcctggcctctcttctagtgggaccctgtgccttggaatacactaagctcaagacagccgatcactactggactgacccctctgctgatgagctggtccagcggcaccgcatccggggtccacctactcgccaggactcccctgcaaagcgcccagccctggggatccggaaacggcactcaagcggcagcgcgtcggaggacaagctggctgcctgcgcccgcgagtgtgtggagtccctgcaccagaactcacggacgcggctgctctatggcaagaaccacgtgctggtgcagccgaaggaggatatggaggcggtccctggctacctctccctgcaccagtctgcagagagcctgactctgaagtggacccccaaccagctcatgaatgggactctgggggactccgagctggaaaagagcgtttactgggactatgccctcgtggtgcccttcagccaggtcgtgtgcatccactgccaccagcaaaagagcggtggcacgcttgtgctggtgagccaggatggcatccagaggccgccgctgcatttcccacagggaggacacctgctgtcctttctgtcctgtctggagaatgggctgctgcctcagggacagctagagcccccgctgtggacccagcaagggaaggggaaagtgttccccaagctacggaaacgaagcagcattcgctccgtggatatggaggagatgggcacggggcgggccaccgactatgtgttccggatcatctaccccggccacaggcacgagcacaacgctggtgacatgatcgagatgcagggctttgggcccagcctgccagcctggcacctggagcccctgtgcagtcagggctcctcctgcctctcctgctcctccagcagctccccacatgcaacccccagccactgtagctgcatccccgaccggttgccgctcaggctactgtgtgagagtatgaagaggcagatcgtgtcccgggccttctacggctggctggcacactgccgccacctgtccacggtgcggacccacctgtcggcgctggtgcaccatagcgttatcccacctgaccggcccccgggggcctccgcgggcctcaccaaggacgtgtggagcaagtatcagaaggacaaaaagaactacaaagagctggagctgctgcggcaagtttactacggaggcatagagcacgagatccgcaaggacgtctggccctttctgcttggccactacaagttcggcatgagcaagaaggagatggagcaggtggacgcagtggtggcagcaaggtaccagcaggtgttggcagagtggaaggcctgcgaggtggtggtgaggcagcgggagcgggaggcccacccagccacacgcaccaagttctcctcaggcagcagcatcgacagccacgtgcagcgcctcatccaccgagactccaccatcagcaacgatgtgtttatctcagtggatgatctggaacccccggagccccaggaccctgaagattccagaccaaaacctgagcaggaagcaggacccgggactccgggcaccgccgtggtggagcagcagcattccgtggagttcgactctccagactcaggactgccctcctctcgcaattactccgtggcctcgggcatccagtcaagcctagatgaggggcagagcgtgggcttcgaagaggaggacggcggtggggaggaaggctccagtgggcccggccctgcagctcacactttgagggagccccaggatcccagccaggagaagcctcaggccggagaactggaggccggagaggagcttgcggctgtgtgtgcggctgcctacactatagaattactggacactgtggccttaaacctgcaccgcatagacaaggatgtgcagaggtgtgaccgcaactactggtacttcacgccccccaacctcgagaggctcagagacgtcatgtgcagctacgtgtgggagcacctggacgtgggctatgtgcagggcatgtgcgatctgctggcgcctctcctggtcaccctcgacaatgatcagctggcctacagctgcttcagccacctcatgaagaggatgagccagaacttccccaacgggggtgccatggacacccactttgccaacatgcgctccctcatccagatcctggactcagagctgtttgagctgatgcatcagaatggagactacacccacttctacttctgttatcgctggttcctgctggattttaagagagaactgctgtatgaggatgtgtttgctgtgtgggaggtgatctgggcagccaggcacatctcatcggagcactttgtcctgttcatcgccctcgccctggtggaggcctaccgagagatcatccgtgacaacaacatggacttcactgacatcatcaagtttttcaatgaacgtgctgagcatcacgatgcccaggagatcctgcggattgcccgggacctcgtccacaaggtgcagatgctcatagagaacaagtgagctggggccaggaggcagcagccgtgcagagcctgggctccggcagggagaggtgcaggggagtcaccgcccagacctccccagccaccaaccgaccccacctctgttcctaacaaagcggttgtgagcctggatccgactcccggcagtgctgaccctgcagggcaagtcaggggccaggatgccctcggatcagggccgggatgggaggggtcagcctcagggagcagctgccttgggggacacacctactctgctcccctctcacacatctgggagtagccccactgccacctgcagccgcagcctggactgctgcccacgagtgaacctggggccccacaggattaacaggggctatagcggcctgggccctactcagctggggtggcagagggcgagaggctctgtgctgtgtcccttctgagggtccctttgcagtcccagtatattgtgcgtgcaccagccccagctggagcaaccaaaactgcttctggtttaggcacacgtcacgggtgcgggagacccgggcacgggagacccgggccgccttcaggccgctcccccgagattctggggcagtcggaagatgtgggccctgggtgggagcagcccacttcagcagcactgccactgcctttggccacctgaggtgacccccaggcctccccggccttgtacagtgtacctctgtgtatctgtacagcctcgctcctgccaccccacccttgcgttctgcattaggtacttccctgaaaaccacgtgtaagaagtgatgcttttgccagtggatgatctggaatgcgaccggagcacttgctctgaggaatcccagggtgactctgtcggggaagaatccggtcacagcctcccctcagagacaggcctcagttcgagggcagcccattatctgtcgcagacatctgccatgtccctgagactgcgggaggcaggggatgcatgggtgtccccatctgtccctggtgagaagcaaggctagctctgccttccacatgcttctcaggatgccaagaggcctaggaacccagaaacccccttggaggagctgtgtatgcgggggtgccaggaagggcatagctcctgcccccaggcctaggcatgctgcttgctcggccatccccacttcctcctctaccccaacacatgcaggctaggccttgccctggaacgtggaggccctgcccggggctggggcctagtccagcagccaccaaagtctggcagactttctgcatttgagaaacatgacaaagggccccgcagcccttctgcacccagcacagcctgcccagcccagccctgcccccgggcactgcacagcctgtctgggggccagaccaccccattgtccatccttgttgtccgtgagtccttggcctccaccaagcacgtgtggccattgtgtgcctgccttagtgactccgtggttttgtgaggagcagagtgtgtatgatttttgcctcagaaactatactcttctgtgtaacagaccaataaacaacatttgtcaac

SEQ ID NO: 15 - DNA, 6467 bp, Homo sapiens
  ref <308>: DATABASE ACCESSION NUMBER: AB007863
  ref <309>: DATABASE ENTRY DATE: 2001-06-18
aaaactcaaggttttctcacgatgagtcggaggaggatatcgtgtaaagatctgggccatgctgactgccaagggtggctgtataagaaaaaggaaaagggaagtttcctaagcaacaaatggaaaaagttctgggtgatactgaaggggtcgtcactgtactggtatagcaatcaaatggcagagaaagctgatggatttgtcaacctgcctgatttcactgtggaaagagcatctgaatgcaagaaaaagcatgcttttaagatcagccatccacagatcaagaccttttattttgcagctgagaatgtgcaggaaatgaacgtgtggttaaataaacttggatcggctgtaatccatcaggaatccactacaaaggatgaagaatgttacagtgaaagtgaacaggaagatccagaaatagctgcggagacaccaccccctcctcacgcttcccagactcagtctttgactgcacagcaggcatcttcatcctcacccagcctgagtggaacgtcgtattctttctcttccctggaaaatacagtgaagacacccagcagttttccttcctccttatctaaagagagacaatccttgcctgacacagttaacagtttgtctgctgctgaagatgagggacaaccaataacgtttgctgtgcaagttcattcacctgtaccctcagaggcaggcatccacaaggccctggaaaacagttttgtcacatcagaaagtggatttttgaactctttatctagtgatgatacttcttcattgagtagcaatcatgaccatcttactgtcccagataagcctgctggatcaaagatcatggacaaagaagagacaaaagtgtctgaagatgatgaaatggagaagctgtacaaatcattagagcaagctagtctatctcctcttggggaccgacgaccttcgactaaaaaggagttgagaaaatcctttgttaagcggtgtaaaaatccatctataaacgagaaactccacaaaatccgaacattgaatagcacattaaagtgtaaagaacatgatctggccatgattaaccagttgctggatgacccgaagctgacagccaggaaatacagagagtggaaagtcatgaacaccctgctgatccaggacatctatcagcagcagcgggcttcgcctgcccctgatgacactgatgacaccccccaggaactcaagaaatcaccttcttctccctctgttgaaaattccatttgagacaaagtcagggttttctcctcttatattttatcacaagcaactcttcaagatgttgcaaaagcttacatttttccttaaaaggaaaactgaaacccagtccttcaagcatcagcttcccatctaaagatgcacgttagatgaagataatcaccgaatacaccagggctcctcatttcagtcgtaacgcatccattgagattggaatgattgagttcagttgaaaggcgttttttgtgttcctactgggagctcacggtgatgtggggctctaggggggatgtgagaaatgtctcttctgttcattgctctccagagaatgctatggacaagaatcaaattttaccaggagtaattgcccatggaaacattctgtttttcaaaagaagaatgtacatattccacttgactgggaagctgtgtggcccaaatcactgtttgagtggaggaatgttttctagagcagtgactggaaggacaaacgtggtgttgcagaacaaaaattccttgcctttggtatggaatggtggtgccttttccatgtgatgagaaatgcttcatagacagtggcatgtgggagagctgaaggaggaggcgtgttccatattccactcattcaaaggacagcttggtgttttcacactttatgcaggttaggggatctgattaatgtttcctttccttacaacagctagagaaaacatctcatcacaattggagacctctacttcctttgagctttcctactcaatggtaggagataggaatatgttccgcaaagaatgtctactgctcttgtccttggctgtgatccctatacatagtgtgaatttatatccaggtttcccaggatcaatattgacaagacgactttggcatctgaattgttttaatatctttactcaaaaaaacaaaaaaacaaaaacccatggaagcaacaaaagagttaaacatgagggatttatttttgtatgtttatatgtcacttgtgtgctatgtgaatagctatgtttgttatttaaatatatttatagaagttcaaattactagtgtttaaaagatgatatactattatatattgtgcttagtatatatttgatgagtctatactttttgcttgagaaaaatagaaatactattgattcactggtgttatgatgttgcactgtgtctgaggaatgctcaggaaatcttgtgggaaaaaaatggggcatgcattcataatttttcattttcttccccaccccaacccccatgagctcttaaatttagatttctatctcttgtaagtcactcttttaaccagcaaaggactttcatcttagattatcctttctattaaataaactttaagctttgtgccatttatgcctgcaaaccttagaccaaaggcaacacaactaatgtcatcttttcattaaagactaatagaaatttagaaatcattgtgttaaagagagctatagagaaacaatatgaaagtcttcccttactaatcaccatgaatatttctcaccataggaataaccacaacccaccaagtacccatgttggccctgcctacccgtaacaaattgttcacacaacctattttgttttatagcttcaaagtgtggcttgacattcaatggaaggaaccacctgaattatatctgcaaacaaaatggaaatagttgttgaatagttccccaagctttactaagaagccttaatactctgtaaacaaacaaacaaacaaaaaacaaccttagcattaagaaataaaaacaaaaaacaagaagcaagttgtactgctagaaacttctctaagataagaggccaggccagtcagtttggcccagcaaacatgtgggtacttctccacctagggaagccactgaagatgagtttgacctgtggtgacctgacagagagaacattcagatcctcagattgcaccctgatgccctggtttaggaaagcagtgctttaaccttttgcccctggaaattactgattctttctgtgattagcagataccagaagggaaattatttaggattggcaatgtaaagagtattgaaggaacaacaaataacaatagcagaaataacagtgtgacataaagtgcccttccacctatttttctttggtttgcaacaccagcctgtagacttccagtttttcttaaattgaagagctccagacacttttgagcagggtttgtgaatagctttgaatgctttcctttggcttttcgtgaagacatatttccccagcctttcaactgtaaactcctttagtaccattgaaacttaaggcaaaaaagatccctgggattacttagccaaggcttaaatttatttttcaaagtcaagaacattagcctagaagtttttgctttgctagttaaagcttactttgcagagcttcccaaagtgaaagggaaactgaacttcacaattttgcacctggctttctggagccccattgcctgctcattcgtgtttttccccctgtaaattattttgcttttgaccaggttgtgctagaaagtagggctgcttctgtgagttctcagcctaggctgtggccactaagacgtgggtggggggatagacaggagtgagagggagagtgggtgacactttccgtgacacttaatgtaggaagacatgggcttctctctcttggcctcaagccacttttctggtccaaagaatattgggaaaactggattactttcagtatatttcttgagaccgggtcatctctgaaatgcatttggggtagtttcctggggtccaagggccaattcctatacccagtcctgcagtgtctgtgagctgtggaatgagagagaaaaccatggctgctcaggaaggaagtggagaatctctcagcacacgtagatccaaatctgtggcacctgctaaagattaggatttggagaggactcctctttggggttgtgaagaggaccttttccctctgttgttagcctgtagatccagaacggagcctgatgtgatgccttcactggttgatatattgcaaatagacactctgagccctgcattgcaagggcgtcttttgctttaaagaattcttagttttgccacaacagctcaaatctcagaataggatcaaaggcctagaaagactcctaaagtataggattacaaagactccaggaagcgtaagaaagagattgtgtttggagtcagatttcaatgtgaaacccatgccttacatttacacagcactttgtagtttgcaaattggtgtgttttcagccccctcccgctgccccatgctctgagatgattgtggattattacagtgaagtgcctggcccggagcccccagtgatgaagcaggaacttgagtctcaggactcccagcggctctctgcccatttcctcctctccgccccccacctcgcttcacctgttaccttgtgaagttgctgttggcacatagcccactaggaaaccaagaagtttgactgggagcgtgtgtttcattgcactgggcttagcatacggctggccctggtggctgtttggctaaattctccatttgaaacctaaagggccctctctgtgcttgagcacagtctcctcctagtggtcctgcctcaacctgctggcgggctgtctatggattggggtttcacctaatcatgctgtgtttcctttcttttctttctgtacattagactacttgggaggtgctgtgtgatccttggatgaaaaacatatatttaaagaaatggagagtgtttattttgtttgctttttgaggcatgtgctgtcaaatgttagagaccaaacttagtgattagaggttggtcctttgaccttcttctcttaattgcttttcatgtaatcatgataatttactcaggtagcactccagtcacaaacaatgtcacagagatgaaacagattcaaagaaaaaatatttttaagtcttttgaaaagaagtgctattcaaatttaagacatgtttaaattcataggtacattatctcttagtaagaaatacttttttttttctttttttagacagagtcttgctctgttgcccaggctggagtgcagtggcacgattttagctcactgcaacctctgcctccctggttgaagtgattctcctgcctcagcctcccgagtagctgggactacgcccggctaatttttatatttttagtagagaccggggtttaccatgttgcccaggctggtttcaaactcctgacctcaggtgatctgcctgcctctgcctcccagagtgctgggattacaggtgtgagccaccacacctggccgaaagacagtattttgatatagccacatacatgatttaatgagtaatgttaagtacagaaaagctgccatatccacatagttttagggggcatttcttcttcagtctaacaagaatatgatatccaattgtggttttccaatttatttctcttccaatttcttttgtatacctcacaggagaaattgaatcctagaactgggagatgactgccctgcccagggttttgtaatacataattgaaaataaaagtccctgaaactaaatgtttgcagcctgtatgaaatggactgtggaagggggataatttctctcctcacagaaagccactcgtctccttgaatgaggcattgagcagacacacgtttctctgtgtcgtggggcaggaagcaattcccttgcctcttcagcacatctcagttctttcccacatgaccccagaaccacatagaaaacattgaaaataatggattcttcattgtatttgaattttttttttttaacctttagcccaaaagggaagtgtgcctcgtggaaagagcaaatgccgtaaaatagaaaccaggagttttaatcgccatatattttaatgtgcttgcatgatgggaatgtgacttttagcactgcatggtgtttgggggcaagatattaatgtggaaatcttagcttaagttttactgtgctctcatcctgtgtcagctacccctctaaactgaaaaagaggcatggctcatttctctcctgctttatgtttttgaggttgacttgtaagataaaaataaaaataagaaaaaaatatatctaggcaaatgacatgaaaaaaaagttgaaatatactactggtgttcatttttgtcctgcagtgttgctttctcaaagaaataaacatgtggctggaagtgttt

SEQ ID NO: 16 - DNA, 5960 bp, Homo sapiens
  ref <308>: DATABASE ACCESSION NUMBER: AB007883
  ref <309>: DATABASE ENTRY DATE: 2001-06-18
cgcagtcgtccttccgccccagagaccgatgatagtcgagttgggggcattatgagaggagagaaaaactactacttccgtggagctgcgggggaccacggttcctgccccactacaacttcgcctctggcctcggccctcttgatgccctcggaggcagtctcaagcagctggtctgagtctggaggcggtttgtcagggggagatgaagaggacactcggctccttcaactcctccgcactgcccgggatccttctgaggccttccaggctttgcaagctgctttgccgcggcggggcggtcgacttggcttcccccgacgcaaggaagctttgtatcgggcactgggccgagtgcttgtggaaggaggtagtgatgagaagcggctctgcttgcaacttctctcggacgttctccggggtcagggggaggcaggccagcttgaagaggcctttagcttagcacttttgcctcaactagttgtctcgttacgggaagagaatccagccctgcggaaagatgcgctgcagatccttcatatatgtctgaaacgtagtcctggagaggtgctgagaacgcttatacaacaaggactggaaagtaccgatgcccgacttagagcttccacagcactactgcttcccatcttgcttactactgaggacttgttgcttggtctggatctcaccgaggtgataatatccctagcccgaaagcttggtgatcaggagacagaagaagaatctgagacagctttctccgcacttcaacaaattggggagcgacttggccaagacaggtttcaatcttacatttctcgtctgccctctgccctgaggagacactacaatcgccgcctggagtcccagtttggaagtcaggttccttattatttggaacttgaagcctctggatttcctgaagatccccttccctgtgcagtgactctttccaacagcaatcttaaatttgggattattcctcaggagctgcattcacgattattggatcaggaagactataagaaccggacccaggccgtcgaagaactaaagcaggtgctgggaaaatttaaccctagttctactcctcattctagtcttgttggcttcattagtttgctatataatttgttagacgattctaacttcaaagtggtgcatggcacacttgaagtcctgcatttactggttattcgccttggagagcaggtacagcagttcttgggaccagttatagcagcttctgtcaaagtgctggcggacaacaagttggtgatcaaacaagaatacatgaaaatcttcctcaagctaatgaaggaagtaggacctcagcaggtgctttgtttactcctgaaacatctcaaacataagcattccagagtgagagaggaggtggtgaacatttgcatctgctccctgctgacctatcctagtgaggattttgacttgcccaaactgtcctttgatcttgccccagctcttgtagatagcaaacgcagggtacgccaagcagctttagaagcttttgccgtattggcatcatcaatgggctcaggtaaaaccagcatcctttttaaagctgtggatacagttgaactgcaagataatggagatggagtgatgaatgctgtgcaggccagattggctaggaaaaccttaccaaggctcacagagcagggatttgtggaatatgcagtactgatgccatcttctgccgggggtaggtcaaaccatttggcacatggagcagatacggactggcttttggctggtaacagaactcagagtgcacactgtcactgtggtgaccacgtgagggatagcatgcacatttatggatcttacagcccaactatctgtacccgaagggtattaagtgcaggaaaaggaaaaaataaattaccatgggaaaatgagcaacctggaatcatgggagaaaaccagacctccacttccaaggatatagagcagttttcaacatatgatttcatcccatctgcaaaattaaagctttctcaaggaatgccagtcaatgatgatttatgttttagcagaaaaagagtatcaagaaacttatttcagaatagtcgggattttaacccagattgtcttcctttatgtgctgctggtactactgggactcatcaaacaaatctttctgggaaatgtgcacaacttggattttcacaaatatgtggtaaaactggcagtgtgggttctgacttacaattcctagggacaactagcagtcatcaagaaaaagtgtatgctagcctcaattttggcagtaagacacagcaaacatttggtagtcaaacagagtgtacttcctcaaatggtcaaaatccaagtccaggagcttacatccttccatcctatcctgtctcatcacctcgaactagtccaaagcatacatctcctcttattatatctccaaagaagtctcaagataattctgttaatttctcaaattcctggcctcttaaaagcttcgaaggactatcaaagccaagtccacagaagaagcttgtcagccaaaaatcgtctgatcctacgggtagaaatcatggagaaaattctcaagaaaaacctccagttcagcttacacctgccttggtgagatcgccatcttcccgacgaggtctaaatgggacaaagcctgttcctcccataccaaggggaataagccttttgcctgataaagctgatttaagcacagtgggacacaaaaagaaagagcctgatgatatttggaagtgtgaaaaagatagtcttccaattgatctttcagaattaaatttcaaggataaagatttggatcaagaagagatgcatagctctcttaggtcccttcgtaatagtgcagctaagaaaagagcaaaactgagtggcagtactttagatcttgaaagccctgattctgcaatgaagctcgacttgacgatggactccccgtctctgtcttcctcaccaaacatcaattcttacagtgaaagtggagtttacagccaagaatcattgacttcttctctgtctacaactccccaggggaagagaataatgtcagacatatttccaacatttgggtcaaaaccttgtccaacaagactttcttctgcaaagaaaaaaatttctcatattgctgaacaaagccccagtgcagggtcatcatcaaatccacagcaaatttccagttttgacttcacaaccacaaaggctttatcagaagactcagtagtagttgttggaaaaggcgtatttggaagtttaagttcagcaccagcaacctgcagccaatcagtgatatcttctgtggaaaatggggatacattttcaattaaacaaagtattgaaccaccatcagggatttatggaagatcagtccagcaaaatatttcatcatatcttgatgttgagaatgaaaaagatgctaaagtttctatttctaaatctacttataacaagatgagacaaaagagaaaagaagagaaagaactgtttcacaataaagattgtgaaaagaaggaaaaaaattcctgggaacgaatgagacatacaggaactgagaaaatggcatctgaaagtgaaacacctactggagctatttcacagtataaagaaaggatgccttctgtcactcatagtccagaaataatggatctgtcagaactacgaccattctctaaaccagaaatagcactgacagaagccctgaggcttttggctgatgaggattgggagaagaaaattgagggactgaattttattagatgcttagctgcttttcattctgagatactgaacacaaagttgcatgaaacaaattttgcagttgttcaagaggtgaaaaatttacgttctggagtttctcgtgctgctgtggtctgtttaagtgatcttttcacttatttgaaaaagagcatggatcaagagctagataccacagtaaaagttttgttgcacaaggctggtgaatcaaatacatttataagagaagatgttgacaaagcattgagagctatggttaataatgtaactcctgcacgtgcagttgtttctcttatcaatggtggacaaaggtattatggtcgaaagatgctgttcttcatgatgtgtcatcctaactttgaaaaaatgcttgaaaagtatgtcccatctaaagatttgccatatattaaggactctgttagaaacttacagcaaaagggtttgggggagataccattagatactccttcagcaaaaggaagacgatctcatactggcagtgttggaaatacaagatcatcatctgtttctagagatgctttcaattcagctgaaagagctgtaactgaagttcgtgaagtcaccagaaaatcagtccctcgtaattccttagaaagtgctgagtaccttaaactcataactggcttattaaatgcaaaagactttcgtgatcgtattaatgggattaagcagcttttatcagatacagaaaataatcaagaccttgttgttggaaacattgtgaagatttttgatgcttttaaatctcgacttcatgattctaatagtaaagtaaatctggtggctctggaaacaatgcacaaaatgattcctctacttagagaccacttatctcctataatcaacatgctaattccagcaatagtggataacaatctgaattccaagaatccaggcatctatgcggctgctacaaatgttgttcaggcactgagtcagcatgtagacaattacttacttctacagccattttgcacaaaagctcagtttttaaatggaaaagcaaaacaggacatgacggaaaagcttgctgatattgttacggaactttatcaaaggaagccgcatgccacagagcagaaagtgttggttgttttatggcatctcttaggaaatatgacaaatagtggctctctgcctggagctggaggaaatatacgaacagccacagctaaattatcaaaagcactctttgcacagatgggtcagaatctgttaaatcaggctgcatctcaaccaccacatatcaaaaagagtttggaggaattactcgatatgacaattttaaatgaattatgaatcttcgataaaatactgtatgatgaacaaaagtgtttacatgatgacaaatggaactttctaaaagttatgttatcagtgcctgcacttcacatccagcaaattaagtcaatggctatttttatttgcagcctatgagtacacatctgtcctatatcaaccttaccacttatattcatcacataaaaacctaaaatattcatgaataattcatgaaatctgagtcacatgggatgaattcaattttaatatttttgagaaaagtcctgctcatttgcactattctatagaaactacaatttgttgccctatatgtaaaattagaattgtaattaaaaatacacattttattatgtaatcatgttctggtatgtctcatttctcagccttattttataacgtggaagtcattgaactatgttatcagaaactaagtttgtatattatttgtgaaaaacatgtatttctgaatcagtccgctaatatgattgtgcagtattagcttgcttttgctgctgtgttaatgtcatatatttgcttaccttttgggttcaattatctacataattgtgaaatttaacaagttataataaagcatgacaaccaaagttttagaaaacattaaacattttaaatgcacgtttaaaaaacgtgttgaatgtaacccccctatttttgtgtgcaaacactaaattttattgctttatgttttgacctttataaaggtgttattctgctgcccagttttgtaattctcaaaaatagtgccaggtcttctatagcttttttcagaattcatgggcttacaagtactgtatgcatctttaaaaagaaaaggaatgttataaaataaaaggatttatttcttt

SEQ ID NO: 17 - DNA, 4661 bp, Homo sapiens
  ref <308>: DATABASE ACCESSION NUMBER: AB007896
  ref <309>: DATABASE ENTRY DATE: 2001-06-18
gctggacttgcctgcggtgacacctgctcccctctgagagcttcaggttctccggcctgccttcactggtttgtgtccagagccggactgattctctcaatttgcgatcttcagcctgttaaacaagaaaacgaaaaaccccttccagaaaacatggatgcatttgaaaaagtgagaacaaaattagaaacacagccacaagaagaatatgaaatcatcaatgtggaagttaaacatggtggttttgtttattaccaagaaggttgttgcttggttcgttccaaagatgaagaagcagacaatgataattatgaagttttattcaatttggaggaacttaagttagaccagcccttcattgattgtatcagagttgctccagatgaaaaatatgtggctgccaagataagaactgaagattctgaagcatctacctgtgtaattataaagctcagcgatcagcccgtaatggaagcttctttcccgaatgtgtccagttttgaatgggtaaaggacgaggaagatgaagatgttttattctacaccttccagaggaaccttcgctgtcatgacgtatatcgagccacttttggtgataacaaacgtaatgaacgcttttacacagaaaaagacccaagctactttgttttcctttatcttacaaaagacagtcgtttcctcaccataaatattatgaacaagactacttctgaagtgtggttgatagatggcctgagcccttgggacccaccagtacttatccagaagcgaatacatggggtcctttactatgttgaacacagagatgatgaattatacattctcactaatgttggagaacctacagaatttaagctaatgagaacagcggctgatacccctgcaattatgaattgggatttattttttacaatgaagagaaatacaaaagtgatagacttggacatgtttaaggatcactgtgttctatttctgaagcacagcaatctcctttatgttaatgtgattggtctggctgatgattcagttcggtctctaaagctccctccttgggcctgtggattcataatggatacaaattctgacccaaagaactgcccctttcaactttgctctccaatacgtcccccaaaatattacacatacaagtttgcagaaggcaaactgtttgaggaaactgggcatgaagacccaatcacaaagactagtcgcgttttacgtctagaagccaaaagcaaggatggaaaattagtgccaatgactgttttccacaaaactgactctgaggacttgcagaagaaacctctcttggtacatgtatatggagcttatggaatggatttgaaaatgaatttcaggcctgagaggcgggtcctggtggatgatggatggatattagcatactgccatgttcgaggtggtggtgagttaggcctccagtggcacgctgatggccgcctaactaaaaaactcaatggccttgctgatttagaggcttgcattaagacgcttcatggccaaggcttttctcagccaagtctaacaaccctgactgctttcagtgctggaggggtgcttgcaggagcattgtgtaattctaatccagagctggtgagagcggtgactttggaggcacctttcttggatgttctcaacaccatgatggacactacacttcctctgacattagaagaattagaagaatgggggaatccttcatctgatgaaaaacacaagaactacataaaacgttactgtccctatcaaaatattaaacctcagcattatccttcaattcacataacggcatatgaaaacgatgaacgggtacctctgaaaggaattgtaagttatactgagaaactcaaggaagccatcgcggagcatgctaaggacacaggtgaaggctatcagacccctaatattattctagatattcagcctggaggcaatcatgtaattgaggattctcacaaaaagattacagcccaaattaaattcctgtacgaggaacttggacttgacagcaccagtgttttcgaggatcttaagaaatacctgaaattctgaaacactgcattcaactgggaattggaaacacactgaaatatttcatagtcttacttccaattgagttagcaaaaaaaaaattaataacttgagacttttaagttattaattttttaaaatgtgcttctccatctaaattttgcttagtctacatctcacttgcttatactattcctccattgatgcacatgcccattaacctaggaaagtagttttcaaatcatgctccttagaaggatgtggagtagagggaagggaaggattggtgatagcagagctccaggcctcccttccagtcagaacagttgagcagtttacaaattagtgtcctgcctctttgctagcaaatgcttttagacactgtggcagtgagtcatcctctaatttctatgactgcattttaagggaaaagataaaattcttccccttaaaattcgttaaagtttttgaataatctggggtcctaatgtgttctggtcatccctgattgatgctatctgaataaagttataagctcctataagccataatttacttttaaacattttatttttttcaaaacatttgagaacctttcttaaagcggttacattcaagctacagaaatatcgaagaattaatgattgttcaccaagcagcatgctgtacatgaagctattacaaatgcttacaatcccactgaaatgccagtgtcttcatctcttcataaaggtgcctaacacgaggtatacagtatgttcagtacactggaatagcatgctcgattggaaacaaagcatctatctctgaaagctgtttggcgatgaaggagattcttcgtgttgtgttcaaagatgagtccctctcccttgtccagaaaaatgccacttgtatcaactttactgcctttgtcggcagaattggtacttaaccttattcttattttagcgggaaggcccgaaatcatattatgtagatttaacagtgttgattctccaaaattcagaaccacgataaagattctgtcgatgccatccagctctcttgtgtacacaacatagtggctgtcattcctcaaatggcaaaaccagcccctgttgaggagtagctcattggcatgaagtagacttaaatcttgatataacttcaaagccgatctgggctgagtcttttggacctatttttttaaaaaagtatttacgtaagtgtttgattctaagaattgtttgtaagtatttttaatatattgtaaggagttatttacccaaaacacttgctccaattttgccccttataattgccaaattgtaagcatcaataagtaggtaagaacaatttatataaaaactgatagaaatgacaaattcggggtttcggcttgtccgggagtcaataagtacgcacagtgctctgctacattgtagagtttctgtagagatcaaatttgactccactttaggagtcccaaagcaaatgtccatgtctaagatgaatatttaacttgcatagtcattctgtgctatattgtaactgccagatggccagaaagaaggcaacagtggactcagacttctgaggaatttgggtttgttcccctttgtagactaatgtgtaggttgctgttgtgcgaagatcgtgtaactttagcagacatgtatttcttgcacagctaatagaagacaaagttgaaaaaaaggatgcaaaataaaaagctgcctaaggtgaaagttagaaattgtagacttttttttaccataatagtatgtgttcattgaagatgatttgggtttattttacagctatataaaacataatttgatgatgtacttctaacctttcaagcattttctgttattgactatataatatagcctccataaatgtttttaatgacaatattctgttgaacggttgtaccatactcagccatgccctttcattttgacgatagtgtttctaatattttgtatttttattcccctccccccatttttgtattacttaagatagattatcagaaagacagttactttgtcaaagagtatgggcacttgatacataatgccaaattattcttcataagagctgttgccaaatcagtgataatgttcatttaattgtattcttgccagccatgtttactggggtgatagttgttattgtggttgttattgttctttaggggtaggttcccaatatgtggtctttaaataattatctaatggtgtttaaaaagatgtttattctgtttgtcaggtacaaagatatttatgatacatgtatgacttgtctaagttattaacattttctctagccttaggtaatgcatgaaagcacatgtttcagtgccactcacataagaagtgcccggtaagtgttagctattattgtctacttgagttactactttctaaaagtatgttgaagtctttttctgtaattgcagatttgttgattttgcatttgagtattttctatattttgaagctgttagatgcatagtcatgatttttggtggaatgttttatcaatttttgaaaattgcctttgtctcatataatgcttttcatattgaactatattttgtctgctattaaatacttccaagcctg

SEQ ID NO: 18 - DNA, 4879 bp, Homo sapiens
  ref <308>: DATABASE ACCESSION NUMBER: AB007899
  ref <309>: DATABASE ENTRY DATE: 2001-06-18
gcccgggtgggtggctgcgcagggccctacctgggcgggagcggctgcagagccctgtccacgcggtgcctccccagcacggcacctcccactccaggctgttggttacctggccgggagctggcagagaccaggatttctcctcgccgccgttgctgttgttaggggaaacagaccatctgcatctagacctgcctctctctccgctccccacttcagacgagctcttcctgcctggaatctgtgatccgtatgtgaaactttcattgtacgtagcggatgagaatagagaacttgctttggtccagacaaaaacaattaaaaagacactgaacccaaaatggaatgaagaattttatttcagggtaaacccatctaatcacagactcctatttgaagtatttgacgaaaatagactgacacgagacgacttcctgggccaggtggacgtgccccttagtcaccttccgacagaagatccaaccatggagcgaccctatacatttaaggactttctcctcagaccaagaagtcataagtctcgagttaagggatttttgcgattgaaaatggcctatatgccaaaaaatggaggtcaagatgaagaaaacagtgaccagagggatgacatggagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatggacgtgtcctcggagtcggacaataacatcagacagatcaaccaggaggcagcacaccggcgcttccgctcccgcaggcacatcagcgaagacttggagcccgagccctcggagggcggggatgtccccgagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattcaaagagaaccctcctcaaggttgaggtcatgcagtgtcaccgacgcagttgcagaacagggccatctaccaccgccatcagtggcctatgtacataccacgccgggtctgccttcaggctgggaagaaagaaaagatgctaaggggcgcacatactatgtcaatcataacaatcgaaccacaacttggactcgacctatcatgcagcttgcagaagatggtgcgtccggatcagccacaaacagtaacaaccatctaatcgagcctcagatccgccggcctcgtagcctcagctcgccaacagtaactttatctgccccgctggagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggaagatccacgtttgaaatttccagtacatatgcggtcaaagacatctttaaaccccaatgaccttggcccccttcctcctggctgggaagaaagaattcacttggatggccgaacgttttatattgatcataatagcaaaattactcagtgggaagacccaagactgcagaacccagctattactggtccggctgtcccttactccagagaatttaagcagaaatatgactacttcaggaagaaattaaagaaacctgctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacggacaactacacccttcagatcaaccctaattcaggcctctgtaatgaggatcatttgtcctacttcacttttattggaagagttgctggtctggccgtatttcatgggaagctcttagatggtttcttcattagaccattttacaagatgatgttgggaaagcagataaccctgaatgacatggaatctgtggatagtgaatattacaactctttgaaatggatcctggagaatgaccctactgagctggacctcatgttctgcatagacgaagaaaactttggacagacatatcaagtggatttgaagcccaatgggtcagaaataatggtcacaaatgaaaacaaaagggaatatatcgacttagtcatccagtggagatttgtgaacagggtccagaagcagatgaacgccttcttggagggattcacagaactacttcctattgatttgattaaaatttttgacgaaaatgagctggagttgctcatgtgcggcctcggtgatgtggatgtgaatgactggagacagcattctatttacaagaacggctactgcccaaaccaccccgtcattcagtggttctggaaggctgtgctactcatggacgccgaaaagcgtatccggttactgcagtttgtcacagggacatcgcgagtacctatgaatggatttgccgaactttatggttccaatggtcctcagctgtttacaatagagcaatggggcagtcctgagaaactgcccagagctcacacatgctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcatttttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtaact

SEQ ID NO: 19 - DNA, 5932 bp, Homo sapiens
  ref <308>: DATABASE ACCESSION NUMBER: AB007916
  ref <309>: DATABASE ENTRY DATE: 2001-06-18
ggggcactgaggagcggcgcccgcggggcagcgaggagcccgatgcagggttctgcgcgtcatttccggtcccgcgggcgccccgtgaagcccacctggatccgccagcgctgtgccactccccagtgccgagctccgagctgtctccgcggcctcgcgcccggcccctccaccgcgcacctcttaggccccgcccgccagcgtccctttgttgtgaaggcgccggggcctagcgctatgcctgcggcggagactgcatcaggctctcgcgtctgcttctgcgctttgcctgggagaggccctggtggcctcgttcctggcgcccggagtccctgctgcggccccacccccgggcggtcacggtgacccatgctgcccagcctggaggtaaaatcgttcgtggctgtggcttcagcatgtcgtcctcggtgaaaaccccagcactggaagagctggttcctggctccgaagagaagccgaaaggcaggtcgcctctcagctggggctctctgtttggtcaccgaagtgagaagattgtttttgccaagagcgacggcggcacagatgagaacgtactgaccgtcaccatcacggagaccacggtcatcgagtcagacttgggtgtgtggagctcgcgggcgctgctctacctcacgctgtggttcttcttcagcttctgcacgctcttcctcaacaagtacatcctgtccctgctgggaggcgagcccagcatgctaggtgcggtgcagatgctgtccaccacggttatcgggtgtgtgaaaaccctcgttccttgctgtttgtatcagcacaaggcccggctttcctacccacccaacttccttatgacgatgctgtttgtgggtctgatgaggtttgcaactgtggttttgggtttggtcagcctgaaaaatgtggcggtttcgtttgctgagacggtgaagagctccgcccccatcttcacggtgatcatgtctcggatgattctgggggagtacacagggctgctggtcaacctctccctcatcccagtcatgggcgggctggcgctgtgcacggccactgagatcagcttcaatgtcctggggttctcggccgcactgtccaccaacatcatggactgtttgcaaaatgttttttcaaaaaagctgctcagcggggacaaatacaggttctcggccccggagctgcagttctacaccagcgccgctgcggtggccatgctcgtcccggcccgggttttctttacggacgtcccagtgatcgggaggagcgggaagagcttcagctacaaccaggacgtggtgctgctgcttctgacagacggagtcctgttccaccttcagagcgtcacggcgtacgccctcatggggaaaatctccccggtgactttcagcgtcgccagcaccgtgaaacatgccttgtccatctggctcagcgtaatcgttttcggcaacaagatcaccagcttgtcggccgttggcacagccctggtgaccgttggggtcctgctctacaacaaagccaggcaacaccagcaggaggcgctgcagagcctggctgcagccactggccgggccccagacgacacagtggagccgctgcttccacaggaccccaggcagcatccctgagagcaggaagctgccagctgctgctgtcctcgtgacactgcatcccccagaaatgggcagggacgccctcctccatggccctgctggggtgcaggacatggggagctaagttggccattgcctgcggctttctcggtttgtcggtgaagaccagcagaaactcaaactggggattccaggtatcagcttcctggagtagacaccagaccagtagctgactgtgtccgccgagcccatccccgtgtaatgtgaaaacagcctctgaggctcccatgctgggggtgcccacttcctctctgggcgacaccccagggtccaccgggagccagaggtgggtccagtgccaacgagagccgctccctgccacagccaagagagccctcggcttcccacaccagccatcgaaggccctgaggccctggaccggcggcagactggccctgggcatgaggccacagagcagggccgaagggaggggacagagggccctggaaggaagggtctcctgctgccacggtgggcactcagaacttctccccacctgacccagggctgtgggcatcctcagactatcccagaggcatcgcaagcctcaagctgcagcattgcacggcactcaagggctatgaccacggaggccgttcagtcgcttctgtttagaggaaggccccctacctcttccacaccctgccctcctatcccttccacaccctgggctgcatgagctccccgcaaccccagggcaccctgccctcctacctgtgggggtttccagccctgaggttgaggacaaacctctcgtgtttaacttgggaggagatgtgtacgttccttttcttttttggactctgagtatgaggcaggctgttctgaggtccccgtggggtgagcctgtctgtcctccctcagagcccaccgttcctatcatcatctagcacctgtccggttccccacgtgagccttgggcaggacgctgcagtgttgatggtttgggttacgtggcgtttacctgggcgccgtccttgctgaaaaaggaaacgtccacactgaatgtttctggggcgcgtggtgtgtgtcaggcgcccaccctgtcccactctccccaagggacagtagtacggcacactggggccaccagccagctcaactcatcctcctgtgtcacgcacccccgagggcgcaggaggcctgaggagtggctactggagccgtgtgttaggcagaggcttctgaccatgtctgagctctttacccccaatctcgcaaccggcggattcccatgcccggtgcagcctgttgccagccagcctttgagacccagagctccagggcttgtcagaggcagcatggggctccagtggtcccgagtctcatttccctgcctgctctttaggcctttggcacccatggtcacttcactggttttccatttggcttctcacctgggaaatacaaaaatagcccctcctgaagataaaatcgttcagaaacagagcaataattctgactcattaacttctacctactcaaaaaagtctgccatgatgatggaccgaagtgaggctttttaacccacaagtaacctttttatttttttgagacggtcttgctctgtcacccaggctggagtgcagtggcatgatcttggctcgctgcagcctcgacttcctgggctcaagtgatccacctcagcctcccatgtggctggaaccgcaggcacgtgccaccatgcctggctatttttttgttgagctgggctctcgctttgttgcccaggctggtcttgaactcctcggctcaagcaatccttcccactcagcctcctgtagtgtcgagaatataggcgtgggctactacacctgcttcagccgcttctataaaaccgctgacctgtgtgtggaggacaggccaggtgtgtgctcactgcgctgcgaagatgttttgtcacgtgactttccctgggtttccatttctttttttctgctttcctcaaaaactaatagaagaccggctgcggtagctcaggcctctagtcccagcactttgggaggctgcagatggcggatcacaaggccaggagttcgagaccagcctggccaacatgatgaaaccctgtctctaccaaaaatacaaaaattagctgggtgtgatggtgggtgcctgtggtctcagctactcaggaggctgaggcaggagaattgtttgagccccagaggcggaggttgcagtgagccaagatcgtgccattgcactccagcctgggcaacagggcaagattccgtctcaaaaacaaacactattagaaaatgctctggaggtggcggggagttgttgatttgtgaggacagattgaaagcaactcccagggtggccttgtccacctccccatcgagaatatggctgccggcctctttgaagattgtggtctggcataaggagaggtgcaggcgcctggttctgagcaccttggaatttccagccgcacagcatctggtgccctcccctccaccctcacaaggagctgccatcctgtttggattttctgtttgtggaccagaaacaaacgtttttccaaaggattagcaaataggttgatttcctgtgtaacgctgctctggggcctcttcctcatcctggcagaaggagcctggagcccatgaggcagccagcactgtgcccttgctcagtcgtgctgtcccctccctctccctcagtctcttctccatgcccaagtcagtttccagccgctggtcttcatggcattcccagcacagctggacaccaagaggcaaaacccaaggcctggcttggccgtgttaacgattgtacagacatttttttaaataactttgtgtaatacttttctagaatagtaagttcttgttgaactgtcacagatgagcttctaggaacacaccgggtgtggttacttccactgggtgtgtccatggtcgtggtctgtgcctttgtaaacaaacagaacacttgaaccaccttccgaattgggtcatcggcttctttacattgatacttagagatttgcagctctctaactttcaaggaaacttcccctactgaaaggcataaaaaggttaaaaaagaaaatccgagagtcccaattccctgtataacagcattaaaataatctgcctgcctggaaagatgagaacactgttgcacaacccaaaatgtgtttttaatttgtgaaaaattaccatggtgagtcagacagtcattttaaacagctgaacagagactatcatcagcaaatagagctcagctttgtagctgcctttaaaatccttgtcccaaatccggtgagctctgcttgctgccgccgcgctcctgggtgatcactcagacgggtcagtgggaataacgggccaacaagacagctttttacatgtgtccaaaggatggcctttcgaaggcctggaagtatttcactgttggaagaagtaaacaagaatgacattccagatggaaatagaattctctctcttgcctttgaccaacatggtactaaggggtttcttctttcccaatgtatgtacgtgccctgctgggggccttactttatagaatgagagcatccgagcttccctaatgaatctggctagttctgtgtctggctgaggatacaggagtgggacatccactctcggatccctcagagcacagaaaccttcagctttgctgtctctgaagtatttcctccagtttccctgcgggcccctatgtttgagtttgatggctgctggatcctcactcaacgaaaactcggttggaaactgttccgcctggcagtccttttttgttgttttccatctcatttcccttccatctgaaagtggcattcagctgacttgctcatttagactgttcacggagtctgaatctgccaacgtggtgttggaggctccaccttgaaaagggccacagtcagggcaactttccccatacaggaaaacttgaaaattacatcaacagtctacgtcacagccaaattatatttcctttataccaaacaaaactatggagaactaaaagtacatcacacaaaacgtttatagtgttttgcatgtgacctatttcagtatttatataactagattagtgctttctagcaaacggttctgttaattagcgagtcactgttgattctgctgtggtggtaagttgataccgtgtaactaatcccgtggatgcctcctcgttatttttgtccaaacgaagcagccgtggtagtagctgtctatgattcttgctcagcaaagtaaaataaatgttaaatatgg

SEQ ID NO: 20 - DNA, 3558 bp, Homo sapiens
  ref <308>: DATABASE ACCESSION NUMBER: AB007950
  ref <309>: DATABASE ENTRY DATE: 2001-06-18
cagaagccgaaagaactgttcacatggagctgtttattttccggcctgaggttgccgagacaattggcgagctgtcttgaatatatctctatcaattaaaacagcagctgagataaataatgcacctttgccggaactgccacagggactgcaggctcaggcttctcaagccagctcaccgtccagctgagcgagatgtcagcccaaggaaggaacttagatgccttggaaattgatgcctcacagttattttctccagaggaggtgcagggtctgggctagggaaacggaaaggactctgttgcatttaataaagcctgtatcctatggcagcagccactaaggagctcaccagaataagccaatgccattcctcatttggcctgagcagctcagagtcaggaagtcagagcgcagaaaatccagcagctgtcagagggctccatgtttggccacggtctgaagcacctgttccacagccgccgtcggtctcgggaaagggagcaccagacgtctcaggattcccagcagcatcagcagcagcagggtatgtccgaccatgactccccagatgagaaggagcgctctccggagatgcatcgcgtctcctacgccatgtccctgcacgacctgcccgcccggcccaccgccttcaaccgcgtgctgcagcagatccgctcccggccctccatcaagcggggcgccagcctgcacagcagcagtgggggcggcagcagcgggagcagcagccggcgcaccaagagtagctccctggagccccagcgtggcagccctcacctgctgcgcaaggccccccaggacagcagcctggccgccatcctgcaccagcaccagtgccgtccccgctcttcctccaccaccgacactgctctgctgctggccgacggcagcaacgtgtacctcctggctgaggaggccgaaggcatcggggacaaggtcgataagggagacctggtggccctgagcctccccgccggccatggtgacaccgacggccccatcagcctggacgtgcccgatggggcaccggacccccagcggaccaaggccgccattgaccacctgcaccagaagatcctgaagatcaccgagcagatcaagattgagcaggaggctcgcgacgacaatgtggcggagtatctgaaactggccaacaacgcggacaagcagcaggtgtcacgcatcaagcaagtgttcgagaagaagaaccagaagtcagcccagaccatcgcccagctgcacaagaagctggagcactaccgccggcgcctgaaggagattgagcagaacgggccctcgcggcagcccaaggacgtgctgcgggacatgcagcaggggctgaaggacgtgggcgccaacgtgcgcgcaggcatcagcggctttgggggtggcgtggtggagggcgtcaagggcagcctctctggcctctcacaggccacccacaccgccgtggtgtccaagccccgggagtttgccagcctcatccgcaacaagtttggcagtgctgacaacatcgcccacctgaaggaccccctggaagatgggccccctgaggaggcagcccgggcactgagcggcagtgccacactcgtctccagccccaagtatggcagcgatgatgagtgctccagcgccagcgccagctcagccggggcaggcagcaactctggggctgggcctggtggggcgctggggagccctaagtccaatgcactgtatggtgctcctggaaacctggatgctctgctggaagagctacgggagatcaaggagggacagtctcacctggaggactccatggaagacctgaagactcagctgcagagggactacacctacatgacccagtgcctgcaggaggagcgctacaggtatgagcggctggaggagcagctcaacgacctgactgagcttcatcagaacgagatgacgaacctgaagcaggagctggccagcatggaggagaaggtggcctaccagtcctatgagagggcacgggacatccaggaggccgtggagtcctgcctgacccgggtcaccaagctggagctgcagcagcaacagcagcaggtggtacagctggagggcgtggagaatgccaacgcgcgggcgctgctgggcaagttcatcaacgtgatcctggcgctcatggccgtgctgctggtgttcgtgtccaccatcgccaacttcatcacgcccctcatgaagacacgcctgcgcatcaccagcaccaccctcctggtcctcgtcctgttcctcctctggaagcactgggactccctcacctacctcctggagcacgtgttgctgcccagctgagtggccagccacaccaaccctgtgctctctggcccccagctggccacacttctccaggagggacccttggacttctttgtgtgtccagtttggcctcctgcccaaactgtccattccagcagctcctgcccccttctctgtacttgcttctgtctgacaccttctccctgttggcctgaagggagcttagaatgcagccctacctggagatagtgcgggcacctgtggccaagtggagcagaggtggacatggggttggattgttttgattatttatagttacacaaggacttctcccagctgaccctcaggatgccccaagtcaggaagaccattaagaataggaggagagggctctgcctcaactttcctaggaaagagcccacctcggagatagctacggtttcctctggtggagatggtgaggatgaaggctggagagtgagggaggaggctctgctggccgcagagaacacagggatgggagggtccctagccttcgggcacctccagggccagagagcaggctcagagcagctagtgtggagctcagcatccccaccccacccctcctccctgtagagctgatttgaggcctccttctggggctgggctctgcaggccaggtgggtgtggcctgtgttttcccttctgttctttctgcctgtactggatctgttattttcagggaaacaggccccagggcccccctgagcctcaccctaagcccttaggcctctgagagtgctgttgggttctatttatttatttatttgttcctttgttccctacccgtgcccccagtgtcttccctgctgagtaccaggagaggtcctgccccatcctctctctgaagccagggcccttccattccatttagcctttggatcatcctggctgggagaagtgggaccgagccacccagccccactatccccaagcagccctacagccgggatgggaggcacgtggcctctcttttatccgtctatttattttgtaagtgtattcgtgtggaggaggttgttgctttatttttttaaggctctggagtgttgtgtatggtttcttttcacatcccagcctcccatgggcacttctaagaagagaggggatttcttggaaaaggagagaggaatcccctagagcagggaaagcagtgcctgccagctgttgtgcaccttcctgagaaataaatatcctctaaattttcaaacc

SEQ ID NO: 21 - DNA, 6335 bp, Homo sapiens
  ref <308>: DATABASE ACCESSION NUMBER: AB011087
  ref <309>: DATABASE ENTRY DATE: 2001-06-18
cgaaggcttcatcgaagtcctgaccaagaagcagcgccgcctgctggaggaagagagaagaaagaaggagcaggccgtgcaggtgcctgtcaaaggtcgaggcctttcctcccgtattcctcctcgatttgcaaaaaagcagaacaacttatgtctggagcaaggtgacgtgaccgtgcctggcagcagcctgggcactgagatctgggagagcagcagccaggctctccctgtgcaggccccagccaacgactcctggaggaaagctgtcactgccttcagcagcaccgagactggctctgcggagcagggttttaagagcagccagggagatagtggcgttgacttgagtgccgagtctcgggagtcgtctgcgacctcctcgcagcgcagctccccatatgggactctgaagccagaggagatgagcgggcccggcctggcggaacccaaggccgacagccacaaggagcaggctccaaagccatctgagcagaaggattcagaacaaggctctggacagagcaaggagcacagaccaggacccatcggcaacgagcgttctctgaaaaacagaaagggctcggagggggccgagcggctgcaaggggctgtcgtcccgcctgttaacggggtggagattcacgtggactccgtgctgcctgtgccacccattgaatttggagtcagtccaaaagactccgatttcagcttgccacctggttctgcctctggtcctactgggagtccagttgttaaacttcaggatgccttggccagtaatgcagggttaacacagagtatccccatcctgcggcgggaccatcacatccagagggccatcggtctctccccaatgtccttccccaccgccgaccttactctgaagatggagtctgcgcgcaaggcttgggaaaactcccccagtttgccggagcagagctctccaggcggcgctggctcaggcatccagcctccatcctctgtgggtgcctccagcggggtcaactacagctccttcggtggagtgtccatgccacccatgcctgtggcctctgtagcaccttctgcttctatgccaggcagccacctcccgcccctgtacctggatggccatgtgtttgcaagtcagccccggctggttcctcaaacgatacctcagcagcagagttaccaacaggccgccgctgcccagcagatcccgatctcccttcacacatctctgcaggcacaagctcagcttggactgaggggtgggcttcctgtgtcccagtcccaggagatcttcagctccttgcagcccttcagatctcaggtgtacatgcaccccagcctgtcaccgcccagcaccatgatcctctctgggggcacagccttgaagcctccatactcggcgttcccaggcatgcagcccttggagatggtgaagccgcagtctggctcaccctaccagcccatgagcgggaaccaagccctggtctacgagggccagctcagccaggctgctggcctgggtgcctcccagatgttggactcccagctcccacagctgaccatgccactgcctcggtacggctccgggcagcagccactgatcctgccccagtctattcagctgccacctgggcagagcctctccgttggggccccccgaaggattcctccgcccgggtcccagccgccagtcctgaacaccagcagagagccctctcagatggagatgaaaggcttccactttgccgacagtaaacagaatgtcccttcaggaggccccgtgccatcgccacagacctacaggcctagctctgctagccccagtgggaagccctctggatcagcagttaacatgggctctgtgcagggacactacgtgcaacaggcaaaacaacgagtggatgagaaacccagcctgggagccgtgaagctgcaggaggccccctcggctgcctcccagatgaagcgaaccggagcgatcaagcctcgggctgtcaaagtggaggagagtaaggcctgacagtgcctggctgccacctcgcctctccctactgaggacggtgccgccatgcggcctcgacacagccgacactcgggagcctcaccagatccaccgtccaaatgcgtggcccagactgagagacctccctcctctccactcccgaaagctccgttgtcaaccagcttgcacccgtggatatatggcattgacccgcttgctttgatacgaaacaaaaaagcagacgactccttcatcccatctgctcctaccgtgactgtggagtgacgcctcctgtgcagtgcagatttgccctccctgcctcctccctgtcctgccgcgcagccagggcgccttctcagcagtgcttccggcccagccgcccatccctaggcacagtgatttggcagcagggtcattttactttgaggctttttgttttaaaatgtagccaaggtttttacaaaggggaaaggaaaagaaaacaaaaacgcaagctccatgtgtatagctgaacttttatatgtttcttgccagcccctccgctcccttccatctctagcctctgtcctgtttagtttgatacgtcactgcagtaccttaagaggtgactcttaagaatgcatcccctcctgattcctcagctggttcacccttgaggttatttgcaaaaagaaaaggaggttcttgagggcaccgattgcgagcattctggtgcctggctccccgcctgggaagcaatggggtgctcagagcagcaggcaggttgggggaggggggggggtcatagttgggttccagctcctggcttgatgagcccagggcgcttacaggcagcccatgaagttgatgacagttttagcatgagaatcacacagggtccctgtcctgggctcctctaaagccagtggatgtgctgggcaccagagacaaatcatggagatggctgctggtggctcccaggttggcccagatggggtgagctgacataccacaggcccatcccaggccccgtgggctctgcttctggggctccataccctgccctgcgggggtgctgtgtttttcacacatttctttccctgaagccttctgtaacctgtcattttccttccttcctcttccggagcctgctgctttctctggacctgtctccacctcccacacagctcatcgtgaacaccacttggtgatggagggagtggacccgtgtgtggtccccaagtgaggccactgggagtttgtccttttcctcctttgcttcactcccagcagcagacccaggttgtcaggacaggagggcctgagctaagcagtaggcatcagtctcgtttgtcttcagacggcgggggcaggtccagggtgaggctgggtggagggctgaccaaggtccaaagggcctgcgcagcctccgggagggcagcttctccagccagaggcttgtgtgagccatcgtgtgctgggcttgtttttaagtaagaaacaaggaaatcactccagattctgtcattccaaggaaagggaaggggacagttcaggtttctcagctgttcttaggggtcactgagcgtctacctcctcctccagaggaggctggctcagaacacctagaggagggggccggggatgcaccccccaccagaggctgccttcagcgtctcacgggtgcaggacagcgctcaggcttgggctctaagctctgtgtctagtgtagaacatggggaaggagcatcttaggaactgctgaagtaacttcttactgctctcacaattctaaggaagcgggagaacggcctcctaccaacagcgcccaccccagagctgcctgggaaagggcagttttactgaaaggtgctttactgttcacctgcatctttcagcagctcccctcctgccctcacctggtcttttccctctttatcccaagcctttatgcttgagtcccttccccaggggctgcccacccgacagttccaggcattccctacctgagcttcttgtctgcttttccttctcccactgcaggcggctgcttgtggggcctgggatgagccctctctgtccccaccggccctccttgccaagccattcctgggtgagttcaggcctgcgggagccacacattcatctccacctggacacttgagccgcatggccagacccctcccacctgatgcggtggtgcgtgtgatttgtcaaaagaaagccttctggatgctgttaagatgtacccttcaggtgaacctggtatcagacccacagtacttgctgtttgagaaaaaataaaaacaaaaaggtcacctgttctccagcccttttctcttacctggtatttccttcctttctcctcccccaccccaaataaaaaaacaaaaaacactagaatttatttatatgtattgatgttgtaggtctaggtgaaaaaaaaagaagtaaatgtttcactgctctatttatatataatgtctgaattaattctgtgcaggaaaggccaggaaattgcatgtgaagttcggtgcagtcaccacctctgtgtgacctgagctgcagtctcttcgctgagatgcaggttttaaatgagacttggggggctgagggcaggcctcaggcctcccagcgccccaacccctccttggtctaatgaaatgcagttcttagtgcagagatgttttaaggtgcaatatatctcttcctttcccgtggttttagagccaagctcaaggtagtaggacgtagggtcttattttgttttcaaacccccatcctcagagcgcagatacatgcagaggcttctgccaggataccacggggccttagtgggaacaggtggagaccagcacttccctttcctgctgctgaggtagggattggggggtcagaacccactcacttttgcctgttaaagttgccctcctgacgctggcagctctgccttggtcactggggatgcggctcgttgctcagccaccagtggccttgcggtattgtccaccatccactagagtgggatgaagtccagagtgtgggtatacatctcagatgcccatctacccactggggacttcaatgccagctgcatttggtttggttttcttaactgttggcttctccccacagcgttttttgtttttttttaaacattcatattgttttcaaacttggaattcatagacactctggctctaggttccttaagggggaaaacaaaagatgactttatttcacattcaagaaaatcagttcagttccaaagctgtggtccttccagccacttctagggacactggggaaccttgttaaacgttgacatcagtgctctccagccgtgctgtcaccctcctatcttctggatctgccttcgggatggtcagtgacagcttctggaagctgagcacacacaggtgcacagccatgctgtggtctggcctgctacggcagcatggcagctctggtggagccttctcccttgccatttggttcccctgtgccaagtagctgcaggctgcccctcaaatcttcatttgtcccttttcacttcctgcagaacaagcctgggttagagggtctgctggaaatggcctttgaagaccaaggataccaggatgtgtgcactctgtcgtgttctgtgatgaatgggaaacgcaggcttccagaaagccagctctcttctgaaatgtgacggacctaagcaggaagtcatccaggacaggagtggctcagtgttggggatggacgctgtcgcccagccatgctccaccagggccaccaatgtgtagttggctggtggtcttcgggcatgtgagacctgctcttcactgtttccaccccacttggtggcctccaggatggtagtggcaccctcagagccccatcttcagcatgttctgaagcctcagagtggaaattcctgctaaggctctgtgtggacgcctttctcccgtgatctaaaggggacactgtactcaagcttttgacctcatgccttgtgtagtaaaaaaggatttgggggttttgtttggttcctgagagggttgtgttttgtttttgtttccttttgtttatgttttggcctttcctctttgtctttccatgtagaccagatatttgaaagggcagacgatggctagaggtgtaatgtgcagcttgtttatacggtattttgggaaacttaccttggatgggaaatcgaatcgtggattcaccaggccggtgctggcacactcaccctcgccctttccctccggttcagtacctattgtttctcctttcaaatatgtgattgtactagctctttccatatgaaagaattctccttatttaaataaaaaaagtttaaaaagat

SEQ ID NO: 22 - DNA, 6740 bp, Homo sapiens
  ref <308>: DATABASE ACCESSION NUMBER: AB011089
  ref <309>: DATABASE ENTRY DATE: 2001-06-18
cccagttgtctgcgggctgcggggagctaagtccccagattggaggaggctggctctggtcttcgatgcacaggagtggccgttatggaacgcagcagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtcgggagtgcacggagggggagcacgcagagcaccccacagttccactcaaggatgtggtggaacagcacaaggcctcgctccaggtccagctggatgctgtcaacaaaaggctcccagaaatagattctgctcttcagttcatctctgaaatcattcatcagttaaccaaccaaaaggccagcatcgtggatgacattcattccacctttgatgagctccagaagactttaaatgtgcgcaagagtgtgctgcttatggaattggaggtcaactatggcctcaaacacaaagtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacggggagatcctggacaacaagaacggcacctatgagtttttgtacactgtccagaaggaaggggactttaccctgtctctgagactctatgaccagcacatccgaggcagcccgtttaagctgaaagtgatccgatccgctgatgtgtctcccaccacagaaggcgtgaagaggcgcgttaagtccccggggagcggccacgtcaagcagaaagctgtgaaaagacccgcaagcatgtacagcactggaaaacgaaaagagaatcccatcgaagacgatttgatctttcgagtgggtaccaaaggaagaaataaaggagagtttacaaatcttcagggggtagctgcatctacaaatggaaagatattaattgcagacagtaacaaccaatgtgtgcagatattttccaatgatggccagttcaaaagtcgttttggcatacggggacgctctccggggcagctgcagcggcccacaggagtggctgtacatcccagtggggacataatcattgccgattatgataataaatgggtcagcattttctcctccgatgggaaatttaagacaaaaattggatcaggaaagctgatgggacccaaaggagtttctgtggaccgcaatgggcacattattgttgtggacaacaaggcgtgctgcgtgtttatcttccagccaaacgggaaaatagtcaccaggtttggtagccgaggaaatggggacaggcagtttgcaggtccccattttgcagctgtaaatagcaataatgagattattattacagatttccataatcattctgtcaaggtgtttaatcaggaaggagaattcatgttgaagtttggctcaaatggagaaggaaatgggcagtttaatgctccaacaggtgtagcagtggattcaaatggaaacatcattgtggccgactggggaaacagcaggatccaggtttttgatgggagtggatcatttttgtcctacattaacacatctgctgacccactctatggcccccaaggcctggccctaacttcagatggtcatgttgtggttgcagactctggaaatcactgtttcaaagtctatcgatacttacagtaatggtgggcaggtggatacccgcttccatggtcttgcactataaactggaatggatttctcaatgcgggaccagattatgactagagtttttatgccagaaggaatcattggtgaactttccaaggttatttctgaatgtaacaatttccttaaaaatgacttatccaatttctgtatttcacctttagggttaaaaaaaactcttctactgaatctataaaaactgcagttttacatctgtgaactatggcttaagggacaggatttatgtagctaaactaattttgcaaatcaaacagacacttaaaaaaactagcatatgtaaaggtattcgttaatcctgtgaatggtagcttttgcacagaacttccaaaagcaaaacaaaaacaaaatctattgtagttatatacttcatttaacctaggtcacaagacccagggaatcttctaacctcacttttacagtaggtattactcttgtgacatttttttggttatcaacaactaaatataaattactttggaaaaagtaaggctgtcttgcaaaatgatcccagctctgattagcagccctctggagttcagaacttaagtatcagtgcaaatttctcaacctttctgggttagacaaagatccttttttgtgtgttcttttcaccacccctttggctcaccttgtatcagcaaacaaagtacttcttcagggaaacctgaaatttctaatgccttgaaaagcatattacaaaagtaatgctaccttttgggaaacaaactgccccgttaactccagatcattgcactggaatgtaatcaagaaagttagtcatgttttatgtaccatgttttcacacgtgtctcttctcttcgacttcctgaaagcgaaagctttacctcctgcaaatgtcagcacatgtagtaggacaccagtatcctaggacagagagccataagtagccctttggaggactgatggtgtcaaccaaaggcatgtgattgattaatgattcccccttagaaagcaagtgttaccaaagttgtgttatcttgaaagcattacaggtaagggcatgttatggttatttatcattgtttaatgaatagtagaggtgtcaagggactatgtatacatgattagggtaagatagaatgtattatatatatatatatatatacacacacacatatatatagctgaatctttggtgtattgaaataggcagcactctgaaagacagaagcttcgtccagccactcttcagcacattcctttactaagcagtttaaagccgtcctagtggagcaagccctaaagcagatttaatttttgccattttccaagaatgacggtggtggcttttagtcagaaaatggccttctgtgctttcaaaaaaaaaacaaaaaaaaaaccacacacacacataaaaaacccaacaggtcaaaataaaagttgaacttgagttacatttaatttaaatataaatgcattttgagaaatgttaagaacaatttagtcaatcgttcatctgtcattggtactgtaaaataagctgtggtctatttccactgtttaattttctactcagttctaccaaataggatgtcatgtttgacatttttgatagtgactttggggtcttcttcactgaaagcaccttagaactgtactataagaaaacatttcccctatgtataattatatgaatgtgatgtttattgcttattaatttataattcagtcattctctatataggacttcttaaaatttagaagggaaatctagctacttcaaattgtctgttaaatttattatgcccaaatcaacctctgaaaaaaggtttttccaggaagatttacatttaggtttaatatttttttagttaggtagagttttaaaaaatacttgagcctgtccgtgataaagctataaaattcaataactttttagaatgttaaatgaagacactgtttcctaacatcagtgagatacatctttgaatttaaacattcatatttactgagtacctactaggtaccaagtactcttttaggcactggaaatacagtgatggacaaaacaggtaaaaaatcgctgccccctcagagctgacattctggggtgggaatttcattttgccacgtactaacgttctgcacaaaagacaggctagactcttgtctagattgtttaaaagaaacttttcaaattggttacattaattttagtttattttcacaagtaaaaatggctttttatttagattctttctgtcccaggctgttgatcttaaaactagttgatttaaagagtttttttgcacaacatttcaattatatttgtgaacttagaaattaacttacaatctaaccagccatcatatcatatcctatcaggctagatatctcaatagtagactgaatacaaagctaattttttttacatgtcaatattggcacaaactggaatgaaagaatagtttgattcagacctgctccactatgtgttgctaaaacacatgctatgagcactcgaggaaacactatattttttccaaaaaatatgtgattatatatgttaaagtatagataacatttcacacttggatacatatgtgcatttactgtatttcttggtaagcatatttttgggggaaagtgctgctgatatgatacaagtagacaaaatttaaatgaaattttgtcacattctatggaaaatggtttctggtaaactgagaaggatattaaaataagtggcttttttctgggctaccattattgtttgatttctctttgtcaagtgtatagaacctgtcatacattcatgataagtagcactgaaaaattactcattcaaatttcccctgggcacgtaaggcaaaatattgccggttgggatttcaaggtcagtgacgacgcatttcctcccagtacagaccccccagccccccttgctggacatggggaggcagagagtcacttgaccatccagaaatacatgactacaagtcctttatgactgtttgccattttttttaatggtacttagtattttgatcaaactttagtctccagaactaaacaagtccctaagtttccttattttaatttactgtgactagatttgaagcaaataaatactccagatccatgcagctagaacacacttgcttccactactaaatatacagggtatgtcctaacatggagttaactggaatagcagtacactagcaagtatctgtgaatccttagcactgacgggttaacagaaatgctttggtaatacctacttagttaattggaggaagtagtaaataaacattaggtaatctgcagattacttcaaatgggaaaaatctttttgtagactctatagtaccctctctattcactagcttctgaaaagggaggagtatttttagtttgacaatttaataatttaaaaacaagacatctccaggtaggaaaaaatgaaagctatttcatgcaaacattatctaatttagcttaaaagtgaaagtggtaatactgttggtttctgtaaatgttgcagggttttaaactttataattactttaatatttttgataactagaaatctagtattgccataaaggaaactaagtgcccatcaaagatttgtttggtataaataaagaattatttgttttgttttcaatgacagtaagctacaaatcatgatgcttaaaaactttctaaagatgaattgtgtggcagtgattggtctgtttgtggagaatgtatgaaagctattaatattctagaatagattaataaattggctatgttgttccaatgaatgtacagcacttccattaacttttgaaagcaacacagccttaaactcaatgcttttgctttatgacatgggaatgttctgtcatcaatggagtgtattcttgtaatagaattctttatatcgttctcaattctatagactttcaagcctatgtatgaatatgaaggggtttttttttttttgctttgttttctttttagattttgtacattccatctttataggtctgtttcatatgttttatgtatagaacactaagtcttgcactctctgacattgatactgatatattctcgtcatttgttcttttatgaatcaaaatgttgactgcctatttaaagaaaagaatgaacgctgtgcatcaaagtgtttgtatgttcgtagctacatacgtaccacagtattttggatgctttagtctacaatgaaactttcaattaattctgtcttgaaacataggagaaacaggattcatgtgtatctctttaccatgcacaaaatctcaaatcattataataaagcttgttttctccatttgc

SEQ ID NO: 23 - DNA, 6827 bp, Homo sapiens
  ref <308>: DATABASE ACCESSION NUMBER: AB011104
  ref <309>: DATABASE ENTRY DATE: 2001-06-18
ctccagaaggtttttgttgcatttagagaatttaatctgtctgaaagcaaagtttgtgaactgcagttgccggatatcaatctcgtgaatgaccagaagaaattagtatcttcagatctttggagaattgtcttgaacagcagtcaaaatggagctgatgaccaaagctctgcaagtgagtctggttctcaaagcacttgtgatccacttgtgactccaacagccctggctgcctgtaccagagttgactcctgctttaccccatggtttgtcccatccctttgcgtttctttccagtttgctcacctggaattccatctttgtcatcaccttgaccaactaggcacagctgcaccacagtacctacagccatttgtttccgacagaaatatgccatctgaactagaatacatgattgtttccttcagagaaccacacatgtatcttcgacagtggaataatggttctgtctgtcaggagatccagttcttagctcaagcagactgtaaacttctagagtgcagaaatgtcactatgcaaagtgtggtgaaacccttcagcatcttcgggcagatggcagtttccagcgatgtagtggaaaagctgcttgactgcaccgtgatagttgattctgtatttgtaaaccttggacagcatgtagtccattcactaaacactgcaatacaagcttggcaacagaacaaatgccctgaggtagaggagttggtcttcagccattttgtgatctgtaatgacacacaggagacactgcggtttggccaggtggatactgatgaaaatattctgctggcgagtctccacagtcaccagtacagctggcgctctcacaaatccccacagctgttacacatctgtattgaaggttggggcaactggcgttggtcagagcctttcagtgtggaccatgccgggacttttattagaacaattcagtacaggggtcgaactgcttctctcatcatcaaggttcagcaactcaatggagtacaaaaacagattatcatctgtggaagacagatcatctgtagttacttgtctcaaagcatagaactaaaagtcgttcagcattacattggtcaagatggacaagctgtagttcgggaacattttgactgcctcacagccaaacagaaattgccttcgtacatactagaaaacaatgaactgacggagctgtgtgtgaaggccaaaggagatgaagactggtcaagagatgtgtgcctggaatccaaagcccctgagtacagcattgtcattcaggtgccatcttcaaacagttccattatttatgtctggtgcacagttttgactttagaacccaactctcaagtgcaacaacgaatgattgtgttcagccctctttttatcatgaggagtcatcttccagaccccattatcatacatttggagaaaaggagtctgggattgagtgaaacacaaattattccaggaaaagggcaggaaaaaccactgcaaaacatagaacctgaccttgtacatcacctgacattccaagcaagagaagaatatgatccttcagattgtgcagttcccatctcaacatccctcattaagcaaatagccactaaggtacaccctggaggcacagttaatcagatccttgacgaattctatgggccagaaaagtcgcttcaacccatatggccctataataagaaggattctgacaggaatgaacagctaagtcagtgggatagcccaatgcgagtgaagctgtcaatctggaagccatatgttagaactttgttgatagaacttctgccctgggccctgcttatcaatgaatccaaatgggacctctggctatttgaaggagagaaaattgttctacaggttcctgctggcaaaattattattcctcctaattttcaggaagcttttcaaattggaatatactgggcaaatacaaacactgtgcacaagtcagtagcaattaaactggtccataacctgacatctccaaagtggaaagatggaggtaatggtgaagttgtgacactggatgaagaagcgtttgttgatactgaaataagacttggtgcttttccaggacatcagaagttatgtcagttctgcatttcctccatggtacagcaaggtatacaaattattcagattgaagacaagactacaataatcaataatacaccatatcaaatattttataaaccacagctatctgtctgcaatccccattctggaaaggagtattttcgtgttccagacagtgctacttttagcatttgcccaggtggagagcagcctgctatgaaatccagctcccttccttgctgggacttgatgcctgacatcagtcagtcagtactggatgcatccctgcttcagaaacagatcatgctgggcttttctcctgccccaggtgctgacagctcacagtgctggagcctgccagctatagttagaccagagtttcccagacagagtgtggcagtacccctcgggaatttccgggaaaatggattctgtaccagggctatagtgctgacatatcaagaacacctcggagtgacttatttaaccctctcagaagaccctagtcctcgagtaattatccacaatagatgtccagtaaaaatgcttataaaggaaaacattaaagatattccaaagtttgaggtttattgcaaaaaaattccctccgagtgctcaattcatcatgagctgtatcatcagatttccagttatccggactgcaagaccaaagacttacttccaagcctacttttgagagttgaacctctagatgaagtaacaactgagtggagtgatgccattgacatcaacagtcagggaacacaggttgtgttcctgactggctttggctatgtgtatgtggatgttgtacatcagtgtggcacagtcttcatcactgtggccccagaaggaaaagcaggacctattttaaccaataccaacagagcgccagagaagattgttacatttaaaatgttcatcactcagttaagcctggcagtgtttgatgacctcacccaccacaaagcatcagctgagcttctgagactcacactggacaacatttttctctgtgtggccccgggagctggtcccctccctggggaagagcctgtggctgcgttgtttgaactttactgtgtggagatctgctgtggggacctgcagctagacaaccagctttataacaagtccaatttccactttgctgtcttagtctgccagggagaaaaagcagaacccattcagtgttccaaaatgcagagtctcctcatatccaacaaagagttggaagaatacaaggaaaaatgttttatcaaactttgcatcaccttaaatgaaggcaagagcatcctctgtgatattaatgagttcagctttgaattaaaacctgctcggttatacgtggaagacacatttgtatactacatcaagactttgtttgacacctaccttcctaacagcaggttggctggtcactccacacacctctccgggggtaaacaggtgttgcccatgcaggtcacacagcacgccagggccttggtgaatcctgtgaagttacggaaactggtgatccagccagtaaatttgctcgtcagcatccacgcttccctcaagctgtacatagcctcagaccacactcctctctccttctcggtgtttgaaagaggacccatcttcaccactgcgaggcagcttgtgcacgccctggcaatgcactatgccgctggggccctttttagagcaggctgggtagttgggtctctggatattcttggcagccctgcaagcctggtgagaagcatcgggaacggggtcgccgacttcttcaggcttccgtatgaggggctgacccggggccctggagccttcgtgagtggcgtctccagagggaccacatcgtttgtaaagcacatctccaaaggtaccctcacatccatcaccaacctcgccacaagcctggcccggaacatggaccggctctcactggatgaggagcactacaaccggcaggaggagtggcggcggcagctccccgagagcctgggcgaggggcttcgacagggcctgtcccggctgggcatcagcctgcttggtgcaattgctggtatagttgatcagccgatgcagaacttccagaaaacatctgaggcacaggcttcagcaggacacaaggccaagggtgtcatctcgggtgtggggaaaggaatcatgggggtgttcacaaagcccatcggaggagctgctgagctggtgtcacagactggctatggtattttacatggagctggactttctcagcttcccaaacagcgccatcagccaagtgatctacatgctgaccaggctccaaacagccatgtcaaatatgtctggaaaatgcttcagtctctgggcagaccagaagtccacatggccctggacgtggttctggtgaggggctcaggccaggagcatgaagggtgcttgctgctgacatcagaagtgctcttcgtggtgagtgtcagtgaggacacacagcagcaggccttccccgtcacagaaatcgactgtgcacaggacagcaagcagaacaacttactcacagtgcagctcaagcagccaagagtggcctgtgatgtggaggtagatggagtccgagagagactgtcagagcaacagtacaacagactggtggactacatcacaaagacatcttgtcacctggcccccagctgttcttccatgcaaataccatgccctgtggtggctgcagaacctcccccctccactgttaaaacataccattacctggttgatccacattttgctcaggtcttccttagtaaatttaccatggtgaaaaataaagccctgaggaaagggtttccttgagtcccctctgaggtgtttattcctgcttgtgtgatttagtttttgggtttctttgagacagggtctcactgcattgcccttgctgacctcaaattctggggttcaagcaatcctcccacctcaacccacaagtagctacgactgcaagcacctgccaccataaagggctgcattttgccaccataaagggctgcatttttttaaaaagcctaggcagctctaacatcatctgatatggacacaaggccaacagtttccttatttacatccttacctctaaaagatacttcaaagtgacaaaaacgtgttccttccccacttagagacaatgattaacagggccctatatgttcttaccacatacagaggatgcatttatttttgctctatgacacttgcaaaaatctctactgtaattaatttgggtctattattaactctctgttccatcatagaatgtggccaggccttacaatggagagccagagttaaaacttcaagttgcatctgtttttgggctgagtcaccacctttgcctcatgctcctttgtctgcaaaggcctaggattctttctttaaatgaaatgcttaggactttgtggcttgttacatttgtcatttaactgcagtgctattctttgaaagctgctatgtgtattttctctgaagtctgcattttactaaaatttacaacagtctgatgattgattgattactgtccaggtacattttagaaaaagtgttcttcttccagtttgttttactaagcaaactttgagtaaatcctttgtcctatattgaatccagtcccaaagtgttcaggtgagtttctctagttccataaacaaaacatacatagtgggaactccctggtatgccatagagcacacaagaaccccaatattaatgctaacaattataccagtccattttgtttattctgtggaattgacttgacaaagcatgaagatattcccagtgtctgtctgataatattttgcatctaagaatgggtttgactcaagatcttgggttaccaagatgtcttaaatgttcagtaaatatctttcttacagtccagtagcttagagcatgtttgctgattgatattacatttaaacttggggctacagcttgttacctagaattttgagatactaagagaatgcaattttaaatgcccactggttttatttgttttggagagagggtctcattctgtcacccaggctagagtacagtgggaacagtcatggctcactgcagcttaagctcactgcctgggctcaagtgatcttactccagcctcccaagcagctgggactacaccaccacaggtatgcaccaccatacctggctgatttttaaaattttttctagagatgaggtctcactatgttgcccagctggtctcatactcctcagttcacgcattcctcccacctccacctcccaaactgctgggattacaggtgtgagccaccatgcccaacacccactgatctttaactctcacatgttgggcataagaagtcactatataattgttactggaaagcaagacttaacgaacaattctgactatgaaaaatgtctctttcagtttgttctgtaaatatttagaaaagtgacagctgtcaacctcagagtaactatttctaaaaatgtaaatatgtattaatccttgtatcttttatggtaattttgcatattgatatgaattatataaaattgtttaaaataaaaggtgtccttgaattactgaccacccatagatgtctactgttaccaggttttacaatgcaaattttcactaatacctgggtttaatacagctcacatcactgaatgttacacatgagtttaaatgggtaatatacaggttttgttataataaagttactgattaaatt

SEQ ID NO: 24 - DNA, 5117 bp, Homo sapiens
  ref <308>: DATABASE ACCESSION NUMBER: AB011105
  ref <309>: DATABASE ENTRY DATE: 2001-06-18
gctgtgaccgctgccaggagggacattttggtttcaatggctgcgggggctgccgcccgtgtgcttgtggaccggccgccgagggctccgagtgccacccccagagcggacagtgccactgccgaccagggaccatgggaccccagtgccgcgagtgtgcccctggctactgggggctccctgagcagggctgcaggcgctgccagtgccctgggggccgctgtgaccctcacacgggccgctgcaactgccccccggggctcagcggggagcgctgcgacacctgcagccagcagcatcaggtgcctgttccaggcgggcctgtgggccacagcatccactgtgaagtgtgtgaccactgtgtggtcctgctcctggatgacctggaacgggccggcgccctcctccccgccattcacgagcaactgcgtggcatcaatgccagctccatggcctgggcccgtctgcacaggctgaacgcctccatcgctgacctgcagagccagctccggagccccctgggcccccgccatgagacggcacagcagctggaggtgctggagcagcagagcacaagcctcgggcaggacgcacggcggctaggcggccaggccgtggggacccgagaccaggcgagccaattgctggccggcaccgaggccacactgggccatgcgaagacgctgttggcggccatccgggctgtggaccgcaccctgagcgagctcatgtcccagacgggccacctggggctggccaatgcctcggctccatcaggtgagcagctgctccggacactggccgaggtggagcggctgctctgggagatgcgggcccgggacctgggggccccgcaggcagcagctgaggctgagttggctgcagcacagagattgctggcccgggtgcaggagcagctgagcagcctctgggaggagaaccaggcactggccacacaaacccgcgaccggctggcccagcacgaggccggcctcatggacctgcgagaggctttgaaccgggcagtggacgccacacgggaggcccaggagctcaacagccgcaaccaggagcgcctggaggaagccctgcaaaggaagcaggagctgtcccgggacaatgccaccctgcaggccactctgcatgcggctagggacaccctggccagcgtcttcagattgctgcacagcctggaccaggctaaggaggagctggagcgcctcgccgccagcctggacggggctcggaccccactgctgcagaggatgcagaccttctccccggcgggcagcaagctgcgtctagtggaggccgccgaggcccacgcacagcagctgggccagctggcactcaatctgtccagcatcatcctggacgtcaaccaggaccgcctcacccagagggccatcgaggcctccaacgcctacagccgcatcctgcaggccgtgcaggctgccgaggatgctgctggccaggccctgcagcaggcggaccacacgtgggcgacggtggtgcggcagggcctggtggaccgagcccagcagctcctggccaacagcactgcactagaagaggccatgctccaggaacagcagaggctgggccttgtgtgggctgccctccagggtgccaggacccagctccgagatgtccgggccaagaaggaccagctggaggcgcacatccaggcggcgcaggccatgcttgccatggacacagacgagacaagcaagaagatcgcacatgccaaggctgtggctgctgaagcccaggacaccgccacccgtgtgcagtcccagctgcaggccatgcaggagaatgtggagcggtggcagggccagtacgagggcctgcggggccaggacctgggccaggcagtgcttgacgcaggccactcagtgtccaccctggagaagacgctgccccagctgctggccaagctgagcatcctggagaaccgtggggtgcacaacgccagcctggccctgtccgccagcattggccgcgtgcgagagctcattgcccaggcccggggggctgccagtaaggtcaaggtgcccatgaagttcaacgggcgctcaggggtgcagctgcgcaccccacgggatcttgccgaccttgctgcctacactgccctcaagttctacctgcagggcccagagcctgagcctgggcagggtaccgaggatcgctttgtgatgtacatgggcagccgccaggccactggggactacatgggtgtgtctctgcgtgacaagaaggtgcactgggtgtatcagctgggtgaggcgggccctgcagtcctaagcatcgatgaggacattggggagcagttcgcagctgtcagcctggacaggactctccagtttggccacatgtccgtcacagtggagagacagatgatccaggaaaccaagggtgacacggtggcccctggggcagaggggctgctcaacctgcggccagacgacttcgtcttctacgtcggggggtaccccagtaccttcacgccccctcccctgcttcgcttccccggctaccggggctgcatcgagatggacacgctgaatgaggaggtggtcagcctctacaacttcgagaggaccttccagctggacacggctgtggacaggccttgtgcccgctccaagtcgaccggggacccgtggctcacggacggctcctacctggacggcaccggcttcgcccgcatcagcttcgacagtcagatcagcaccaccaagcgcttcgagcaggagctgcggctcgtgtcctacagcggggtgctcttcttcctgaagcagcagagccagttcctgtgcttggccgtgcaagaaggcagcctcgtgctgttgtatgactttggggctggcctgaaaaaggccgtcccactgcagcccccaccgcccctgacctcggccagcaaggcgatccaggtgttcctgctggggggcagccgcaagcgtgtgctggtgcgtgtggagcgggccacggtgtacagcgtggagcaggacaatgatctggagctggccgacgcctactacctggggggcgtgccgcccgaccagctgcccccgagcctgcgatggctcttccccaccggaggctcagtccgtggctgcgtcaaaggcatcaaggccctgggcaagtatgtggacctcaagcggctgaacacgacaggcgtgagcgccggctgcaccgccgacctgctggtggggcgcgccatgactttccatggccacggcttccttcgcctggcgctctcgaacgtggcaccgctcactggcaacgtctactccggcttcggcttccacagcgcccaggacagtgccctgctctactaccgggcgtccccggatgggctatgccaggtgtccctgcagcagggccgtgtgagcctacagctcctgaggactgaagtgaaaactcaagcgggcttcgccgatggtgccccccattacgtcgccttctacagcaatgccacgggagtctggctgtatgtcgatgaccagctccagcagatgaagccccaccggggaccaccccccgagctccagccgcagcctgaggggcccccgaggctcctcctgggaggcctgcctgagtctggcaccatttacaacttcagtggctgcatcagcaacgtcttcgtgcagcggctcctgggcccacagcgcgtatttgatctgcagcagaacctgggcagcgtcaatgtgagcacgggctgtgcacccgccctgcaagcccagaccccgggcctggggcctagaggactgcaggccaccgcccggaaggcctcccgccgcagccgtcagcccgcccggcatcctgcctgcatgctgcccccacacctcaggaccacccgagactcctaccagtttgggggttccctgtccagtcacctggagtttgtgggcatcctggcccgacataggaactggcccagtctctccatgcacgtcctcccgcgaagctcccgaggcctcctcctcttcactgcccgtctgaggcccggcagcccctccctggcgctcttcctgagcaatggccacttcgttgcacagatggaaggcctcgggactcggctccgcgcccagagccgccagcgctcccggcctggccgctggcacaaggtctccgtgcgctgggagaagaaccggatcctgctggtgacggacggggcccgggcctggagccaggaggggccgcaccggcagcaccagggggcagagcacccccagccccacaccctctttgtgggcggcctcccggccagcagccacagctccaaacttccggtgaccgtcgggttcagcggctgtgtgaagagactgaggctgcacgggaggcccctgggggcccccacacggatggcaggggtcacaccctgcatcttgggccccctggaggcgggcctgttcttcccaggcagcgggggagttatcactttagacctcccaggagctacactgcctgatgtgggcctggaactggaggtgcggcccctggcagtcaccggactgatcttccacttgggccaggcccggacgcccccctacttgcagttgcaggtgaccgagaagcaagtcctgctgcgggcggatgacggagcaggggagttctccacgtcagtgacccgcccctcagtgctgtgtgatggccagtggcaccggctagcggtgatgaaaagcgggaatgtgctccggctggaggtggacgcgcagagcaaccacaccgtgggccccttgctggcggctgcagctggtgccccagcccctctgtacctcgggggcctgcctgagcccatggccgtgcagccctggccccccgcctactgcggctgcatgaggaggctggcggtgaaccggtcccccgtcgccatgactcgctctgtggaggtccacggggcagtgggggccagtggctgcccagccgcctaggacacagccaaccccggcccctggtcaggcccctgcagctgcctcacaccgccccttgtgctcgcctcataggtgtctatttggactctaagctctacgggtgacagatcttgtttctgaagatggtttaagttatagcttcttaaacgaaagaataaaatactgcaaaatgttttt

SEQ ID NO: 25 - DNA, 4745 bp, Homo sapiens
  ref <308>: DATABASE ACCESSION NUMBER: AB011121
  ref <309>: DATABASE ENTRY DATE: 2001-06-18
cttcagcaaacagaggacaaatcactcctgaaccaggggagcagctcagaggaggttgcagggagctcccagaagatgggccaaccaggaccctcaggagatagtgatttggctacagcactgcatcgccttagcttgcgtcgacaaaactatttaagtgagaagcagttctttgctgaagaatggcagcggaagatccaggttctggcagaccagaaggaaggagttagtggctgtgtcaccccgacagagagccttgcctctctctgcaccacccagtcagagatcacagacctcagcagtgccagttgccttcgaggttttatgccagaaaaattacaaattgtcaagccccttgaaggatcacaaactctgtatcactggcagcagcttgctcaaccaaacttgggaaccatccttgatccacgaccaggtgtcattactaaaggctttacccagttgcccggggatgctatttatcacatctcagatttagaagaggatgaagaggagggtattacttttcaggttcagcaacctcttgaagtggaagagaaactttcaacatccaagccagtaacagggatcttcctgccacccattacttcagcaggtggaccagttacagttgcaaccgccaacccaggaaagtgcctgtcgtgcacaaactcaacattcactttcaccacctgtagaatattacatccctctgacatcactcaggttacccccagctctgggttcccttcattatcctgtggaagtagcggtagcagttcatccaacacggctgtgaattctcctgccttgtcctatagactcagcattggtgagtccatcaccaaccgacgagattccactacaaccttcagtagcaccatgagcttggccaaacttctacaagagcgaggcatctctgccaaagtgtaccacagcccaatttcagagaaccccctccagcctctccctaaatccctggctatcccttccacaccaccaaattcaccatctcactcaccttgcccttctcctttaccctttgagcctcgagtgcatctctctgaaaattttttggcctctcgaccagctgagacattcctccaggagatgtatggcttgagaccctcccggaaccctcctgatgttggccagttgaagatgaacttagtggacaggctgaagagactggggatagccagagtggtcaagaaccctggtgcccaagagaatggaagatgccaggaggcagaaattggtcctcaaaaaccagattctgctgtttatttaaattcaggtagcagtttattaggtggactaaggaggaatcagagtcttccagtcataatgggtagctttgctgccccagtttgcacatcctcacccaaaatgggtgtcctgaaggaggactgaggttcagcagttaactgacctcttatacaagttagcacatgaaggatagatatgcactgaaacatgtggtctggtctgacttgagagaaaaggaatgttgcacaagggttgtgaatgtgaaagggggaatggaggaatggaaataaaattgggatgagccctaatggaggaagtcgggcaaattgaaagtataaatgaatgggccatgagtgttcagagggagaaaagaaaggtttaatatactccttcagttgagttttcttgtcttgaacataaaaagtgaatacaaataaattcagtaatactaaaacatacagagatactgaacttgctggcacatttacttctggtaagcataaagcagagagaacccaggttagaaggatgggaagagaaaaggagcagttttattgcttatagaaagccgttctgaggggttggtggggtaagctcagtctattactgagacaatagtgagatggcttatatgtttcccctgttaatatctggttaaattatgtatccatcaaatggtatgctcgcagcattagcaaaattaggagtttcatctttttcattgaatcacaggtggagactcctattttcctttctgttttcaggcctttgagcccctgggagcccaaataccactcaattattttgtatttatgattaataaaagttcattttttaaatttgtatttttatacaacctccaaaaaaaaaaacaactgggtagagggtgggagggatttacttttaagaggcaaaatgtgagtaaattgaaaccaagaaaacttgtttttagaatatttcgtctgaataagtacagtagccaaggaatacaaacataattgcatgtttttaaaaattccttggaggctggaaggggttaagccagaagtgcaatcaataggaattagggaatgttgtatatttatatatgtaaactttttttgtaagaaaagttggtgacaactaaaccaactttttccaaagtgcgctatgcatatttttaatgaaagatgacatgtatttgcacaaaaattctcaggcacattaaattattgtaaactgaagtaaaacccgggtgcttgctttgagattgtggttttttcttcctaatgtaaaataaaataaaacacatctgccttcttgatatttatagaattagagaataaactttttaatgggggagtcaaagctttttctttttctctaaggttctttttttttattcaaactgtatgaaatggcaaagtgaggctctggggttagatttcagcattcagcagttgacacaggctaagaaatggaaagaagtagatctgttttttctcaatgttgctgagcaaagtctgcttctcatcagatgacgtggctttgtctagacagcacgcagttcagaaagaaatgtctttatacaaaagacatgatagagaaaagatgagagaggggactaattattttgtttatgaaaatggcaagtaaattacttgatctttttggtgcttaatttgcaaatgttttgttcctttgtcctgacttaaaggcagttttctgaagaactcttgactcttgctcctatggttcccataggcacacctattcccaggccaaggagagtccttcctctccccttttgaggcatccccgccatccccccacttagagctatgtgctcaaaaagccaacatgaatgcagtggtaaaaatttgttagtttcttatactttttagaatctctcaataaaatttttctaaataaattccacaaaaacaaagggtgaagatggtctctccctttcgttccccttcactcagttgtgctgaggtcaatagagtgtagagtttcagaaaggattccagcaggtttatatgtgaatataagtgtccctgaatggggcaggcattaaatagaagaatccctgctgtttaaatttcccgcatattccaattcacttttaaaaaataccatttgaatttgtatttcataaagtgactctggggtgcttactttagtcaattcttaaaattttttatttgttccctaagaaagtaattactgtttctgttgcctggacagttacagtttccaggaaacatcaggaagtaggaaactgtagggccagagagtagtacaacgttaaattgtccgatttatgtgtattacttaaagctataaattgaactagatcttgccgtgctctgtattgagtataatttgtatacttttttataattaatgactaaatgatcactttggaggcagggtggtgggggtgtattagcagccaaataagcatatctgatcaaaaagaaccaggcttagattttttttaagtacattgatgttgatgttccaccagaaacaccttaagtgtatactgttgtgtaatgtctctagaaaggaatcctgtcttaaaactgggttttgctgttttttgaagtttctacctaaaatcatttttggtatatcctgataatctctataatactagaattgtctgcaaaatatagtaagaagaattggagcctaatagctgattcctcccaatttatctgttatgttttgtcactattcacattttagtcttttctacgataaaaattgtatgtgtactttcatgccagtataggaaacctcaatcttttttttttttcgcctttaagaaggttttcagtgattatacctcaggtatttctgagtgtcctattgtctaataggagaaatatcttcccgagctcagaattaaaagttctcctaaattatgaagatcccaaatcttatgtaaataaccttaggcatgagtccttagggagaagttaatgaccattgttaaagtgcttttttagaaaatgttgtgctgtatgttcttgatctgacataaatgaatagactttggcaagggaggaaataagttaaaaggcagcttacaagagcctattccctataaagggtataattttacacagtactcaaagcttgttatcttttctgaccattttagtacagaattagtacttggtggttactaacatcaacttgtgacatctagaactagggctcttagtgtttagtgggccacttctctgatgtcagatgcatgcagacctgtactccacatgcaacccaacagcagtgcagtgtgataactgagcggtcgcatggcagaggacatccccctcagagtgggcacaagtgccctctagggcagccaggggaatactattgttcgatacctgggatttgactttgtcaaacagctctttgtgcccctatctttgttttgtcaaatgtagatcagttaataaacatgagtagcttgaattttc

SEQ ID NO: 26 - DNA, 5956 bp, Homo sapiens
  ref <308>: DATABASE ACCESSION NUMBER: AB011132
  ref <309>: DATABASE ENTRY DATE: 2001-06-18
caaagctcttgactcgctagctcagccccaacgcctgcatgaacttccggctacacgccattccgcttcccgaggaacgcttgggctgttgtacgggttccctacgggactctgaagactgaggatatccggcccggagcgtttgtgcggcgcggagttaagcgccccggcagtaacttaagggaagtggaccagggttgccgctgcccagagcggtcctttagtttccactggagtggagggaagagtgctgccatggcagcccctgcgcagcccaagaagatcgtggcccctacggtgtcccaaatcaatgcggagttcgtgacccagttagcatgtaaatactgggctccccacatcaagaagaaatcaccttttgatataaaggttattgaagatatatatgaaaaagagattgtcaaatcaaggtttgctattagaaagataatgctcttggaatttagccagtatcttgaaaattatctctggatgaattattctcctgaggtatctagcaaggcctatttaatgtcaatctgctgtatggtgaatgagaagtttagagaaaacgtgcctgcatgggagatttttaagaagaagccagaccacttcccattcttttttaaacacatcttgaaggcggcattagctgaaactgatggtgaattttcacttcatgaacagacagtcttactactttttcttgatcattgcttcaatagtttggaagtagacttgatacgaagtcaagtacagcagcttatctccctcccaatgtggatgggcttacagctggcacgattggaattagaattaaaaaagacacctaagctaagaaaattctggaacttgattaaaaagaatgatgaaaagatggatccagaagcaagagaacaggcatatcaagagaggagatttctttcacaactcatccagaagtttatctctgtgctgaaatcagtcccactttctgaacctgtcactatggacaaagttcattactgtgaaagattcattgaacttatgattgatctagaggccctgctacccacaaggcgctggtttaataccatcctggatgattcccaccttctggttcactgttacctttccaatcttgttcgtagagaagaggatggccatcttttttcccagcttttggacatgcttaaattctatactggttttgaaattaatgaccaaactggaaatgctctgacagagaatgagatgaccacaattcactatgatagaattacttctctacagagagctgcttttgcacattttcctgaactctatgattttgccctctcaaatgtggcagaagtagatactcgggagtccttggtcaagttttttggacctcttagttcaaacacactccaccaggtggcatcatacctctgcttgttgccaactcttcctaaaaatgaagacacaacttttgataaagaatttcttctagaattgctggtatctcgtcatgaacgtcgaatttctcagattcagcagttgaaccagatgcctttgtatccaactgagaaaattatatgggatgaaaatattgtcccaactgagtactattctggagaaggttgtcttgctcttcccaaattgaatttgcagtttttgactcttcatgactacctgctaaggaactttaacctcttccgcttagaatcaacttatgaaattcgtcaggacattgaagatagtgtcagcagaatgaagccatggcaatctgaatatggcggtgtagtgtttggtggttgggcgcgaatggcccagcccattgtggctttcactgtcgttgaagtggccaaacccaacataggtgaaaactggccaacccgagttcgtgcagatgttaccataaatctcaatgtcagagatcacatcaaagatgaatgggaaggtcttcgtaagcatgatgtatgctttttaattaccgtacgtcccacaaaaccttatggcactaagtttgaccggaggagaccttttattgagcaggttggcctggtttatgtcagaggctgtgaaattcagggcatgctggatgataaaggacgtgtcattgaagatggacctgaacccagacccaatcttagaggagaatcaaggacatttagagtgtttttggatccaaaccagtatcaacaagatatgaccaatactatacaaaatggagcagaggatgtgtatgaaacttttaatataataatgaggagaaaaccaaaggaaaataactttaaggctgtgctggagactattcggaacctgatgaatactgattgtgtggtacctgactggctgcacgatatcattttaggttatggggacccaagtagtgcacattattcgaaaatgcccaatcagattgccacccttgatttcaatgatacatttctctccattgagcatttaaaagccagcttccctggtcataatgttaaagtaactgtagaagaccctgctctacaaataccccctttcaggataacttttccagtaagaagtggaaaagggaagaaaaggaaagatgcggatgtggaagatgaagacaccgaggaagcaaaaaccttaattgttgagccccatgttattcctaataggggtccttatccttataatcaacccaaacgtaatacgattcagttcactcatacacagatagaagccatccgtgctggaatgcagcctgggctgactatggttgtgggcccacctggtacaggcaaaacagatgtggcagttcagatcatatccaacatctaccacaacttcccagaacagaggactctaattgttactcattccaatcaggccctaaaccagttgtttgagaaaatcatggcattagacattgatgagcgccacctactgcgtcttggtcatggagaagaagagctggagacagagaaagatttcagcaggtatggaagagttaattatgttctggctcgaagaatagaacttttagaagaagtcaaacgattgcaaaagagtctaggggttccaggagatgcctcatatacctgtgaaactgcaggctatttcttcttataccaggtaatgtctcgctgggaagagtatatcagcaaagtgaaaaataaaggtagtacattgccagatgttacggaagtctccactttcttccctttccatgaatactttgcaaatgctcctcaacccatttttaaaggaagatcttatgaagaagacatggaaattgctgaaggatgtttcaggcatattaagaaaatctttacgcagcttgaggaattcagagcctctgaattgcttcgaagtggactggacagatctaaataccttttagtgaaagaagccaaaattattgctatgacctgtactcatgctgccttaaaacgacatgacttggtcaagctaggtttcaagtatgacaacattttgatggaagaggctgctcagattctggagatagaaacttttatccctcttcttctacagaatcctcaggatggatttagccgactaaaacgatggattatgattggcgatcatcaccagttacctccagttattaagaacatggcctttcaaaagtactcaaacatggagcagtctctcttcactcgctttgttcgcgttggagttccgactgttgaccttgatgctcaagggagagccagagcaagcttgtgcaacctctacaactggcgatacaagaatctaggaaacttaccccatgtgcagctcttgccagagtttagtacagcaaatgctggcttactgtatgacttccagctcattaatgttgaagattttcaaggagtgggagaatctgaacctaatccttacttctatcagaatcttggagaggcagaatatgtagtagcactttttatgtacatgtgtttacttggttaccctgctgacaaaatcagtattctaacaacatataatggccaaaagcatcttattcgcgacatcatcaatagacgatgtggaaacaatccattgattggaagaccaaacaaggtgacaactgttgatagatttcaaggtcaacagaatgactatattcttctttctctggtacgaaccagggcagtgggccatctgagggatgtccgtcgcttggtagtggccatgtctagagccagacttggactttatatcttcgccagagtatccctcttccaaaactgttttgaactgactccagctttcagtcagctcacagctcgcccccttcatttgcatataattccaacagaacctttcccaactactagaaagaatggagagagaccatctcatgaagtacaaataataaaaaatatgccccagatggcaaactttgtatacaacatgtacatgcatttgatacagactacacatcattatcatcagactttattacaactaccacctgctatggtagaagagggtgaggaagttcaaaatcaagaaacagaattggaaacagaagaagaggccatgactgttcaagctgacatcatacccagtccaacagacaccagctgccgtcaagaaactccagcctttcaaactgacaccacccccagtgagacaggagccacttccactccagaagccatccctgctttatctgagaccacccctactgtggtaggagctgtatctgcaccggcagaagctaacacacctcaggatgccacatctgccccagaagagaccaagtagccaaactgtagtccttctaaaggaggacatggcagtcaaaaagtctgagtaaagctgttttttgtattttatatttgcttctgccattttactgtcactaattaatgtttagttcttatatttgttaactgatttcggtgtcttgaatatatttttttaaattatgtgtatgaacaattctagtttcatttgttcaatcagaagagcaaataaccattcctttcatgttttgatcactgagtgtgtctgtaatcatacctacattaaaatcattttctatgaatatataatatatacttcacatttttagtgaacttctctaaagaagaggacagaatatactggacttaaccacgaatacccttgagtgtccaaattgggaaggaacttgtttcttctgttatactatcaaatgcttaaattctgtttccttttttcttacctttgtttgctgtctttatgtaaagatattattagcagtaagatacaggtttcttcaatctatcaaagtggttacatgcatttccttctctcaaatcttagaatgccttagaatcacctaagatgtctgtttattcttgaggcacacctcagactgaatgagtcagaatctcaggattagagcctaggaatctatattttaggaggttctccacaccactaatgtttgggttgctggcagagtggcatcagccaaggctggttaggctgagccaggatttgtcatcagctaaataggaggactctgccaaatcaatctgggcaagaagcaggatcctgagtctgggcaatgagagtcagagaacttaactcctgtgtgcagggtagaattttcccatggcagaaattctgagttttctgccttatttttcttgggataaccagccacagggagaccttcaggtaaaatgtggttcaaatatgggaaggcagaggtacctgggaccttgctactcaagtatgatttgtgaaccaacagcatcaacatcgtattgaagtttgttatttatagaaatgcagaagtttgggctctgctccaaacctattaaatctaaatctacattgcaacaaagtccccaggtgattcacaggcactttgtagtttgagaagcactgtactaagattactgtgttgtcttcacatgaatgaggctataatgtagaattaccagtgaatgtgactaatgttttctgacaagggacctctgcttacaaggtccctgggcatggtgcccagaactgg

SEQ ID NO: 27 - DNA, 5042 bp, Homo sapiens
  ref <308>: DATABASE ACCESSION NUMBER: AB011152
  ref <309>: DATABASE ENTRY DATE: 2001-06-18
agccgagactgaaaaggagaaacaagactggattgaagctgtgcagcaatcaatagcagaaactctctctgattatgaagtagctgagaagatttggttcaatgaatccaacaggagctgtgcagattgtaaagccccagatcctgactgggcatccatcaatctctgtgttgtcatctgtaagaagtgtgcaggacagcatagatctttaggaccaaaagattccaaggttagaagtctaaaaatggatgctagcatttggagcaatgaactcatcgagctttttattgtcattggaaacaaaagagcaaatgacttttgggctggtaatcttcaaaaggatgaagaattacatatggactcaccagtagaaaagagaaaaaactttattactcagaaatataaagaaggaaaattcagaaaaactcttttggcatctctcaccaaagaagaattaaataaggctctatgtgctgctgtagtgaaaccggatgttctagaaacaatggctttgctgttcagtggagcagatgtcatgtgtgccaccggagaccccgtgcatagcaccccctatctgctagccaagaaagctgggcaaagtctgcaaatggaatttctctaccataacaaattctcagatttccctcaacatgatattcattccgagggtgtattaagtcaagagtcttcccagtccacattcctctgtgactttttatatcaagctccttctgctgcttctaaactctcttcagagaaaaaactgcttgaagagacaaataaaaaatggtgtgttttggaaggaggcttcttgagttactatgaaaatgataagtctaccacacctaatggcaccattaatatcaatgaagttatctgcctggctatacacaaagaggacttctatttaaatactgggcccatctttatctttgagatctacttaccctccgaacgtgtgtttttatttggagctgaaacatctcaagctcaaagaaaatggacagaggcaatagccaagcattttgttcccttatttgctgaaaacttaacagaagctgactatgatttgattggtcaactcttctacaaagactgccatgccctggatcagtggagaaaaggctggtttgctatggacaaatccagcttgcatttttgccttcaaatgcaagaagttcagggagatagaatgcacttaagaagactgcaagagctaacaatcagcacaatggttcaaaatggggaaaaactggatgttttactcttggtagaaaaagggagaacattatacatccatgggcataccaagttggatttcacagtctggcatactgcaattgaaaaagcagcaggtacagatggtaatgctttacaagatcagcagctcagcaaaaatgacgttcccattatagtgaacagctgtatagcatttgttacacagtatggtttaggatgcaaatatatctatcaaaagaatggtgatcctttgcatataagtgaactcctggagagtttcaaaaaggatgcaagaagctttaaattgagggctggaaaacatcagcttgaagatgtgacggctgtgttgaaaagttttctctctgacattgatgatgcactgcttactaaggagctctacccatattggatctctgctttagatacgcaagatgacaaggaaagaattaaaaaatatggagcatttatacgttctcttccaggggtcaaccgagcaacactagcagctatcattgaacacctgtatagggttcagaaatgctcagaaatcaatcacatgaatgcccataatttggccttggtcttttcatcctgtttgtttcaaacgaagggacaaactagtgaagaagtgaatgtaattgaggacctaattaataattatgtagaaatatttgaggttaaagaagatcaagtcaaacaaatggacatagaaaatagctttattaccaagtggaaagacacccaagtttcccaggctggagatttgttaattgaagtatatgtagaaaggaaggaacccgactgtagtattataattcggatatctcctgtgatggaagcagaagaattaactaatgatatattagcgataaaaaatattattcctacaaaaggtgatatttgggccacatttgaagtcattgaaaatgaagagctagagcgtcctcttcactacaaggaaaatgtactggagcaggtgcttcggtggagttcattagctgaacctggctctgcttacctggtggtgaagagattcttaaccgctgacacaattaaacactgcagtgaccggagtacactgggaagcatcaaagaaggaatcttgaaaatcaaagaagaaccatccaaaatactatctggaaataagtttcaagaccggtattttgttttacgagatgggtttctctttctttacaaggatgtgaagagtagtaaacatgacaagatgttttctctcagttccatgaagttttatcgtggagtgaaaaagaaaatgaagcctccaacaagctggggattgaccgcatattctgagaaacatcactggcacctgtgttgtgatagttcacaaactcagacggagtggatgaccagtatctttattgcccagcatgaatatgatatatggccaccagctggaaaggaacgaaaacgttcaataaccaaaaatcccaaaattggaggtttgcctctgattcctatacagcatgaggggaatgcaaccttggcccggaaaaatattgagagtgcaagagcagaacttgaaaggctgcggctcagtgaaaagtgtgataaagagtccgtggactctagcttaaaggagagagcttccatggtggcccactgcctggagcacaaggacgataaacttcgaaatcgaccccgaaaacatcggagtttcaactgcctggaggacacagagcctgaagccccacttgggcaaccaaaaggccataaaggcctaaagacattgaggaagactgaggacaggaatagcaaagctactttggactctgatcataagttaccatcaagggtaattgaagaacttaatgtggttctacaacggtcaagaacccttccaaaagaattacaggatgagcagattttgaagtaggaaataaaatgaattgctccccagattatttttttaatattgtatgcaatctttatgtgtaactccaaaactgaactataagataattcataagaatttgcctattgataggcaaatttgtctatgcttaggcatttaaggagcatttaaaaatatgtatatatgtgactgaatgtaagattaactttattttggtctgaacaaaccttgtaaagttccattgtattaacgtgtgtaagaagacattgggttacttaggtggtcagtccttttaaagtagttgtctgttaagtggtataatttatgagcagaaatctcaaactgtactgtattgtataaaatgctgtgtttaaatgaagcctaagaaactatctgtaacatattttgcactttgagaaaccttgtatattaaattaccatatgtttttaggtttacagaagttctaccttagggaaaagaaagggaagtaaattgaaaaaggggggagaatttattgtagtggctgcctaaaaaccactggagtttttaaaagaagcaaggagttaaatgtcctgcaaaacaaggaagtgagctaagattcattctagttcactaatgaccagaacttgtcaatgagaaaccacttgttaagaaaaagtccagtgtttatttctcaagagtaatattcggccaacagatgtaaataatagcactagccactcttattaatatttatagtgttagaaaaccagccacattacagattcactacgtttgagctcattgttggtggctgctaagaggaaacttacactgcattggagaggttgtgtacacaggacctggcctggatgctgattgcactgtcattgtatgcaagcattttgtcttttttcagaatttctgactatacttttggtacgaacaaaattcatcaccacagggtcctgttgttttgtttgatttttagatttttttaaattattattaaggttgtaatgtttttctccgagttgtcagaaataactggaagaatacaatatatggccattatggagccaggggctagttggtggtttactatacatttgggggctacctggtcacatttaatctaggtttttttttctttttttaagtaaaggtgtggtctcttccctgtacttatgaataaggacaaagccctatttttgtttccacataaagatcagctactgaattggtgaatttcctgacagacaatgctatctaaccatagttcacgttaggggaagcatttttccatcagtttctttaaaattggattgtctggtgagttttgatattaaacattatgtagctaagtttttttttttagcatttcttttttatttttcaatctatattcacaggcccatacttcagtcagtccaatcatagtacagtgatgtggtggtagatgctatgaatttcttcattgtaaaatacggatcatttgtattttggggtgataaaatagttcaccatgggtatgagatatttattctttaaatcaaagtaaattagaatttttaaaaagcacaaaactgcaggacagtttatgaaataggtggcactattagggaatcttcctttaaagcaagaaatcatgttatttagaaagaaaaactaatcttaaacatactatttctaataaatatttatatttttatgaaataaagaggtatgtggaaattaatatttggtgatgttggacagtggaaaagtatctagagtttttacctgccttatctgaattcttcttgaaacttgagcttaaactctaatagctgtttccctttctattctgaacaactgtctccatttttcaagtgtgagagataagggctaatgatgacatctcatttattttgagtaaacattaaaattgttttacaagtctacttg

SEQ ID NO: 28 - DNA, 3311 bp, Homo sapiens
  ref <308>: DATABASE ACCESSION NUMBER: AB011179
  ref <309>: DATABASE ENTRY DATE: 2001-06-18
cgcgctgggagaagacttcgccgctcggggccgcagcctgttgggcaaggcgagcatcatggcctcggattgcgagccagctctgaaccaggcagagggccgaaaccccaccctggagcgctacctgggagccctccgtgaggccaagaatgacagcgagcagtttgcagccctgctgctagtgaccaaggcagtcaaagcaggtgacatagatgccaaaactcggcggcggatcttcgatgctgtcggcttcaccttccccaatcgtctcctgaccaccaaggaggcgccggatggctgccctgaccatgttctgcgggctttgggtgtggccctgctggcctgcttctgcagtgaccctgaactggccgcccatccccaagtcctgaacaagattcccattcttagcaccttcctcacagcccggggggacccggacgatgctgcccgccgctccatgattgatgacacctaccagtgcctgacggctgtagcaggcacacccagagggcctcggcacctcattgctggtggcaccgtgtctgccctatgccaggcatacctggggcacggctatggctttgaccaggccctggcactcctggtggggctgctggctgctgccgagacacagtgctggaaggaggcggagcccgacctgctggccgtgttgcggggcctcagtgaggatttccagaaagctgaggatgccagcaagtttgagctctgccagctgctgcccctctttttgcccccgacaaccgtgccccctgaatgctaccgggatctgcaggccgggctggcacgcatcctgggaagcaagctgagctcctggcagcgcaaccctgcactgaagctggcagcccgcctggcacacgcctgcggctccgactggatcccggcgggcagctccgggagcaagttcctggccctgctggtgaatctggcgtgcgtggaagtgcggctggcactggaggagacgggcacggaggtgaaagaggatgtggtgaccgcctgctatgccctcatggagttggggatccaggaatgcactcgctgtgagcagtcactgcttaaggagccacagaaggtgcagctcgtgagcgtcatgaaggaggccataggggctgttatccactacctgctgcaggtggggtcagagaagcagaaggagccctttgtgtttgcctcggtgcggatcctgggtgcctggctggccgaggagacctcatccttgcgtaaggaggtgtgccagctgctgcccttcctcgtccgctatgccaagaccctctacgaggaggccgaggaggccaatgacctttcccagcaggtggccaacctggccatctcccccaccaccccagggcccacctggccaggagacgctctccggctcctcctgcctggctggtgccacctgaccgttgaagatgggccccgggagatcctgatcaaggaaggggccccctcgcttctgtgcaagtatttcctgcagcagtgggaactcacatcccctggccacgacacctcggtgctgcctgacagcgtggagattggcctgcagacctgctgccacatcttcctcaacctcgtggtcaccgcaccggggctgatcaagcgtgacgcctgcttcacatctctaatgaacaccctcatgacgtcgctaccagcactagtgcagcaacagggaaggctgcttctggctgctaatgtggccaccctggggctcctcatggcccggctccttagcacctctccagctcttcagggaacaccagcatcccgagggttcttcgcagctgccatcctcttcctatcacagtcccacgtggcgcgggccaccccgggctcagaccaggcagtgctagccctgtcccctgagtatgagggcatctgggccgacctgcaggagctctggttcctgggcatgcaggccttcaccggctgtgtgcctctgctgccctggctggcccccgctgccctgcgctcccgctggccgcaggagctgctccagctgctaggcagtgtcagccccaactctgtcaagcccgagatggtggccgcctatcagggtgtcctggtggagctggcgcgggccaaccggctgtgccgggaggccatgaggctgcaggcgggcgaggagacggccagccactaccgcatggctgccttggagcagtgcctgtcagagccctgaggggtgtccaccggggacagacccaggggcgggcagagagggaaggagggaggaggcatcttccctgaagcccccaatctggcccccccctccccagacttcctccccaaaacaccccagctttctggcttttctgagggcaagggcatggtgcccacccctcaagtgtaaggaactgcgttccgccctcaggcccccatgggggcagggatcggcttggaaatcaacgtggttgtccccgccaggccggggaaggttggagcagcccccagggaggggggcactaggtgtcattgtgcccgatgtctggctcccctgcaggagggaggctccagggtaagacagggctggcaggagcagactgcctcagcccatgtgccctgccggccagggcgtgggctcccctcggctgtggtgcctcctctggccccccaggtccacgtcctttaaattggccctttggctcttgcccttggctcccttgggcagacagcaggcttaggccattgatatcgcagttcttcctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatccctgcttggacacctgagcatctgattcctgtccccctggtgccatctggcctggctggagccaggaacaggagggacacttccccagaatccgcatgtttccccagtgattacactccactgccaccgtggtgcctggctttaactcccacccctgctatgactcctctctgcagagacgcgactggcggctccagcagggactacctttcttataaacccagggggaccacacacacacacacacacacacacacacacacacacacacacacacacacacacactcttgatcccttgcttccctcccccagtgcgttctgtgatcgccaagttcaaagctgtgcacatgtggacactcaataaatgttcattggtg

SEQ ID NO: 29 - DNA, 4591 bp, Homo sapiens
  ref <308>: DATABASE ACCESSION NUMBER: AB014534
  ref <309>: DATABASE ENTRY DATE: 2001-06-18
ggttcgcttcggcgtccgccgtctccgcagctgcctcctcttcctccttcgccaccgccgccaccgccgccgccgcccgcagcaccgcagcccctcccgccatggccgccgccggcgcccggctcagccccggccccggctcggggctccgggggcggccgaggctctgcttccacccggggccgccgccactgctgccgctgctgctgctgttcctgctcctgctgccgccgccgccgctgctggccggcgccaccgccgctgcctcgcgggagcccgacagcccgtgccggctgaagaccgtcacggtgtccacactgcccgccctgcgggagagcgacatcggctggagcggcgcccgcgccggggccggggctgggaccggggccggagccgccgccgccgccgcgtccccgggctctcctggctctgccggcaccgccgccgagtcgcgcctcctgctctttgtgcgtaacgagctgccggggcgcatcgcggtgcaggacgacctggacaacaccgagctgcccttcttcaccctggagatgtctggcacagcggcggacatctcgctggtgcactggagacagcagtggctggagaatggcaccttgtacttccacgtctccatgagcagctccgggcagctggcccaagccaccgcccccactctccaggagccctcggagattgttgaggagcagatgcacatcctccacatttctgtgatgggtggcctcatcgcgctgctgctgctgctgctggtgttcaccgtggcgctgtacgcccagcgacgttggcagaagcgtcgccgcatcccccagaagagcgcaagcacagaagccactcatgagatccactacatcccatctgtgctgctgggtccccaggcgcgggagagcttccgttcatcccggctgcaaacccacaattccgtcattggcgtgcccatccgggagactcccatcctggatgactatgactgtgaggaggatgaggagccacctaggcgggccaaccatgtctcccgcgaggacgagtttggcagccaggtgacccacactctggacagtctgggacatccaggggaagagaaggtggactttgagaagaaaggaggaatcagctttgggagagccaaggggacgtcgggctcagaggcagacgatgaaactcagctgacattctacacggagcagtaccgcagtcgccgccgcagcaaaggtttgctgaaaagcccagtgaacaagacagccctgacactgattgctgtgagttcctgcatcctggccatggtgtgtggcagccagatgtcttgtccactcactgtgaaggtgactctgcatgtgcccgagcacttcatagcagatggaagcagcttcgtggtgagtgaagggagctacctggacatctccgactggttaaacccggccaagctttccctgtattaccagatcaatgccacctccccatgggtgagggacctctgtggacaaaggacgacagatgcctgtgagcagctctgcgacccagaaaccggagagtgcagctgtcatgaaggctatgcccctgaccctgttcacagacacctgtgtgtgcgcagtgactggggacagagtgaaggaccttggccctacacgacacttgagaggggctatgatctggtgacaggggagcaagcccctgaaaagattctcaggtctactttcagcttgggccaaggcctctggcttcctgtcagcaaaagctttgtggttccgcctgtggagctgtccatcaaccccctggccagctgcaagaccgatgtgctcgtcacggaagaccctgcagatgtcagggaagaagcgatgctgtccacatactttgaaaccatcaatgacctgctgtcttccttcgggccagttcgtgactgctctcggaacaatgggggctgcactcgcaacttcaagtgtgtgtctgaccggcaggtggattcctcgggatgtgtgtgccctgaggagctgaaacccatgaaggatggctctggctgctacgaccactccaaaggcattgactgctctgatggctttaatggcggctgtgagcagctgtgcctgcagcagacgctgcccctgccctacgatgccacttcgagcaccatcttcatgttctgcggttgcgtggaggagtacaaactggctcctgatggaaaatcctgcttaatgctctcagatgtctgcgagggccccaagtgcctcaaacctgactccaaattcaatgataccctctttggagagatgctacatggttacaacaaccggacccagcatgtgaaccaaggccaagtcttccagatgacctttagggagaacaacttcatcaaggactttccccagctggccgatgggctgttggtgatcccgctgccggtggaggagcagtgccggggggtcctctccgagccccttccggacctccaactgctcactggagatatcaggtatgatgaggccatgggttaccccatggtgcagcagtggcgggtccggagcaacctctaccgtgtgaagctcagcaccatcaccctcgcagcaggcttcactaatgttctcaagatcctgaccaaggagagcagtcgggaggagctgctgtccttcatccagcactatggctcccactacatcgcagaggccctctatggctcagagctcacctgcatcatccactttcccagcaagaaggtccagcagcagctgtggctccagtatcagaaagagaccacagagctgggcagcaagaaggagctcaagtccatgcccttcatcacctacctctcaggtttgctgacagcccagatgctgtcagatgaccagctcatttcaggtgtggagattcgctgtgaggagaaggggcgctgtccatctacctgtcacctttgccgccggccaggcaaggagcagctgagccccacaccagtgctgctggaaatcaaccgtgtggtgccactttataccctcatccaagacaatggcacaaaggaggccttcaagagtgcactgatgagttcctactggtgctcagggaaaggggatgtgatcgatgactggtgcaggtgtgacctcagcgcctttgatgccaatgggctccccaactgcagcccccttctgcagccggtgctgcggctgtccccaacagtggagccctccagtactgtggtctccttggagtgggtggatgttcagccagctattgggaccaaggtctccgactatattctgcagcataagaaagtggatgaatacacagacactgacctgtacacaggagaattcctgagttttgctgatgacttactctctggcctgggcacatcttgtgtagcagctggtcgaagccatggagaggtccctgaagtcagtatctactcagtcatcttcaagtgtctggagcccgacggtctctacaagttcactctgtatgctgtggatacacgagggaggcactcagagctaagcacggtgaccctgaggacggcctgtccactggtagatgacaacaaggcagaagaaatagctgacaagatctacaatctgtacaatgggtacacaagtggaaaggagcagcagatggcctacaacacactgatggaggtctcagcctcgatgctgttccgagtccagcaccactacaactctcactatgaaaagtttggcgacttcgtctggagaagtgaggatgagctggggcccaggaaggcccacctgattctacggcgactggagagggtgagtagccactgctccagcctcctgcggagtgcctacatccagagccgcgtggaaacagtgccctatcttttctgccgcagcgaggaggtccggcctgcaggcatggtgtggtatagcatcctcaaggacaccaaaatcacgtgtgaggagaagatggtgtcaatggcccgaaacacgtacggggagtccaagggccggtgagggagggtattgccctccgtgagcacagagactctccatgggagggggagcagtattctcctggatcctggggcctgggtgggctgggggacagctgaggatgggcctagcagatgaagcttgccagcaaggccaaagcaaacggtttctcctgtggatagtggacagagacctttgtaaccaatggaattattcatttttctctatcttttattttttcaaagatattatttgactctatcaaaagtctctcctttttaaaccttttcttatggatggctgtcaatcccaaggcagaagttttcaggtggagaccaagcggcctttgctcttcttccttcttcctgccacactctgctttcttcctgccatggacccctggaggagacctatggagggacagttttgacctgacccctagaggagacagttttgacctcttcagcaccaggaaggaagctctgaggatggttgcagtgaggaagcatgggtctttaaggacttctctctcttttttgctggacattattgagtttgtgggaccctgcctcttcctgctacctgtgggtctgcccagagtccctgcaggcctgtccatgcattaaaaattcctattgtctctc

SEQ ID NO: 30 - DNA, 3767 bp, Homo sapiens
  ref <308>: DATABASE ACCESSION NUMBER: AB014568
  ref <309>: DATABASE ENTRY DATE: 2001-06-18
gctaagaggagtccctgtgtgggcagctggagccttcagattctcttcaggggaagagtccacatcccacctcatcatgtcccgaagaagccagcgcctcacgcgctactcccagggtgacgatgacggcagcagcagcagcggagggagctcggtggctgggagtcagagcaccctgtttaaagacagtcctctcaggaccttgaagaggaaatccagcaacatgaagcgcctgtccccagcgccacagctgggcccgtcctctgatgcacacacctcctactacagtgagtcgctggtccacgagtcctggttcccacccaggagctccctggaggaactgcatggtgacgccaactggggtgaggacctgcgggtgcggaggaggagaggcacgggtggctcagagagcagcagggccagcgggcttgtggggcgcaaggccaccgaggacttcctgggctcttcctcgggctactcctctgaggacgactacgtgggctactcggatgtggaccagcagagttccagctcgcggctccgaagcgccgtctcacgggcgggctccttactctggatggtggccacttcgccaggccggctcttcagacttctctactggtgggctggcaccacctggtaccgcctgaccacagctgcctccctccttgacgtcttcgttttaaccaggcgcttctcgtccctgaagacgttcctctggttcctgctgccgctgctcttgctgacgtgcctgacgtatggtgcttggtatttctacccctatgggctgcagacattccaccctgctttggtttcctggtgggcagcgaaggacagcaggaggccggatgagggctgggaagccagagactcatcgccacatttccaggctgagcagcgtgttatgtcccgggtacactctctggagcggcgtctggaagctcttgctgctgaattttcctccaactggcagaaggaggccatgcggctggaacgtctggagctgcggcaaggggctcctggccagggaggtggtggtggcctgagccacgaggacaccctggcgctgctggaggggctagtgagccgccgtgaagctgccctgaaggaggatttccgcagggaaactgctgctcgcatccaggaagaactgtctgccctgagagcagagcatcagcaagactcagaagacctcttcaagaagatcgtccgggcctcccaggagtccgaggctcgcatccagcagctgaagtcagagtggcaaagcatgacccaggagtccttccaggagagctctgtgaaggagctgaggcggctggaggaccagctggccggcctgcagcaggagctggcggctctggcactgaagcagagctcggtggcggaagaagtgggcctgctgccccagcagatccaggccgtgcgggacgacgtggaatctcagttcccggcctggatcagtcagttccttgcccgaggtggagggggccgcgtggggctccttcagagagaggagatgcaagctcagctgcgagagctggagagcaagatcctcacccatgtggcagagatgcagggcaagtcggccagggaagccgcggcctccctgagcctgacgctgcagaaagaaggtgtgattggagtgacagaggagcaggtgcaccacatcgtgaagcaggccctgcagcgctacagtgaggaccgcatcgggctggcagactacgccctggagtcaggaggggccagcgtcatcagcacccgatgttctgagacctacgagaccaagacggccctcctcagcctcttcggcatccccctgtggtaccactcccagtcaccccgagtcatcctccagccagatgtgcacccaggcaactgctgggccttccaggggccacagggcttcgccgtggtccgcctctctgcccgcatccgccccacagccgttaccttagagcatgtgcccaaggccttgtcacccaacagcactatctccagtgcccccaaggacttcgccatctttgggtttgacgaagacctgcagcaggaggggacactccttggcaagttcacttacgatcaggacggcgagcctattcagacgtttcactttcaggcccctacgatggccacgtaccaggtggtggagctgcggatcctgactaactggggccaccccgagtacacctgcatctaccgcttcagagtgcatggggagcccgcccactagccctgcttactggtgcctgctgccagccatctgggagtgggtgaacagcaccccgccgcttcccccacacgcttgctcggcgctctgacttctaggagcacaagagaggagcctgtggccccatgcagatgaaaaggacgggcagggtctcctgagcagcaggtggctcgaggcggttagcaggctccagcagctcccttcttccttccctctgtgcccgtggcgtctgcttcccatcctgggagtgtgtatatatgtagcatatcatgggggactgggaagttgggagaggtaggacctgactggtcttggctggggtcaggggctggtgcctgggagctgatgaagcaggtgccagggctgtgggaggggcaagctacggcctgggctaggtgagctgcctctgcccctgggcaaggaagcgaggccctctgggaggagggtgcttagctccagagcaggatgggacttccccaggcaggaagcacttgatggagagctgcccagctctcctacaaggttagtgccctccacctagggaagcctgaaccacagggtccctgagggccttcgacaaaagtgtgtatttgtcccggggagggtagcagtgggccatggggcttcttgtgccctaaaggggactggctgctgtgatcttctaaggggcccagggccaaccctgtaggcttcccctctgctggggacggtagttgcttttctctctcctgatgctaggttggggcccaccctgctccctgttcctgctagggcctgccagtgcccctgagcttgctttccacattctcccagggtatggagacctagacctgtctttggggccattagcatctggggttatagcaagaagagtggggagcatggaactcctgggctcttgtggggacgttcagggtatcggggtgcgaggtctgtctgcaccggcccccacatctaaccaggccctgatgtaggggtcgtccgctcaggctgcccccttgggctcttgcagctcttgttcaggtagtcgcccttctggtttgttctctgtggggcagttggtgggggctgggggaagaggctggcagaagttaccctggatagggaagggggaggaggggacttttagagccagcaggccccactgtattatgtatatatttttcaaggtctgtttttctaactgaaaagctaagggcttgattcctagccccgttctgtggggcactgggtgatactcagtttcttgttcctggccgtggagaggggcctggggcactggttccggctgtgtctggtggtccggctgcagggaaggggcaagaaggcgggcaggccttcactgcagcactgagcctcaaatccgctctggagcatgaggctggatgcagtggtggtgaggccgccccgctccatcccgaggcagccaggctttgttttgcgctctcctgtcacaaatgctgcactattggttcttaagttttttatctccagatcctaatttatgcctatgcaaaaaataaatgacgcccaagagctg

SEQ ID NO: 31 - DNA, 5449 bp, Homo sapiens
  ref <308>: DATABASE ACCESSION NUMBER: AB018260
  ref <309>: DATABASE ENTRY DATE: 2001-06-18
atttttttctcctcctttttttaccctcccgtttttttcttttcttttttttttccctatcctttttttgtgaatgaaaaaaggaggtcgcgagcggtacctgggactgcagcgccaggcgtcttcgcggcagcgccttcgccgcgggcccgggcgcgtagcggcggcggcctcgcccctctcccggcgcccctgcgcgccgcccgctgcctccgcagcccggctccgcgcgccgccgtgacattgggcgcctggcgcgcggggcgatgctgatccggaaggggcagcggctgcagtgcagcgcgcgcgtccgctcctgggcccacgtccggcctgggctgccctgccggagtttctgagtggccgcgagctggccgggaggctggagcccagcagcagcgcggcggcgccggcgtcgtcccaacttgcaggcgcggagggacccctgacatttcactaaaatgagcgtgctcagcaggaagagatgtgttcctcacgctagaagccaccccgtcacatgtagtggtgtcccgtttaatggattctgacatggattatgaaaggccaaacgtagagaccatcaagtgcgttgtggtgggggacaacgccgtgggtaagaccaggctcatctgtgcccgcgcttgcaatgccaccctcacccagtaccagctgctggccacgcatgtgcccacagtatgggccatcgaccaatatcgtgtgtgccaggaggtgctggaacgctcccgagacgtggtagatgatgtcagcgtctctctgcgcctctgggacacctttggagaccaccacaaagaccgtcgctttgcttatgggagatctgatgtggtggttctgtgcttctccattgccaaccccaattccctccaccatgtcaagaccatgtggtacccagaaatcaagcacttctgcccccgagcacctgtcatcttggtgggctgccagttggacctgcgctacgctgacctggaggctgtcaacagggctaggcgacccttggctaggcccatcaaacctaatgaaatcctgcccccagagaagggtcgggaggtggccaaggagctgggcatcccctactatgagaccagcgtggtggcccagttcggcatcaaggacgtctttgacaacgccatccgagctgcactcatctcccgccgccacctgcagttctggaagtcccacctccgcaatgtgcagcggcctctgctgcaggcacccttcctaccccccaagccaccgcccccgatcatcgtggtgcccgaccctccctccagcagcgaggagtgccccgcccacctcctggaggacccgctctgcgcggacgtcatcctggtgctgcaggagcgggtgcgcatctttgcccacaagatctacctctccacctcctcctccaagttctatgacctgttcctcatggacctgagtgagggggagctggggggcccctcggagccagggggcacccacccagaggaccaccagggccactctgatcaacaccaccaccatcaccaccaccaccatgggcgagacttcctgctccgagcagccagctttgacgtgtgcgagagcgtggatgaggctgggggctccggtcctgctggcctccgtgcttccaccagcgacgggatcttacggggcaacggaacagggtacctaccgggcaggggtcgtgtgctgtcttcctggagccgagcttttgtgagcatccaggaagagatggcagaagatcctctcacctacaaatcccggctgatggtggtggtgaagatggacagttccatccagccggggcccttccgggctgtcctcaagtacctgtacacgggggagctagatgagaacgagcgtgacctcatgcacattgcccacattgctgagctgctcgaggtctttgatctgcgcatgatggtggccaacattctcaacaatgaggccttcatgaaccaggagatcaccaaggccttccacgtccgccggaccaaccgggttaaggagtgcttggcaaaaggcaccttctcagatgtgaccttcatcctggatgatggcaccatcagcgcccacaagcccctgttgatttccagctgtgactggatggctgccatgtttggggggccatttgtggagagctccacccgggaggtggtgtttccctacacaagcaagagctgcatgcgggccgtgctggaatacctctacaccggcatgttcacctccagccccgacctggatgacatgaagctcatcattctagccaaccgcctctgcctgccacacctggttgccctcacagagcagtacacagtgaccgggctgatggaagcgacccagatgatggtggacatcgatggggacgtccttgtgttcctggaactggctcagttccactgtgcgtaccagctggccgactggtgtctccaccacatctgcaccaactacaacaacgtgtgccgcaagttcccccgagacatgaaggccatgtccccagaaaaccaggagtatttcgagaagcatcggtggccacctgtgtggtacctgaaggaggaagatcattaccagcgggcacggaaggagcgtgagaaggaggactacctccacctcaagcggcagcccaaacggcgttggctcttctggaacagtccatcctccccgtcttcctcggcagcctcctcctcatccccatcttcctcctcggctgtggtctgagatgctgccaccctcttctgaccctgctgctgttgtccccatccgccttcacccctctgctcttccgcatcaccccatccaccttacagggaccagggggcccacgtaaccaggacccagagggtggagctcttcttaccagccaccgtggctcagccagagaggagctgagccctgtggagcagaacgggaaccacctgcagaggtccccagacccaaagcaggacgggagacaactgcttggaggagcgaagagccctggcattttatctctgggtttgagagccctagagtcaaagggaaagcctcccagcctccagggcttctctgtgtgtcttggttgctgctctggccagggaggcagccccactcccagcaagcagaagtgatcctcgagggtcctgcccctgttggccatatctttccaccgacggacttgagtgttgcatttgttttgtgggcatttccacacgaagcctactcacaccctcactggagaagtcagggtagaaattgagccttcagagcccaactcaaggcttctacatcctggggtgcagctgcaaaaggccagacgtggaaaggcctgtatcctgccagtgtccctccgtcccagggggctgtgctggcacagacctgagaatggggacacaggtcattcagagctccaggcctggaagcagtgcctcttggtgcaacaagaaacttctccctcaccccctcctttaccctcagatttggagatggtaaccaaaggaagcagctgggacaggtggagaaggaagtaggaatgagtgcacggcgaccccgtgctcctcagggccctcccctgcctctgggtggcactgctttttatagggtggggcaaaattagcaaaaaacaaaaaccaatgacaaccaaactgaaaccgaaacgaaaaatcaacaaacactctgtcctctatccctccaaagaatgaaaatcagaaaaagcccctgcctagctcacatttctataaacagaggcccccatgatgaggaggtgaagatttaggttgcagaatcgactccaatgcctttcaggaaaggactcggcacttctctgactgcggaggccctgaccctgccagctggctccgagggcaacacaggggcctggcctctagagggctggtgattgaggggcccgggctggcggcaaagaggggtttggtctcggggcttaaatggcaccagactcttgcttttgcccatctggagactgcaggctcccttccttaccctcagagagtgcttatggtgggtgtttttgcggggctgcaataggggccaaaagtcagggaaaggggcactgacctgtagtgaaaggccacaggacacagccttattactgctggggtgggataaggggaaggagaagagggagaatggagcaggaggaaaagcagagttggtctagagaggaggagggcggggctggaggaatgtgggggattgaaactagctcccagcccccatggggcagcagctgggccacaattgcccctttccgttttctaaccccgactcagatttcaccacccacactctttttaggtgtaaaagatggagtcccacggaggaggggcagagccaggaggcagtggggctgtgggctcagagctcaggagtcgccttacctgagagagatgttctagctgagagggcctggccctggggtgggctccaggaaaacgctggttaggcctgggattgagctaacctgaaacaaaggtagtaggcaggacctaatgaccagaggttaaatcctcatcaagagagaccaggcggctggaggacaagcggctctaaccctgggggcggccatgttgtccaggcccaggcccctccaggactgtggctgcctcccctccacggcctccagggcggctggctggaaagccacgcgtatgctgccctctacaggctgctcggcctccctgcagctcagcgcagcccagggctccaagtgaggcccagaagcccatgggcagggctggggggacgaagggggaacccggagcacctccacttctagggaagatggacagcgtgggggcacacctgggcctcccggaagctgtggacgaaagggagagcgggtcctccagggcaaggggaacgggaaataggtctcctaggtgcctgaagcgctgagcaacctgggtaccctggtggggatgcagggaaggccggggcagagaaagcgaaggtcgacccagggctgtaggaagccataggagagtgaccacgggattccctgagaaacagggccggccccccaacttcagggacccaccgcccattccccgagagctgtcggaaccagatgcaacccggcagcccagagaactctcctgggaggctgtgggtgagccaggccaacattggtgtccctgtccccagagggaggagcaggcaggagagagaggggaaggaggtatgaatcccagtccccaggaacctagctctttaaactctggggagtcggattcaggaaacacccccaggaggccaagcctgaaaacagaggggagggaggaaggaaggagtcccagcaggagcacagccctggtttcctgtcactcagagctgattcacaggaggaggggaggttggggggcgggagacaaaaaccacacctctttttatataaggtttcatatttaatttggtcatggattcataaatacataagtattttgtacac

SEQ ID NO: 32 - DNA, 3911 bp, Homo sapiens
  ref <308>: DATABASE ACCESSION NUMBER: AB018268
  ref <309>: DATABASE ENTRY DATE: 2001-06-18
aacttacatgcttgctgtaactttggatgaatggaaaaagaaactggaatctcccaacagagaaattattattttacacaatccaaagcttatggtgcattaccagccagttgcagggtctgatgattggggttcaacacccatggagcagggtcgaccaagaactgtgaagagaggagttgagaacatctctgttgacattcattgtggagaacctttacaaatagatcacttggtttttgtagtccatgggattggaccagcttgtgatctccgctttcgaagcattgtacagtgtgttaatgattttcgcagtgtttccttgaacttgctacagacacattttaagaaagcccaagaaaatcagcagattgggagggtagaatttcttccagtcaactggcacagtcctttgcattctactggtgtggatgtagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggttcgcttatattgtttgatatcctaacaaatcagaaagattctttgggggatattgacagtgaaaagggttcgctaaatattgtaatggatcaaggagatacacctacactagaggaagatttgaagaaacttcagctctctgaattctttgatatctttgagaaggagaaagtagataaggaagctctggctttatgtacagaccgagatcttcaggaaataggaattcctttaggaccaagaaagaagatattaaactatttcagcaccagaaaaaactcaatgggtattaagagaccagccccgcagcctgcttcaggggcaaacatccccaaagaatctgagttctgcagtagcagtaatactagaaatggtgactatctggatgttggcattgggcaggtgtctgtgaaatacccccggctcatctataaaccagagatattctttgcctttggatctcccattggaatgttccttactgtccgaggactaaaaagaattgatcccaactacagatttccaacgtgcaaaggtttcttcaatatttatcacccttttgatcctgtggcctataggattgaaccaatggtggtcccaggagtggaatttgagccaatgctgatcccacatcataaaggcaggaagcggatgcacttagaactgagagagggcttgaccaggatgagtatggaccttaagaacaacttgctaggttcgctgcggatggcctggaagtcttttaccagagctccataccctgccttacaagcttcagaaacaccagaagaaactgaagcagaacctgaatcaacttcagagaagcctagtgatgttaacacagaagagacctctgtggcagttaaagaagaagtcctgcctatcaatgtggggatgctgaatggaggccaacgcattgactatgtgctacaggagaagcctattgaaagttttaatgagtatttatttgctttacaaagccatctatgctactgggagtctgaagatacagtattgctcgtcctcaaagagatctaccaaacccagggtatcttccttgatcagcctttacagtaaaaatgacccatctatggctgcttaatacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcatagctgggggtggtttgtgtctttaattctttgatgatagtttatagttgccacactttattgattagtacttgacagggtgtaaagcctattttgggtttgatttgttttgggtggggtagacatgtttttaaggaacttattgcttatctttagaaaatgttctagtttggaaacagattcttgagattcagaaggcattttggagtacacttatctcttgtttgtgttgaactgaaggctaagtctcagtggacatggaaaagacttttgggtgatttatttttgaacctgcatttctttcttatgtgtagtgtatgaagaaagactagaatgtagctttaaaaaagtgttgtttactctcttagaactgacagacttattgccagaaatcactgatgttcattgtttttgcaactgtttgagctgctgtaagagtctaaagttgacaagttagttcatgttaggtgcatctttataaagcaaagatgttgtatatcctaggcctcccttttatatttgatagaagttatttgctaatagcttctattcttacgttgaaaatagttgtaaaagctgatgaacctgaaattgtgtagcctctacaggctgctgaggttctaaataaaaccttttagtggtgcctttatggtgaaacagaatttgtcacctgccatttctacttgagctaaggtagtattgtgtatcctctttccttcttaggtatccataatccacaaagcatatttaaaaggctcttggcacgggcagcattggttgagcaggtaggtttggctagggggaaatgtttaacttgttctgaaagaaaaacttatgtctgtagggtccaagaaacagctattccagagtcagtgtcagctgagtctggaacatatgaagtgaggtttacttctaagaacacaagtgactgcacactaattttgtcaaggcatcttttcactactttgctgtagatttttcttcttcattggtcagtttgtcattgtctttgtagttctctttatgataatcctttatacttgctctcagattccacaggcctctgtttatagagtggcaaaggcaggcgagctgtggtttattgtttataaatttttttataaatgttatggtattcaaagccactgacatttaatatttactgaagccattccttagacagcagtggtctttatccctttctggaaagaaaaggaaaatgaagggtaattactgtcaccatggagattgtagaggtaaggttggggtataggtcaggcctggcctttctttgtcatctgcttatagtctagtgctaagtatgccactaagtttcagatatatggaatactttatttttttaaaggtatataaactctgagttattgagaattaagtattcactgtatattaaggggaagcttttgccaagttgtggtcttcaaatttatgtttactcttcctattggcagaataggtgctatttaagagtaaaccaaaggataagcagagggagtccctataaccaaagatggacagcatagccctggatagccagataaaccactctttgtattaagaaatgtttctttcctagtggtgaggggtgggtaactgtgaaagagctttatatcttgtctattcatggtattatagctgtatattcccaggatgataagcttgattgaaatcctgtatttagtcatatattatttgcgctgcttcatttgtatcatgtgcaatctctagaccaaccctatttttaaactctggtacagcatcattttgtacatattcccagctgcagaactagtatcacttatctcagcaaaagagattgtttgcatggaaagattaatagcactgattagatttctaatattttgcatttttgaaatgtttgttttctacgtgattatatttaaaactttagtaaatactaaaatg

SEQ ID NO: 33 - DNA, 4086 bp, Homo sapiens
  ref <308>: DATABASE ACCESSION NUMBER: AB018289
  ref <309>: DATABASE ENTRY DATE: 2001-06-18
atttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactggatgcaaattttgcaattggtgtcattttttttaaagtcaaattacaaggaagtacccagatcaggcagtggtaataccaaaggtcatcaaacacatacaaggaacatcttgatcatagggcatgtggggaagtttactgggccatcacagacttttgttctagtgattgtatgtattaggagtcatagcatgccctacggcagatctggattcttatacactaagatgtgtcttaagaatcacagtgcgtgcttcatccctttattgaagaacagaaaattatgactactctacaaggtggataatattttggtacctgtgcttgccacagccctgttcctcaaagctgaattgatagatttctctttgacttccaagacctagcagttataaggcaccttgaaataaattgtttgtgcctggaaatgcagggagggcaatagctttgtaaattggtttacatttttctccttgaatttttctagggtcctagtgcttccgaatcatttaatggcattgtcggatatcttttacatttcaattgcaatccatgaaattacatttagaagattcttagtacttaactgtagtcttctccatgaattacacgttagaatagactggcagcaacggaatatgcagcaagtaagcctctagcttatagtttcatccctacccctcatgcctgcgtgagtctgtacagggatatgtgtgtgtgtgtgtgtgtgtgtgtgtgtgtgtgttagagaggaagaggaagagcagaatgtctgtatactacatgctgctaaggtagtgaataaatcagtaatgcaatattgtgggtccaaactactctttgcactactttatttacagtagtaaataaaattatttttatac

SEQ ID NO: 34 - DNA, 3999 bp, Homo sapiens
  ref <308>: DATABASE ACCESSION NUMBER: AB018305
  ref <309>: DATABASE ENTRY DATE: 2001-06-18
caagattccacatttgatggggtgactgacaaacccatcttagactgctgtgcctgcggaactgccaagtacagactcacattttatgggaattggtccgagaagacacacccaaaggattaccctcgtcgggccaaccactggtctgcgatcatcggaggatcccactccaagaattatgtactgtgggaatatggaggatatgccagcgaaggcgtcaaacaagttgcagaattgggctcacccgtgaaaatggaggaagaaattcgacaacagagtgatgaggtcctcaccgtcatcaaagccaaagcccaatggccagcctggcagcctctcaacgtgagagcagcaccttcagctgaattttccgtggacagaacgcgccatttaatgtccttcctgaccatgatgggccctagtcccgactggaacgtaggcttatctgcagaagatctgtgcaccaaggaatgtggctgggtccagaaggtggtgcaagacctgattccctgggacgctggcaccgacagcggggtgacctatgagtcacccaacaaacccaccattccccaggagaaaatccggcccctgaccagcctggaccatcctcagagtcctttctatgacccagagggtgggtccatcactcaagtagccagagttgtcatcgagagaatcgcacggaagggtgaacaatgcaatattgtacctgacaatgtcgatgatattgtagctgacctggctccagaagagaaagatgaagatgacacccctgaaacctgcatctactccaactggtccccatggtccgcctgcagctcctccacctgtgacaaaggcaagaggatgcgacagcgcatgctgaaagcacagctggacctcagcgtcccctgccctgacacccaggacttccagccctgcatgggccctggctgcagtgacgaagacggctccacctgcaccatgtccgagtggatcacctggtcgccctgcagcatctcctgcggcatgggcatgaggtcccgggagaggtatgtgaagcagttcccggaggacggctccgtgtgcacgctgcccactgaggaaacggagaagtgcacggtcaacgaggagtgctctcccagcagctgcctgatgaccgagtggggcgagtgggacgagtgcagcgccacctgcggcatgggcatgaagaagcggcaccgcatgatcaagatgaaccccgcagatggctccatgtgcaaagccgagacatcacaggcagagaagtgcatgatgccagagtgccacaccatcccatgcttgctgtccccatggtccgagtggagtgactgcagcgtgacctgcgggaagggcatgcgaacccgacagcggatgctcaagtctctggcagaacttggagactgcaatgaggatctggagcaggtggagaagtgcatgctccctgaatgccccattgactgtgagctcaccgagtggtcccagtggtcggaatgtaacaagtcatgtgggaaaggccacgtgattcgaacccggatgatccaaatggagcctcagtttggaggtgcaccctgcccagagactgtgcagcgaaaaaagtgccgcatccgaaaatgccttcgaaatccatccatccaaaagctacgctggagggaggcccgagagagccggcggagtgagcagctgaaggaagagtctgaaggggagcagttcccaggttgtaggatgcgcccatggacggcctggtcagaatgcaccaaactgtgcggaggtggaattcaggaacgttacatgactgtaaagaagagattcaaaagctcccagtttaccagctgcaaagacaagaaggagatcagagcatgcaatgttcatccttgttagcaagggtacgagttccccagggctgcactctagattccagagtcaccaatggctggattatttgcttgtttaagacaatttaaattgtgtacgctagttttcatttttgcagtgtggttcgcccagtagtcttgtggatgccagagacatcctttctgaatacttcttgatgggtacaggctgagtggggcgccctcacctccagccagcctcttcctgcagaggagtagtgtcagccaccttgtactaagctgaaacatgtccctctggagcttccacctggccagggaggacggagactttgacctactccacatggagaggcaaccatgtctggaagtgactatgcctgagtcccagggtgcggcaggtaggaaacattcacagatgaagacagcagattccccacattctcatctttggcctgttcaatgaaaccattgtttgcccatctcttcttagtggaactttaggtctcttttcaagtctcctcagtcatcaatagttcctggggaaaaacagagctggtagacttgaagaggagcattgatgttgggtggcttttgttctttcactgagaaattcggaatacatttgtctcacccctgatattggttcctgatgcccccccaacaaaaataaataaataaattatggctgctttatttaaatataaggtagctagtttttacacctgagataaataataagcttagagtgtatttttcccttgcttttgggggttcagaggagtatgtacaattcttctgggaagccagccttctgaactttttggtactaaatccttattggaaccaagacaaaggaagcaaaattggtctctttagagaccaatttgcctaaattttaaaatcttcctacacacatctagacgttcaagtttgcaaatcagtttttagcaagaaaacatttttgctatacaaacattttgctaagtctgcccaaagcccccccaatgcattccttcaacaaaatacaatctctgtactttaaagttattttagtcatgaaattttatatgcagagagaaaaagttaccgagacagaaaacaaatctaagggaaaggaatattatgggattaagctgagcaagcaattctggtggaaagtcaaacctgtcagtgctccacaccagggctgtggtcctcccagacatgcataggaatggccacaggtttacactgccttcccagcaattataagcacaccagattcagggagactgaccaccaagggatagtgtaaaaggacattttctcagttgggtccatcagcagtttttcttcctgcatttattgttgaaaactattgtttcatttcttcttttataggccttattactgcttaatccaaatgtgtaccattggtgagacacatacaatgctctgaatacactacgaatttgtattaaacacatcagaatatttccaaatacaacatagtatagtcctgaatatgtacttttaacacaagagagactattcaataaaaactcactgggtctttcatgtctttaagctaagtaagtgttcagaaggttcttttttatattgtcctccacctccatcattttcaataaaagatagggcttttgctcccttgttcttggagggaccattattacatctctgaactacctttgtatccaacatgttttaaatccttaaatgaattgctttctcccaaaaaaagcacaatataaagaaacacaagatttaattatttttctacttggggggaaaaaagtcctcatgtagaagcacccacttttgcaatgttgttctaagctatctatctaactctcagcccatgataaagttccttaagctggtgattcctaatcaaggacaagccaccctagtgtctcatgtttgtatttggtcccagttgggtacattttaaaatcctgattttggagacttaaaaccaggttaatggctaagaatgggtaacatgactcttgttggattgttattttttgtttgcaatggggaatttataagaagcatcaagtctctttcttaccaaagtcttgttaggtggtttatagttcttttggctaacaaatcattttggaaataaagattttttactacaaaaatg

SEQ ID NO: 35 - DNA, 5252 bp, Homo sapiens
  ref <308>: DATABASE ACCESSION NUMBER: AB018345
  ref <309>: DATABASE ENTRY DATE: 2001-06-18
cacgggggaagcaggcgggccccccagcacccgggaggccgagctgaagctgcggctaaagctggtggaggaggaagccaacatcttgggccggaagatcgtggagctggaggtggagaaccgtggcctcaaggcagagatggaggacacgcggggccagcaggagcgggagggcccgggtcgggaccacgcacccagcattcctacctcacccttcggtgactccctggagtcctccactgagctccgccgccacctgcagtttgtagaagaggaagcggagttgctccggaggtccatctccgagatcgaagaccacaaccggcaactgacccacgagctcagcaagtttaagtttgagcctccccgggagccgggctggctaggagagggtgcaagtcctggtgccgggggtggggcccccctgcaggaggagctgaagtcagccaggctgcagatcagcgagctcagcggcaaggtgctcaaactgcagcacgagaaccacgcgctgctgtccaacatccagcgctgcgacctggcagcccacctggggctgcgtgcccccagtccccgggacagcgatgccgagagtgatgcgggcaagaaggagagtgatggggaggagagccgcctgccccagcccaagcgggaagggcctgttggcggggagagtgactcggaggagatgtttgagaagacgtcgggcttcgggagcgggaagccatcggaggccagcgagccatgccccacggagctcctgaaggcccgggaggactctgagtacctagtgaccctaaaacacgaggcccagcggctagagcggacggtggagcgcctcatcacggacaccgacagcttcctccatgatgcggggctgcggggtggtgcgcccttaccggggcctggcctccagggcgaagaggagcagggtgagggggaccagcaggagccccagctgctggggaccatcaacgccaagatgaaggctttcaagaaagagctgcaggccttcctggagcaggtgaaccgcattggggatggcctatcccccttgccccacctcacagagtcctctagcttcctctccactgtgacttccgtgtcccgggactcccccatcgggaacctggggaaggagctgggcccagacttgcagtccagactgaaagagcagctggagtggcagctcgggccggcccgaggggacgagcgggagagcctgcgcctccgagccgcgcgggagctgcaccgccgcgcagacggggacaccgggagccacgggctgggaggccagacctgcttcagcctggagatggaggaggagcacctctatgccttgaggtggaaagaactggaaatgcacagcctggctttgcaaaacaccctccatgagcgaacctggagtgatgagaagaatctgatgcagcaggagctccggtccttgaagcagaacattttcctcttctacgtcaaactcaggtggctgctgaaacactggcggcaagggaagcagatggaggaggaaggagaggagttcactgagggtgaacatccagagaccctctccaggctcggggagcttggagtccaggggggtcaccaggcggatggcccagaccacgacagtgaccgaggctgtggctttccagtgggggagcactccccacactcccgggtgcagattggagatcacagcttgcggctgcagaccgcggacaggggacagccccacaaacaggtggtggaaaaccagcagctgttcagcgccttcaaggccttgctggaggacttccgtgcggagctgcgggaggatgagcgtgcccgactacggctgcagcagcaatatgccagcgacaaggcggcctgggacgtggagtgggccgtgctcaagtgccgtctggaacagctggaagagaagactgagaacaagttgggagaactaggctcctccgctgagagcaagggggccttgaagaaggagagagaggtgcaccagaagctcctggcagacagtcacagcctggtcatggacctgcgctggcagatccatcacagcgagaagaactggaaccgggagaaggtggaacttctcgaccgcctggacagagatcggcaggagtgggagcggcagaagaaggaattcttgtggaggatagagcagttgcagaaagagaacagtccccggagaggtggcagtttcctctgtgatcaaaaagacggcaacgttcgcccctttccccaccagggaagcctccgcatgccccgtccagtggccatgtggccttgtgcagatgctgactccatcccgtttgaagaccggccgctgtccaagctgaaggagtcggacaggtgctcggccagtgagaatctctacctggatgccttgtccctggatgacgagccagaagagccaccagcccacaggcccgagagggagttcaggaaccgcctccctgaggaagaagaaaatcacaaaggaaatcttcaaagggcggtgtccgtgtcctccatgtctgagttccagcgtctaatggacatctcccccttcctgcctgagaagggcctgccgtccaccagcagcaaggaggatgtcaccccacccctgtctccagacgacctcaagtacatcgaggagttcaacaagagctgggactacacacccaacaggggccacaatggtggggggccggacctttgggccgacaggaccgaggtggggcgggcagggcacgaggacagcacagagcctttccccgactcctcctggtacctaaccacaagtgtcaccatgaccacggacaccatgaccagcccagagcactgccagaagcagccactgcggagccacgtcctcaccgagcagtcggggttgcgcgtgttacacagcccgcctgccgtgcgcagggtcgacagcatcacggcggcaggtggtgagggtccctttcccacaagcagagccagagggagcccgggagacaccaaggggggccctccagaacccatgctcagcaggtggccttgcacctcccccaggcactcccgggactatgtggagggggcacggcgcccccttgatagtcccctctgtacctccctggggtttgcctccccactgcacagcctggagatgtccaagaacttgagtgatgacatgaaggaggtggccttctctgtcaggaatgccatctgctccggccctggcgagctgcaagtcaaggacatggcctgccagaccaatgggtcccggacgatggggacccagactgttcagaccatcagtgtgggcttgcagactgaagccctgcgtggcagcggtgtcaccagcagcccccacaagtgtctcactccaaaggctgggggcggtgctacacccgtgtcgtctccttcccggagccttaggagcagacaggtggcccctgccatcgagaaggtgcaggccaagtttgaacgcacatgctgctcccccaagtatggttctcccaagctgcagaggaagcccctccccaaagccgaccagccaaataacaggacgtcaccagggatggcccagaaagggtacagtgagtcagcctgggcccgctccaccaccacaagggagagccccgtgcacaccaccattaatgatggcctctccagcctcttcaacatcattgaccacagccccgtggtgcaggaccccttccagaaggggctgcgggccggcagtcggtctcgctcagcagagccccgaccagagctgggcccaggccaggaaacaggcaccaattcccgaggaaggtcgcctagccccattggggtggggtcagagatgtgcagggaggaagggggagagggcacgccagtgaagcaggacttatctgctccccctggctacaccctcactgagaacgtggcccggatcctcaacaagaagctgctggaacatgccttaaaggaggagaggaggcaggctgcccacgggcccccgggtctccacagtgacagccactcgctgggggacacagccgagccagggcccatggagaaccaaactgtcttgctaactgccccctggggactctagccctgcctgcctcacgctgaactaccttgttctgcactagctccatccctagagccctgcttctccaggcccgagagaccagcaaaccgtcgccctccgtcccgttgggccccacattcccccactgcctcacagcctcagtcacccggagacccgacgtccttggaggagcatggtggcgaggagccgcccgaggagcagccacaccgagatgcaagcttgcatggattatcacagtataattcactgtaatttgcataaccacaccatcaccatgaacaaaactctgcccaacaggagagatctagttttctcaaggtcaaagaatgttttttaaaaacacaaagctgctgaatgttcaacctgtgaaactgagatgtttctagaatgaaacagtaaatgtgcctgtaataacttaatttttttcatagctcagaaaactatttttgtctccatcttttttacacacagtatattaaacgaaaacgtaaataaggtataaatagatttaaaaaataaaagttttaaaaaatgtacattttaagagattctgaacaccctcgctgtcaatacctgactgcctctgttaaatttgcactgttacattttggttcagtttatttccatgttgaattagagtggattaagttaattttattttgtcagtgttactgttttttatgaattttttaatgcttcagactgtctgattcagtgaactttttgtagtgaaaaagccatgaagccagtagacaagacagatattctgtatgctggaggggatacaggatgattttgaaaaggtacaaagtcctcagtgggcttagaaaattcactgtatgatccttatattatcctacttggcttgcacgtcttcgggtgcatgtatataccgctactgtgtcctcgccatcacctaaatgtgactcagtctgttccactgtaatatgttgtgaatttccttgtactgtacttttattgttggtcttcttgcatcgatgatccaacagcaacaccatttttaaattattgtgaaaagattaactggcaatgtacagagtttactcaaagttttcttaagggaaaacactacaaaaagtcacaaggataccaaatggaaacacatgatgatgcctctgggtctgtatgagaccgtgatgaagtagaaataaagcccttctgagatggc

SEQ ID NO: 36 - DNA, 4628 bp, Homo sapiens
  ref <308>: DATABASE ACCESSION NUMBER: AB020677
  ref <309>: DATABASE ENTRY DATE: 2001-06-18
gagcagaccccgaaagccccatcctggacctggaccttcacctgcccttgctgtgcttcaggcctgagaaggtgctacagatcctgacatgcatcctgacggaacagcggatcgtcttcttctcctcggactgggctctgctgacgctggtcactgagtgcttcatggcctacctgtatccgctgcagtggcagcaccccttcgtgcccatcctgtcggaccagatgctggatttcgtcatggcccccacgtccttcctgatgggctgccatctcgaccacttcgaagaagtcagcaaggaagccgacggtttagttctgataaatattgatcatgggagcatcacctactccaagtccacggacgataacgtggacattcctgatgtccccctcctggcagcccagacgtttattcagagggtgcagagcctccagctccaccatgagctgcacgccgcccacctcctctccagcacagacctgaaggagggccgagcccaccggcggtcctggcagcagaaactcaactgccagatacagcagaccaccctgcagctgctcgtgagcatcttcagggatgtaaagaatcatttaaactatgaacacagagtctttaatagtgaagaatttctcaaaaccagggctccaggggaccatcagttttataagcaggtcttagacacctacatgttccattcttttcttaaagcccggctcaataggaggatggacgcctttgctcagatggacctcgacacccagtcggaggaggacagaataaatggaatgcttctaagtccaaggagaccgaccgttgagaaaagagcctcccggaagtcctcgcacctgcatgtcacccacaggcgcatggtggtcagcatgcccaacctgcaggacattgccatgcctgagctggcacccaggaactcctcgctccggctgacggacaccgcaggctgtaggggcagcagcgcagttctgaatgtcacgccgaagtccccgtatacattcaagattcccgaaatccactttccgctggagagcaagtgcgtgcaggcataccatgcccactttgtctccatgctgagcgaggccatgtgctttctggcccccgataactctctgctcctggcccgctatttgtacctccgagggctcgtttatctgatgcagggacagctgctgaacgccctcttggacttccagaatctgtataaaacagacatacggatctttcccactgatttggtgaagaggacggtggaatccatgtctgcccctgagtgggagggggctgagcaggcgccggagctgatgaggctcatcagcgagatcctggacaagccgcacgaggcctcgaagctggacgaccacgtgaagaagttcaagctgcccaagaagcacatgcagctgggcgacttcatgaagcgggtccaggagtcagggatcgtgaaggacgccagcatcatacaccggctgttcgaggccttgactgtaggacaggagaaacaaatcgacccagaaacattcaaagatttctacaactgctggaaggagacggaagcagaagcccaggaggtcagtctgccgtggctggtgatggaacacctggataaaaacgagtgtgtgtgtaagttgtccagctccgtcaagacaaacctaggcgttggcaagatcgccatgacccagaagcgcctgttcctcctaaccgaaggaaggccaggctacttggagatttccaccttcagaaatatagaggaggtcaggagaaccactactacatttctacttcggagaatacccactttaaaaatcagagtggcgtccaagaaagaagtcttcgaagccaacctgaaaaccgagtgtgacctttggcacctgatggtgaaggagatgtgggctgggaagaagctggccgatgaccacaaggaccctcactacgtccagcaggcgctgaccaacgtcttgctgatggacgccgtcgtgggcacactgcagtcaccaggcgccatctacgctgcctccaagttatcctactttgataagatgagtaacgaaatgcccatgacgcttccggagacaaccctggaaacactgaagcataaaatcaacccctcggcgggggaggcgttcccacaagcggtggacgtgctgctctacactccagggcatcttgacccagccgaaaaagttgaagatgctcaccccaagttatggtgtgctctgagcgaaggcaaggtgaccgtgttcaatgcttcttcatggaccatccaccagcactcctttaaagtgggcactgcaaaagtgaactgcatggtgatggccgaccagaaccaggtgtgggttggctcggaagactccgtcatctacatcatcaacgtccacagcatgtcctgcaacaagcagctcacagcccactgctccagtgtcacggatttgattgtgcaggacggacaggaggcacccagcaacgtgtactcgtgcagcatggacggcatggtgctggtgtggaatgtgagcacactgcaggtgaccagccgcttccagctgccgcgaggtggcctgacgtccatcagactgcacggcggccgcctgtggtgctgcacaggtaacagcatcatggtcatgaaaatgaatggatccctccatcaagaattgaagattgaggagaacttcaaagacaccagtacctccttcctggccttccagctccttcctgaggaggagcagctgtgggcggcctgtgcaggacgcagcgaggtttacatctggagcctgaaggacctggcccagcccccgcagagggtgcccctcgaggactgctctgagatcaactgcatgatccgggtgaagaagcaggtctgggtgggcagccgagggctggggcagggaacacccaaggggaaaatctacgtgattgacgccgagaggaagaccgtggagaaggagctggtggcgcacatggacaccgtgaggacgctgtgctcggctgaggacagatacgtgctgagtgggtcgggcagggaggaggggaaagtcgccatttggaaaggcgaataaacgtggctgagtctgccaagtggaactgtgccctatgtgtggggactggctgccccctagagcctgccaggagcagaagcctggaggggtggcagggcagagcagcccaggctcagcatggagcccacttaccgtgtggccagccgcgagacccatggccacgcaccttctctcaggccttcgggccccctggttaaactgcaccaagggtgtttcctgttggggtgtgtctcaggcaggcagctgcgtcttgttggtgataacctctgctgggaggttactttgttgcctagaaagttctggaatccacaaccaggggctggcactggagccagcagcttggccgagtcacaggtgacccgtggccctcacgtctctggttttacctttccttacttcattcattcactcacccagtccttacgaatcaccgaggaacactgggctgagcacatgacagggagcctggagccccggggcctccagcgaggcctgagaagggtggttcgggtaaccactgtgggctctctcccatcacagaaggtggacagggcctacccaggtggaggggaccaccctgcgatcaggtgtttgcgacaggggttgggccagctgaggcaagctgtcttttttcccttttctttttaatagatgcaacatttttataataatcctagagaccttttttctaccaaagatcacagaccagaaaaagttccatctaaaatatcatgcccaggaaagcacatgggatcaaaagtaaaatagcatcatgtgtgatctcgtcttccagcgtgccgctcagttccccgaatccgtgtgcacacgtgtgatctcgtcttcagtgtgccgctcagttccctgaatccgtgtgcacactgcgtatgtgtacgcgcagcatgctatactgaactcaacaagatcttggctgtacataaatatttgtaaaagagaccctttgcacctttttactgtcatgttgagacttcattacttaaatgttctacggaaggttctggtgtggttgttggagccggagggagcgtgtcagcacgtgctgagggcatggggcctgccccctgggcacccatccacaagctgggccacggagctccagcttctcaggacaaagccccggggctggcgcatcctgagggtctctgggggtgtttgccaggctcctgggatgggccgctttcagaagccctgcagtgcctccagatggaaaggcgggcccggcctccggttgggtctgcattttggagagtccacaccacggaccaggttttcccccaaggcttggctttgtgtagctactaacttcttggggcattctgagagtgtgggcagagagaattatgtggcctcatcctcccccaaggctgtgcttgcagcccgggcaccttcccactttctagctctggagaggttggattttgcttttgtaaacacatgaatccttatgataaaagtctgtcagtcaaaaatacatttataaattatttaatgccagtcctcatgtaacctcaggtatcttcagcttgtggagaataaatctggtttaat

SEQ ID NO: 37 - DNA, 4186 bp, Homo sapiens
  ref <308>: DATABASE ACCESSION NUMBER: AB020689
  ref <309>: DATABASE ENTRY DATE: 2001-06-18
gaacttatgtagcctcattatcccgctccgtgaggtgacaattgtggaaaaggcagacagctccagtgtgctccccagtcccttatccatcagcacccgaaacaggatgaccttcctatttgccaacttgaaagatagagactttctagtgcagaggatctcagatttcctgcaacagactacttccaaaatatattctgacaaggagtttgcaggaagttacaacagttcagatgatgaggtgtactctcgacccagcagcctcgtctcctccagcccccagagaagcacgagctctgatgctgatggagagcgccagtttaacctaaatggcaacagcgtccccacagccacacagaccctgatgaccatgtatcggcggcggtctcccgaggagttcaacccgaaattggccaaagagtttctgaaagagcaagcctggaagattcactttgctgagtatgggcaagggatctgcatgtaccgcacagagaaaacgcgggagctggtgttgaagggcatcccggagagcatgcgtggggagctctggctgctgctgtcaggtgccatcaatgagaaggccacacatcctgggtactatgaagacctagtggagaagtccatggggaagtataatctcgccacggaggagattgagagggatttacaccgctcccttccagaacacccagcttttcagaatgaaatgggcattgctgcactaaggagagtcttaacagcttatgcttttcgaaatcccaacatagggtattgccaggccatgaatattgtcacttcagtgctgctgctttatgccaaagaggaggaagctttctggctgcttgtggctttgtgtgagcgcatgctcccagattactacaacaccagagttgtgggtgcactggtggaccaaggtgtctttgaggagctagcacgagactacgtcccacagctgtacgactgcatgcaagacctgggcgtgatttccaccatctccctgtcttggttcctcacactatttctcagtgtgatgccttttgagagtgcagttgtggttgttgactgtttcttctatgaaggaattaaagtgatattccagttggccctagctgtgctggatgcaaatgtggacaaactgttgaactgcaaggatgatggggaggccatgaccgttttgggaaggtatttagacagtgtgaccaataaagacagcacactgcctcccattcctcacctccactccttgctcagcgatgatgtggaaccttaccctgaggtagacatctttagactcatcagaacttcctacgagaaattcggaactatccgggcagatttgattgaacagatgagattcaaacagagactgaaagtgatccagacgctggaggatactacgaaacgcaacgtggtacgaaccattgtgacagaaacttcctttaccattgatgagctggaagaactttatgctcttttcaaggcagaacatctcaccagctgctactggggcgggagcagcaacgcgctggaccggcatgaccccagcctgccctacctggaacagtatcgcattgacttcgagcagttcaagggaatgtttgctcttctctttccttgggcatgtggaactcactctgacgttctggcctcccgcttgttccagttattagatgaaaatggagactctttgattaacttccgggagtttgtctctgggctaagtgctgcatgccatggggacctcacagagaagctcaaactcctgtacaaaatgcacgtcttgcctgagccatcctctgatcaagatgaaccagattctgcttttgaagcaactcagtacttctttgaagatattaccccagaatgtacacatgttgttggattggatagcagaagcaaacagggtgcagatgatggctttgttacggtgagcctaaagccagacaaagggaagagagcaaattcccaagaaaatcgtaattatttgagactgtggactccagaaaataaatctaagtcaaagaatgcaaaggatttacccaaattaaatcaggggcagttcattgaactgtgtaagacaatgtataacatgttcagcgaagaccccaatgagcaggagctgtaccatgccacggcagcagtgaccagcctcctgctggagattggggaggtcggcaagttgttcgtggcccagcctgcaaaggagggcgggagcggaggcagtgggccgtcctgccaccagggcatcccaggcgtgctcttccccaagaaagggccaggccagccttacgtggtggagtctgttgagcccctgccggccagcctggcccccgacagcgaggaacactcccttggaggacaaatggaggacatcaagctggaggactcctcgccccgggacaacggggcctgctcctccatgctgatctctgacgacgacaccaaggacgacagctccatgtcctcatactcggtgctgagtgccggctcccacgaggaggacaagctgcactgcgaggacatcggagaggacacggtcctggtgcggagcggccagggcacggcggcactgccccggagcaccagcctggaccgggactgggccatcaccttcgagcagttcctggcctccctcttaactgagcctgccctggtcaagtactttgacaagcccgtgtgcatgatggccaggattaccagtgcaaaaaacatccggatgatgggcaagcccctcacctcggccagtgactatgaaatctcggccatgtccggctgacacgggcgccttcccgggggagtgggaggagagggaggggagggattttttatgttcttctgtgttgagttttttctttctttcttttaaattaaatatttattagtacctggcttgaagcctagtgttttcataatgtaattcaatgaaaactgttggagaaatatttaaacacctcaatgtaggtacattacactcttgttgcggggaggggatttaccagaatacagtttatttcgtgaattctaaaaaacaaaaagatgaatctgtcagtgatatgtgtgtattataacttattaatcttgctgttgagctgtatacatggtttaaaaaatagtactgtttaatgctaagtaaggcagcagtcatttgtgtattcaggctttttaaataaaattagagctgtaaggaaaatgaaaagccacaaatgcaagactgttcttaaatggaaggcatagtcagcgagggtaaatcctataccactttaggaagtattaaaaatatttttaagatttgaaatatatttcatagaagtcctctattcaaaatcatattccacagatgttccccttcaaagggaaaacatttggggttctaaacagttatgaaagtaagtgatttttacatgattccagaataacacttgtattgaccaatttagacagataccagaccaattttgcatttaagaaattgttctgattatttacgtcaactcattagaattcagtgaaaagtaacagtcttttgtcacagagaatctgaaagtagcagcaaagacagagggctcatgacaggtttttgcttttgctttgcttttgtttttgaaagagtaaaagtactgatgcttctgatactggatgtttagcttcttactgcaaaaacataagtaaaacagtcaactttaccatttccgtattctccatagattgaagaaatttataccacatatcgcatatgaccatctttccatcaaatcaatgtagagataatgtaaactgaaaaaaaatctgcaagataatgtaactgaatgttttaaaaacagaacttgtcactttatataaaagaatagtatgctctatttcctgaatggatgtggaaatgaaagctagcgcacctgcactttgaattcttgcttcttttttattactgttatgattttgctttttacagatgttggacgattttttcttctgattgttgaattcataatcatggtctcatttcctttgcttctttggaatatttctttcaacacattcctttattttattatacattgtgtcctttttttagctattgctgctgttgttttttattctatttacaggatgatttttaaactgtcaaatgaagtagtgttaacctcaaataggctaaatgtgaacaaataaaatacagcaaatactc

SEQ ID NO: 38 - DNA, 3882 bp, Homo sapiens
  ref <308>: DATABASE ACCESSION NUMBER: AB020695
  ref <309>: DATABASE ENTRY DATE: 2001-06-18
ggagaactccaccgggctatgcgaacagaatcctgcgaagaggatggcattccctgtggatatgctggaaaattgcagccatgaggaattggaaaattctgctgaagattacatgtcagatttaaggtgtggggaccctgaaaatccagagtgtttttctcttctcaatattacgattcctattagcctgtcaaatgtaggctttgtacctctttatggtggagatcagacccagaaaattcttgctctctttgcacctgaagattcactgacagctgtggcactttaccttgctgatcagtggtgggctattgatgatattgtgaaaacatctgttccttcaagagaggggcttaagcaggtgagcactcttggggagagagtggttctgtatgttctgaatcgaattatttatagaaaacaggaaatggagagaaatgagatcccattcctgtgtcatagcagtactgattatgctaagattctgtggaagaaaggagaggccattgggttttattcagttaagcctacaggaagcatatgtgcctcttttcttacccaaagttaccaattgccagttcttgatacaatgtttctaagaaagaaatacagaggtaaagattttgggcttcacatgctggaggactttgttgattcctttacagaagatgcgcttggcttgcggtatccactgtcttctctcatgtatacagcttgcaagcaatactttgagaagtatccaggagaccatgaactcctttgggaagttgaaggtgttggacactggtaccagcgaataccagtcaccagagcattacaaagagaagcacttaaaattctagcactttctcaaaatgaacctaaaagacctatgtctggagaatatggtcctgcatctgttccagaatacgaagcaagaactgaagacaatcagtctagtgagatgcagctaactattgattctctaaaagatgcctttgcaagcacttccgaaggtcatgataaaacatctgtttccactcatactcgaagtggtaatctaaagcggccaaagattggaaagcggtttcaggattctgaatttagcagttctcaaggtgaagatgaaaagacctcccagacttcacttacagcttcaataaacaaattggagtctactgcacgcccatcagagagctcagaagaattcctggaagaagaacctgaacagagagggattgaatttgaggatgaaagcagtgatagagatgcacggccagcactggaaacccagccacagcaagagaagcaagatggtgaaaaggaatctgaattagagcctatgaatggtgagataatggacgattctcttaagacctcacttataacagaagaggaagactccactagtgaagttttagatgaagaattaaaattgcagccttttaattccagtgaagactctacaaatcttgttccactggtggtagaatcttcaaaaccccctgaggtagatgcaccagataagaccccacgtatacctgactcagaaatgttgatggatgaaggcacatctgatgaaaaggggcacatggaagagaaattgtccctacttccaagaaagaaagcacatcttgggagttcagacaatgttgctactatgtcaaatgaagaacgatctgatggtggttttccaaactctgtgatagctgaattttccgaagaaccggtctctgagaatttgtctcctaatactacttcctcattggaagaccagggtgaggagggggtatctgagccccaggaaacatctactgctcttcctcagagttctttgatagaggttgaacttgaagacgtgccattttcacagaatgcaggacagaagaatcagtcagaggagcagtctgaagcatcttccgagcaactggatcagtttacacaatcggcagaaaaagctgtggatagcagctcagaggaaatagaagtggaagtgcctgtggtagacaggcggaatttaagaagaaaggccaaagggcataaaggacctgctaagaagaaagctaagctgacctgaaggaagaagaaagtggatgataaatcctcttctttgtaacatagttgttgtttttaaaatatggtaattaataaacagcatggggcacaggacaaaaatttccaaaatttcaatttgaacttacttactatgcagttttttgcttccctttagaacgtagaattcaccattgtttttaattttccaggctatttttggtaaatgcaattttttatttttattaaccatgtttcaattttgggaaaccagatcatattatattttctttatcaggtggtacatctgaccattatttcaaaaatataattaaaaagctgtgaaagtagtaggatttccattacttataaggatcacagaaatcttttatactaagggttttaatagtaaaacttggtgagggttctagaagttttaaatttcaaaactaatcaccaattttttaaaatgtaggcatgcctaaacaaaaataagtgtcaataaattagaaaaaatataacttcaagtaaatgagagcacaaaaacagaaacttacggtcaaaggttcatgaagatattttggttttggcctcttaatcctagatatagatgcagttttttcctttgacttcactatctatggaaaggtacacataaaatctgtttctgattcattctatcatctgatgttaacagtactgtcagggatttaactgtggcatgtggggactaattatttaaaatttcatttgaagtattagtttgctgtaattttttttgtctgcatatgtgcagacgcctagaagtttagactttcacctttaatcaggtaaaaatcacaactatactttggagacatggtttaatttggacttctggtcctgatcagatagataaattaagctggagattttacttttatcccaacccagttaacatctatatttcagaagtatgaggctccttcctaaggcatctccttaaatcttgccacctccctaattctacagtcttatttatattcccccacagctttcatctacttctgtaactcatggagtgattctccaatcaacagatcttcctgcctgccggcttatgcccttgatgtccatttttgggtaggtttggaggtgcaccccacaatgttagacctatatggcaggagtaaaactgcccccagtgttagacctatatggcaggggtaaactgcctttgggggagctgtggttacaagggcttcaatcatattggaggcttcaatcatcctttgatttgtactgagtactggttgcaagctggcctgttaagtatatattgtgttgccataacaaaggcctaggaaaatttgaagaaaaaaaacactgaactgttattttttgtaatttatttaaaaatggacaaaatggttattagaatccaaagataatctaaaaacagttctactctttggaaatattatgtgtactcaaatttgcacttaagttggagaatgttttgagaccatttaaattgttttaaaaatagcttgatcttgatccttatgcaaaagaaactaagactttgtgtcattatttgaggtagctaaggactgatgttgaaagtgtattcagtctatagtaagctgatgtcaggtcagtaaattttgtttggggatgttggtattttcgatcaagttaaaatcttaaagcagacaaaaatagtaaacgctcctatttgtgttagattttgaacaattgtattaccctatattttctttaattagtcaaaggtaagccagattatttcattctaaatgaaaattaaagcactttggccatttattttttcaacaaatgctaatactaagt

SEQ ID NO: 39 - DNA, 3875 bp, Homo sapiens
  ref <308>: DATABASE ACCESSION NUMBER: AB020710
  ref <309>: DATABASE ENTRY DATE: 2001-06-18
catttgatgatcctgatgctgcagaattaaatccatttggagatcctgactcagaagaacctatcactgaaacagcttcacctagaaaaacagaagactctttttataataacagctataatccctttaaagaggtgcagactccacagtatttgaacccattcgatgagccagaagcatttgtgaccataaaggattctcctccccagtctacaaaaagaaaaaatataagacctgtggatatgagcaagtacctctatgctgatagttctaaaactgaagaagaagaattggatgaatcaaatcctttttatgaacctaaatcaactcctcctccaaataatttggtaaatcctgttcaagaactagaaactgaaaggcgagtgaaaagaaaggccccggctccaccagtcctctcaccaaaaacaggagtattaaatgaaaacacagtttctgcaggaaaagatctctctacttctcctaagccaagccctataccaagtcctgttttggggcgaaagccaaatgctagtcagtctttgcttgtatggtgtaaagaagttacaaagaactaccgaggagtaaaaatcaccaattttactacatcgtggagaaatggtttatctttttgtgcaatattacaccactttagaccagatttaattgactacaagtctctgaatcctcaagatattaaagagaacaacaaaaaggcatacgatggatttgccagcataggaatttcccgattattggaaccttctgatatggtattattagcaattcctgataaactgactgttatgacttatctctatcaaataagggcacatttcagtggccaagaactaaatgtcgttcagatagaggaaaacagcagtaaaagcacatataaagttggaaactatgaaacagatacaaacagttctgttgatcaagaaaaattctatgcagagcttagtgatctgaagcgggagcctgaactacaacagcctatcagcggagcagtagacttcttatcacaggatgactctgtatttgtaaatgatagcggggttggagagtcagaaagtgagcatcaaactcctgatgatcaccttagtccaagcacagcctccccttactgtcgcaggactaaaagtgacacagaaccccagaagtctcagcagagctctggaaggacttcaggatctgatgaccctggaatatgttccaatacagattcaacccaagcacaggttttgttaggcaaaaagagactattgaaagctgagactttagaattgagtgacttatatgttagtgataagaagaaggatatgtctccaccctttatttgtgaggagacagatgaacaaaagcttcaaactctagacatcggtagtaacttggagaaagaaaaattagagaattccagatccttagaatgcagatcagatccagaatctcctatcaaaaaaacaagtttatctcctacttctaaacttggatactcatatagtagagatctagaccttgctaagaaaaaacatgcttccctgaggcagacggagtctgatccagatgctgatagaaccactttaaatcatgcagatcattcatcaaaaatagtccagcatcgattgttatctagacaagaagaacttaaggaaagagcaagagttctgcttgagcaagcaagaagagatgcagccttaaaggcggggaataagcacaataccaacacagccaccccattctgcaacaggcagctaagtgatcagcaagatgaagagcgacgtcggcagctgagagagagagctcgtcagctaatagcagaagctcgatctggagtgaagatgtcagaacttcccagctatggtgaaatggctgcagaaaagttgaaagaaaggtcaaaggcatctggagatgaaaatgataatattgagatagatactaacgaggagatccctgaaggctttgttgtaggaggtggagatgaacttactaacttagaaaatgaccttgatactcccgaacaaaacagtaagttggtggacttgaagctgaagaagctcctagaagttcagccacaggtggcaaattcaccctccagtgctgcccagaaagctgtaactgagagctcagagcaggacatgaaaagtggcacagaagatctccggactgaacgattacaaaaaacaacagaacgttttagaaatcctgttgtgttcagcaaagattctacagtcagaaaaactcaacttcagtctttcagccaatatattgagaatagaccagagatgaaaaggcagagatcaatacaggaagatacaaagaaaggaaatgaggagaaggcagcgataactgaaactcagaggaagccatcagaagatgaagtgcttaataaagggttcaaagacaccagtcagtatgtagtaggagaattggcagcactagagaatgagcaaaagcaaattgacacccgtgccgcgctggtggagaagcgccttcgctatctcatggacacaggaaggaacacagaagaagaagaagctatgatgcaggaatggtttatgttagttaataagaaaaatgccttaataaggagaatgaatcagctctctcttctggaaaaagaacatgatttagaacgacggtatgagctgctgaaccgggaattgagggcaatgctagccattgaagactggcagaagaccgaggcccagaagcgacgcgaacagcttctgctagatgagctggtggccctggtgaacaagcgcgatgcgctcgtcagggacctggacgcgcaggagaagcaggccgaagaagaagatgagcatttggagcgaactctggagcaaaacaaaggcaagatggccaagaaagaggagaaatgtgttcttcagtagccatcagatcagaaagaatctctcccaacattttagagtcttgcttcccaaaccagaaaaagtcagactcattgttgatttaaaacttttaacattttgtttggctggattgtactactttacctctactttaccaccaccacccttttcctccctcctttccaaataatatacagaactccaaaatagcttcatttaaggatttttttgtgagttaacaatttccttgaaatcctgtgaaatagatttgcacagacaccttgtgagtgattggtattggaggtgttcaagaaactgttcgaaaaagaacaaaaacacttccctcgttattttctctcattttttgatgagaggaaaatttgaaacattattcttgttgttgttggtaatagcataatgacagtgggaggggtacaaggggataagaaaaatgtcatgatttttttccggtcctgccacatgtaacacttactctgttacctaaattttatagttagatcatatccaatctacttattaaactgtgttctatttaccagtggagtttttctgcagtggttgcgtttcactgtaaggataatggagttcctctcctctgctttcctcagaggatggtcttttaacatagccagaaacaagccctgtggtttgaaggtgagctgtgaggatgggactaattgatatgcaccagtttacaaagacagtcttatcatccgagaatacaccatctttttctctggataattatttcttacatcatgcttgattcctacattttgttgggtctcaacattggctcacgaatgctgttaatatttattctgtattgataaaaagtctgtcttgccactacaagtaaatcccccatttaatattttcttctttagcatagcactgtcattttttgtgaaaatggttatgtttatttattacaatactgagtcatatataaattttcaataaaagcagaaactttcttacctt

SEQ ID NO: 40 - DNA, 2505 bp, Homo sapiens
  ref <308>: DATABASE ACCESSION NUMBER: AB023139
  ref <309>: DATABASE ENTRY DATE: 2001-06-18
ccagactttacctcctcctgggtaattcgggacctaagtcttgtaaccgcagcggacctagaatttcgcttcactctcaatgtgactctccctcatcacctgttgcccttgtgtgcagacgtggttccaggacccagctgggaggagtcattttggaggctcacggtcttctttgtcagtttgtccctgttgggtgtgattttaatagccttccaacaagcacagtacattctcatggaattcatgaaaacaagacagaggcaaaatgctagctcctcttcacagcaaaacaatggtcctatggatgtaatcagcccccattcttacaaaagcaattgcaagaactttctcgatacatatggcccctctgataaaggcagggggaagaactgccttccagtgaacactccccaaagcaggatccagaatgctgcaaagaggagcccagccacctatggtcattctcagaagaagcacaaatgctcagtgtattacagtaaacacaaaaccagcacagctgcggccagcagcaccagcacgactactgaggaaaaacagacttcacccctgggcagctcactgcctgctgctaaagaggacatttgcactgatgccatgcgtgagaactggatcagcctcagatatgcaagtggcataaatgtcaacctgcagaagaatttaacccttcccaaaaacttactgaataaagaagaaaacacactgaaaaacacaattgttttcagtaatccttcttcagaatgtagtatgaaggagggaatacagacatgtatgtttcctaaggaaactgacattaaaacttcagagaacacagccgagttcaaggaacgggagctctgtccactgaagacctccaagaaactacctgaaaaccatttaccaagaaactcacctcagtaccaccagccagacttgccagaaatttccaggaaaaataatgggaataaccagcaagtacctgtcaagaatgaagtagatcattgtgaaaatttgaagaaggtggacacaaagccttcttcagaaaagaagattcacaaaacatctagagaagacatgttttctgagaaacaggacatacctttcgtagagcaagaagatccttataggaagaaaaagcttcaggagaaaagagaaggaaatttacaaaatttaaattggagtaaaagtcgaacatgtagaaagaacaagaaaaggggtgttgctccagtctcaaggcctcctgaacagagtgatctaaagcttgtgtgcagtgactttgagaggtctgagctgagcagtgacatcaatgtaagaagctggtgtatacaggaaagcactagggaggtttgtaaagcagatgccgaaattgcaagcagtttacctgctgcccagagagaggcagaaggttactaccagaagcctgagaagaaatgtgtggacaagttctgctccgattccagctctgactgtgggagctcctctggcagcgtgcgtgccagccggggcagctgggggagctggagcagcaccagcagctccgacggggataagaagcccatggtggacgcccagcacttcctgccggccggagacagtgtttcacaaaatgattttccttctgaagctcccatctccttgaatctttctcataacatctgcaatcccatgaccgtgaatagtctcccacaatacgcagagccttcctgtcccagccttcctgccgggcccacaggtgttgaagaagataaaggtctttactcacctggagacctgtggcccactccgccagtgtgtgtgacaagcagcttaaactgcaccctggagaacggcgtgccttgtgtgattcaggagtcggccccggttcataatagtttcattgattggagtgcaacatgcgaaggccagttttccagcgcatactgtccattggaattgaacgattacaatgcctttccagaagaaaacatgaactatgccaatggcttcccctgtcctgcagatgttcagacagactttattgatcacaactctcagtctacctggaacaccccacccaacatgcctgctgcctggggacatgccagtttcatcagctctccgccctacctcacaagcacccgaagcttgtctccaatgtctggactttttggttccatctgggccccgcaaagcgatgtgtatgaaaattgctgccccatcaaccccaccacggaacattcgacccacatggaaaaccaagcggtcgtgtgcaaggaatactacccggggttcaacccgtttcgcgcctatatgaacctggacatatggactaccacagcgaataggaatgcaaatttcccactgtctagagactcgagttactgtgggaatgtgtgaaaataattggatttttaaacaatgtgaataaagaggcttgtgttttgattactagtgtaaactggttattgagatagattatgacattggtggatattttggcacttttatatgaaaataaattttttaatg

SEQ ID NO: 41 - DNA, 5892 bp, Homo sapiens
  ref <308>: DATABASE ACCESSION NUMBER: AB023151
  ref <309>: DATABASE ENTRY DATE: 2001-06-18
attctgcacctcctgacgtaaccacgtacacctcagagcactcgatacaggtggagagaccgcagggttccacggggtcccggacagcgcccaagtacggcaacgccgagctcatggagaccggggatggagtaccagtaagtagccgggtgtcagcaaaaatccagcagcttgtcaataccctcaaacgaccgaaacgaccacctttacgagaattctttgtcgatgactttgaagaattattagaagttcaacaaccggatccgaaccaaccaaagccggagggggcccagatgctggccatgcgcggagagcagctgggcgtggtcacgaactggccgccgtcgctggaggccgcactgcagaggtggggcaccatctcgcccaaggcgccctgcctgaccaccatggacaccaacgggaagcccctctacatcctcacttacggcaagctgtggacaagaagtatgaaggtcgcttacagcattctacacaaattaggcacaaagcaggaacccatggtccggcctggagatagggtggcactggtgttccccaacaatgatccggctgccttcatggcggctttctacggctgcctgctggccgaggtggtccccgtgcccatcgaggtgccactcaccaggaaggacgcagggagccagcagataggtttcttgcttggaagctgtggagttactgtagccttgactagtgacgcctgccataaaggacttccaaaaagcccaacgggagagatcccacagtttaaaggttggccaaagctgctgtggtttgtcacagagtctaaacatctctccaaaccgccccgagactggttcccacacattaaagatgccaataacgacactgcgtatattgagtacaagacgtgtaaggatggcagtgtgctgggtgtgacggtgacgaggactgcgctgctgacacactgccaggccctgacgcaggcgtgtggctacacggaagctgaaaccattgtgaatgtgctggatttcaagaaggacgtcgggctctggcatggcatcctgacaagcgtcatgaacatgatgcatgtgatcagcatcccgtactcgctgatgaaggtgaaccctctctcctggatccagaaggtctgccagtacaaagcaaaagtggcgtgtgtgaaatcgagggatatgcattgggcattagtagcacacagagatcagagagacatcaacctctcctctctgcgaatgctgatagtggcggacggcgcgaacccctggtctatttcttcttgcgatgcatttctcaatgtcttccaaagtaaaggccttcgacaggaggtcatctgtccttgtgccagctcgccagaggccctcactgtggccatccggaggcccacggatgacagtaaccagcccccgggccggggtgtcctctccatgcatggactgacctatggggtcattcgtgtggactcggaagagaagctgtccgtgctcaccgtgcaggatgtcggcctcgtgatgcctggagccatcatgtgttcagtgaagccagacggggttcctcagctgtgcagaacggatgagatcggggagctgtgtgtgtgtgcagttgcgacgggcacgtcctactatggcctctctggcatgaccaagaacacctttgaggtgtttcccatgacaagctccggggctccgatcagtgaatacccattcataaggacaggcttgctggggttcgtgggtcccggaggcctcgtcttcgtggtgggcaagatggatggcctcatggtggtcagcgggcgcaggcacaacgccgacgacatcgtggccactgcgctggccgtagaacccatgaagtttgtctaccggggaaggatagccgtgttctcggtgaccgtgctgcacgacgagaggatcgtgatcgtggctgagcagaggcctgactccacggaagaggacagtttccagtggatgagccgtgtgctgcaggcgattgacagtatacatcaagttggagtttattgcctggccttggtgccagcaaacaccctccccaaaaccccgcttggtgggatccatttatcagaaacaaaacagctttttctggagggctctctgcacccctgcaatgtcctaatgtgcccccacacctgcgtcacaaacttgcctaagcctcgacagaagcagccagaaatcggccctgcctctgtgatggtggggaacctggtctctgggaagagaatcgcccaggccagtggcagagacctgggtcagatcgaagataacgaccaggcacgcaagttcctgttcctctcagaggtcttgcagtggagagcacagaccaccccggaccacatcctctacacgctgctcaactgtcggggtgcgatagcgaactcgctgacctgcgtgcagctgcacaagagagctgagaagatcgccgtgatgctgatggagaggggccaccttcaggacggcgaccacgtggccttggtctaccccccaggaatagacctgatagcagcgttttatggttgcctgtacgcaggctgtgtgccaataaccgtccgtcccccgcacccacagaacatcgcgacgacgttgcctaccgtcaagatgattgtggaggtgagtcgctctgcctgtctgatgacgacacagctgatctgtaagttgctgcggtccagggaggcggcggcggctgtggacgtcaggacgtggcccctcatcctggacacagatgatttgccaaagaagcggcctgcccagatctgcaaaccttgcaacccagacactcttgcatatctcgacttcagcgtgtccacaactgggatgctagctggcgtaaagatgtctcacgcagccaccagtgccttctgccgttccattaagctgcagtgtgaactttacccctctagagaagtggccatctgcctggacccttactgtggactgggatttgtcctctggtgcctctgcagtgtgtattctgggcaccagtccatcctgatcccgccctctgagctggaaaccaaccccgccttgtggcttcttgccgtgagtcagtacaaagtccgagacacgttttgctcctactccgtgatggagctgtgcaccaaggggctgggctcgcaaacagagtccctcaaggcgcgagggctggacttgtcccgagtgaggacctgcgtggttgtggcggaagagaggcctcggatcgcactcacacagtcgttctcaaagctgtttaaggacctgggccttcacccgcgggccgtcagcacctcgttcggttgcagggtgaacctggcgatttgcttgcagggaacctcaggacctgacccaaccactgtctacgtggacatgagagccctgagacacgacagagtccgcttagtggaaagaggatcccctcatagtctgcccctgatggaatcgggaaagatacttccaggggttcggattataattgccaacccagaaacaaaaggaccgctgggggactcacaccttggagagatttgggttcacagtgcccacaatgccagcggttatttcactatttacggagacgaatccctccagtcagatcacttcaactcaagactaagttttggagacacccagaccatctgggcacgcacaggctacttggggttcctgcggagaactgagctcacagatgcaaatggagagcgccatgatgccctctacgtggtaggggcactggacgaagccatggagctgcggggcatgcggtaccacccaatcgacattgagacctcggtcatcagagcccataaaagcgttacggaatgtgctgtgtttacctggacaaatttgttggtggttgtggttgagctggatgggtcggaacaagaagccttggacctggttcccttggtgaccaacgtggtcctggaggagcactacctgatcgtcggagtggtggtcgtggtggacatcggcgtcatccccatcaactcccgtggggagaagcagcgcatgcacctgcgagacgggtttttggcagaccagctagaccccatctatgtggcctacaacatgtagtctcgtctcttggcttccatggacttttctagagatgtagacattgttctccgtgtccactgaagcgtgcagacacagggcaacactcaccagaatacagccatttgtggtgagagtggaggaggaagaggaggaggaagaggacttctcacagcagccacgattggcatgggggtgaaatgtgaatttaccactgaatttcgctcagaaggactttggattactgccttcagtttgttggaaaagcccatttcaaaaactttcttttcttttctttcttttttaattattggataataagtgctttcttcgtaaatgtggtattttgttaagccgaaatagcaattaaaaaaatatcctgccctccagatgggttcttttaaacaatttatgtagtgtgacaaagaattgttttctctgttttaatgtgtcatgaaatcttaatgacatggatctgttactaatttaagccattgctagatctcatccttttaggaaagtttgaggtacgagaaaaccttccaaatagcaccttccaattagataatagctttctttgtcagaaatgtgctgaagaaacaaaggctggtatacggccttcgaagttagtatagaatgagaagaaattataaataaggtgtatttcggcaattatcttgcaaatatctttgtactaaactaaaaagataaaataagttaacttcctcaatatgtaattatgtacaaaacgtttaatttattttgatctctttagaactataaaagagaaaaacattcaagaatattaaagtcttgtaatgtttgctaatataaaaaagtgttgtattatcttgcgtggatagtatcacaacaaatatatatatatgaaatataaattcactaatgaacaaaggagattttaaagtttaagatgcagaacttgtcacttgcatggtgtgccccccgtactcacatacactctgctgttgccagcagtcgcagaccgcaggagccctgtctaaaagtttcttctagaaccagagaccagcaagtgaaattattgccatctcaaggatggcaaaagaattcaaagctcaatgtgcactatttttttctttgctgtgggacaacagtgaatgtgtttatgccagcgtgtgctgatgatactgaggggctttaggttggcaaatagcactgttttcttagctgcaagaattcattgcacaatgtttttcatcatttttgttaatgtcatctttttttggtccttgctacgaaaaggaatgcgattctgtggtcattcgcactgggttgcattgattccccctctgatggccaatgtggagtggacaaagtgtccggaactcacatcggtgatcgtcccctcgtcttaagacccagcccgctctgtgtgagcctctggggctccctcgctcagtgagcacagttccccgggggttcatgccagagctccggctgaagcaagaagtcctccagctgcgtcgtttgccgcctgtggacgagtgcgccccagtttctgccctggcagctcctggccacaccttctcagagctcacctgtgcacttctaaattgaattggcccacggtgtccaaccaagaaggagcatctgcactccgagaaagatgtgttctgtaactgccccagtgtgaccccgcagtggctctcggtgctagatatgcatgactaagattgatgctgggcaaaatgtagatgatctttcattatgttgtgggcagcgtctttctctgcctttgctatatgcagtcagcagtaagccttttgctaaaagagttttgtttgacttctgagatccaaggctgattgttgtt

SEQ ID NO: 42 - DNA, 6189 bp, Homo sapiens
  ref <308>: DATABASE ACCESSION NUMBER: AB023152
  ref <309>: DATABASE ENTRY DATE: 2001-06-18
ggacacgggtttctctatgaaacatttgggatccggccacagttctcctggcacgttgacccgtttggcgcctctgccacgacgcccaccctatttgcgctggcgggcttcaatgcccacctcggctcccggatcgactacgacctgaaggcagccatgcaggaggcccgggggctgcagttcgtgtggcgagggtccccatccctctcagagcggcaggaaatcttcacgcacatcatggaccagtacagctactgcaccccgtcccacatccctttctccaacaggtcaggattttactggaatggcgtggctgtcttccccaagcctcccccagatggggtgtaccccaacatgagtgagcctgtcaccccagccaacatcaacctctatgccgaggccctggtggccaacgtgaagcagagggccgcctggttccggacaccgcacgtcctctggccctggggatgtgacaagcagttcttcaatgcctcggtgcagtttgccaacatggacccgctgctggaccacatcaacagccatgctgccgagctcggtgtctcggtgcagtatgccacgctgggcgactacttccgtgccctgcacgctctcaatgtcacctggcgtgtccgcgaccaccacgacttcctgccctattccacagaaccattccaggcctggacgggcttctacacgtcccgcagctcactgaaggggctggcccggcgagccagcgccttgttgtatgccggggagtccatgttcacacgctacctgtggccggccccccgtgggcatctggaccccacctgggccctgcagcagctccagcagcttcgctgggccgtctccgaggtccagcaccatgatgccatcactgggactgagtcccccaaggtgagagacatgtacgcaacgcacctggcctcggggatgctgggcgtgcgcaagctgatggcctccatcgtcctagatgagctccagccccaggcacccatggcggccagctccgatgcaggacctgcaggacattttgcctcggtctacaacccgctggcctggacggtcaccaccatcgtcaccctgactgttggtttccctggagtccgcgtcacagatgaggcgggccacccagtgccctcgcagatccagaactcaacagagaccccatctgcgtatgacctgcttattctgaccacaatcccaggcctcagttaccggcactacagcatcagacccactgcaggggcccaagagggcacccaggagccggctgccactgtggcgagcacccttcaatttggccgcaggctgaggagacgcaccagccatgcgggcaggtacttggtgcctgtggcaaacgactgctacattgtgctgctcgaccaggataccaacctgatgcacagcatctgggagagacagagtaaccgaacggtgcgcgtgacccaggaattcctggagtaccacgtcaacagggatgtgaaacagggccccatttccgataactacctgttcacaccgggcaaggccgcggtgcctgcgtgggaagctgtggaaatggagattgtggcgggacagcttgtgactgagatccggcagtacttctacaggaacatgacagcacagaattacacgtatgcaatccgctcccggctcacccatgtgccgcagggccatgacggggagctgctctgccaccggatagagcaggagtaccaagccggccccctggagctgaaccgtgaggctgtcctgaggaccagcaccaacctaaacagccagcaggtcatctactcagacaacaacggctaccagatgcagcggaggccctacgtttcctatgtgaacaacagcatcgcccggaattactaccccatggttcagtcggccttcatggaggatggcaaaagcaggcttgtgttgctgtcggagcgggcacatggcatctccagccaagggaatgggcaggtggaggtcatgctccaccggcggctgtggaacaacttcgactgggacctgggctacaacctcacgctgaacgacacctcagtcgtccacccagtgctctggcttctgctgggatcctggtccctcaccactgccctgcgccagaggagcgcactggcgctgcagcacaggcccgtggtgctgttcggagacctcgctgggactgcgccgaagctcccaggaccccagcagcaagaggccgtgacgctgcccccgaatcttcacctgcagatcctgagcatccctggctggcgctacagctccaaccacacggagcactctcagaatctccggaaaggccatcgaggggaagcccaggctgacctccgccgtgtcctgctgcggctctaccacctgtatgaagtgggcgaggacccagtcctgtctcagccagtaacagtgaatctggaggtgaacttccccacccccatccagaccataagccagggaagcaaaccctagatgaagccccaagaaactgccttggcaaagagatccacgagggcttcctcccaaatggacgctggtatgggccccaccccgcccttcttcatggtcttctgggtttgtcaggtattacaactggcctggttttttagggttttttgtgtatatgtgagacaggatctcactctgttgcccagtctggggtgcagtggcacaatctcagctcactgcaacctctgcctccctggctcaagtgatcctcccacctcaacctcccaagtaactgggatcacaggggcgcgccaccacgatggctaagtttttttttttttttttttgagaccgagtttcgctctcgtcccccaggctggagtgcaatggtgcgctctcagctggctgcaacctccatctcccaggttcaagtgattctcctgcctcagcctcccgagtagctgggattacaggcatgtgccaccacgcccggctaatttttttgtacttttagtagagacagggtttctccatgttggtcaggctggtcacgaacccctgacttcaggtgatccacctgcctcggcctcgcaaagtgctgggattacaggcgtgagccaccaagcctggcctagtttttttatttttagtagagacacggtcttgctgtgttgctcaggctggtctcgaacgtctggcctcaagcaatctgcctgtcttagcctcctgaagtgctgggattacaggcgtgagtggcctgtattttctttcttatttattctgtggtaaaacttttaaaacacagacaacatctgtgtaatccaaaaacaaaacagattccccatagagttgctttgaaaggtgacttagagtcagacaatccagggtccacacccaggcccctctacgggggcatctccggcaccccatgcctctgggcctcagtttccccccatgtaaaatggggagaggtgagagttctttgcccagaaggttgctgagaggccctggcactaaggggcctcgtgcagtgtcagggcccccaggcctcgtccccttccaggttcccctcttggctgatgttgccctctcagctctactatcaggcgaggcttccgccacctggcctgcccacgctccctccccagaaggcatgacctgagccgcctcatttctttcccagtttgcattctttctatttcatttcctgctcatggagaatttctgtgaatctctgtgtttctgccttgggcctccttcgacatctgagtcttcaggggaatccagagaagccccagtaccttttcgccatgatgtcttactgggccacccacctcctctttcatgatcctcgccagggaggatcctttcctcacggtccctggcctgcctgagagcaggtctaggccatggcgggtaccagtgcccagcacagggccagcctgccctgggaagcaaggaggccggcgtgggacctggaagttggtcatctgatgctcccccgtttcacagatggaagcaccaaggccctgagacaaggagacggttgggatggacaccatgactccctgcccaacgtggacggtggtggggtggaaagaccattgagttaggaacgcagtgagtttggctgcaagtcacaaaacacctaacagatgtgcttagaacagaggacagagtgttttctcaccgaacaggcatgtccgatggaccccaagcgctgtcaccgtgggcccgatcactgtcgtcttcccgccatcgccggcagactggcttttgtcttttgccgtctgcttgtttgcggtcacaagatggcacaggcctccctcatgagcaaatttcaaggcagggtggggctcggcagtagtggccagaaaggccttgccctagcgtggctctctccctccgtcagcacacagaagcttctccaagagccacccccacccctcctgctccacagacttttccagacccctaagggcctcctgcctcccctaggtgtaagggaggctgggacaaggcctattgggaaagggggatggggtaactgtggctggcttcctccctggactgggcacggggccacctgagcaatgtggggagaggagaactccgcggtggggtgggcagctcaaaatgccacacctcccgggctgctcctccagctcggccacctggtaaagcatgcacctcccgcttcagtgtcctcatctgtaaagtacacggccagtcctgtcctcgcagatgtgctgtgagaagcagatgagggagctgtgtcaggcaccaggggaggacctgggctcctgaggacaccgagttcgtggtgtgtctgccctgctgctgtcttggttctctgctcagctctggaacttggtgcagctcactctccctctgctcctctccctgcaggctgtgctgcaggcgctggggtccgtggtggcagtggaggagcgctcgctcacagggacctgggatttgagcatgctgcaccgctggagctggaggacggggcctggccgccacagaggtgacaccacctctccctcgaggccaccaggaggccccatcatcaccgtccacccaaaggaaatccggacgttctttattcactttcaacagcagtgagccctgggcagatgccccgtccccagggcttcccccaggaactccatgtaacagaacagacccaggacagggaaaagcagtgcggagggatgggactggggagtcagctgctcatctgcaggctaatggcaggaaatggtcatatttggggtttttccctaatttttttaaacaaaaattacattacaagatccaggttcttcccccccacactcaatcaagccagccctctcctcttctgtcacgtaaaggatatttggcacactcatgcgtcattcattcacaaaacacaaacccaggactttctgcctaaggcagaacacaagactcacagcagcaccgaagcgcatctgccgtccgggccctgccaggcttgccaggctgccagtggtaactgtggacctactgcgtgccacgtgttttcatagactcatcccatgctggcaacagccctgcaaggggcttggctctgccacagggcaggagaggaagttgtagcgcctagcgagagttccagccccagacgcccacctgtgcctcagggcaccgcctgccgagcagagaaggcacagcagccgtcagagtccatgagaggtgaaaccacacagcagggatgtccaatatcagaactattaatatcaataaaagtataaccttcccaggtctatgcccaagagaattgaaaacatccatccacacaatacctgtgctcccgcgttcatagcagcattactcaaaagtcaaacggtagcaacaacccaaatgtccatccacagatgaattaagacatgaagtgtgttctgtccatacaatggaatattatttggccataaaaaggaaggaaattctgacgcatgccacagcctgagtgaatcctacaaatattacgctaagtgaaagaagccaatcacgagtttatgtgaaatgtccagaataggcaaatctgtgtatcagagacaaagcacattggtggttgccaggtactggaggaagagagaagaggcatgacagctaacagggacgggctttctttggaagatgatgaaattgtggaatgatggttgcacaactttgtgaatatactagaaaccaatgaattaaaaactttggaagatg

SEQ ID NO: 43 - DNA, 4715 bp, Homo sapiens
  ref <308>: DATABASE ACCESSION NUMBER: AB023163
  ref <309>: DATABASE ENTRY DATE: 2001-06-18
gaagaaggaggaggaggcccgcgtcgcctccggcggggctcgcgctcgccccgcgctcgccctccgcctcgcccgagccccgggagggtgaaacgctttctcccagcatgcagcgggaggagggatttaacaccaagatggcggacggcccggatgagtacgataccgaagcgggctgtgtgccccttctccacccagaggaaatcaaaccccaaagccattataaccatggatatggtgaacctcttggacggaaaactcatattgatgattacagcacatgggacatagtcaaggctacacaatatggaatatatgaacgctgtcgagaattggtggaagcaggttatgatgtacggcaaccggacaaagaaaatgttaccctcctccattgggctgccatcaataacagaatagatttagtcaaatactatatttcgaaaggtgctattgtggatcaacttggaggggacctgaattcaactccattgcactgggccacaagacaaggccatctatccatggttgtgcaactaatgaaatatggtgcagatccttcattaattgatggagaaggatgtagctgtattcatctggctgctcagttcggacatacctcaattgttgcttatctcatagcaaaaggacaggatgtagatatgatggatcagaatggaatgacgcctttaatgtgggcagcatatagaacacatagtgtggatccaactagattgcttttaacattcaatgtttcagttaaccttggtgacaagtatcacaaaaacactgctctgcattgggcagtgctagcagggaataccacagtcattagccttcttctggaagctggagctaatgttgatgcccagaatatcaagggcgaatcagcgcttgatttggcaaaacagagaaaaaatgtgtggatgatcaaccacttacaagaggcaaggcaagcaaaaggatatgacaatccgtccttccttagaaagctgaaagctgataaggaatttcggcagaaagtaatgttaggaactcctttcctagttatttggctggttgggtttatagcagacctaaatattgattcttggctcattaaagggctaatgtatggtggtgtttgggctacagtacagtttctttcaaaatcctttttcgatcattcaatgcatagtgcattgccccttgggatatatttggcaaccaaattctggatgtatgtgacgtggttcttctggttttggaatgatctcaactttttatttatccatcttccattccttgccaatagtgttgcacttttctacaattttggaaaatcttggaaatcagatccagggattattaaagcaacagaagagcaaaagaaaaagacaatagttgaacttgcagagacaggaagtctggacctcagtatattctgcagtacctgtttgatacgaaaaccggtgaggtccaaacattgtggtgtgtgcaaccgctgtatagcaaaatttgatcatcattgcccatgggtgggtaactgtgtaggtgcaggcaaccatagatattttatgggctacctattcttcttgctttttatgatctgctggatgatttatggttgtatatcttactggggactccactgtgagaccacttacaccaaggatggattttggacatacattactcagattgccacgtgttcaccttggatgttttggatgttcctgaacagtgttttccacttcatgtgggtggctgtattactcatgtgtcagatgtaccagatatcatgtttaggtattactacaaatgaaagaatgaatgccaggagatacaagcactttaaagtcacaacaacgtctattgaaagcccattcaaccatggatgtgtaagaaatattatagacttctttgaatttcgatgctgtggcctctttcgtcctgttatcgtggactggaccaggcagtatacaatagaatatgaccaaatatcaggatctgggtaccagctggtgtagcgacatcttatcctatgaagcatattgctgagtggtgcctgaaaattgtgtctgtccgtgtctttctcacactcgaatccacatcctttgaacaagagcatgctatgtgtagggctaatggtgaattttacagtctttttttcaacacttttattaacaaaagtaaacatggacagaacacactgccatttctgggaagagtaaagatgataaaaaataattttaatggttcttaatgtggaaattcacaacatactcaacttttgggttttgttctcacagtatttttcacaaaaaaagggtaaacttattctattgacagacatggtgtactgatcagaaatgttcagttttaactaaaactaaatttatgttatttggctaaatgttatgatgcagtctagtacgagtattgcatctaattccaggagcattgttttaagttgattgactagttattatgtacatttcagaatgtacacataaatactgtgatgaaaatcatgtgattgggatctactgtgatgttgtcttcaaaggcaggagaaaataatgttcacaataaaatgtgctaacaatgttttgtttctatcagctgttgcaatgctgatatatttctagttcagtgaaataatttgtagtaaccttactctgaggttttacggtctgataatgaagcacttgcatgagtatagtaagtcatgtttttttgttcaaatttaaaagccctgctaattgcatgacacaccacatagaatgtatactagcagatactatccagtgaagcataaattagaatttaatttgatgttcaaaaacagttccatttttaagggttaaggtggtattttcaagaaaaggcagaacaaataatgcaaaattctcagtaatagtgatacatggatatacttccttttaaattctcagctgcaaaataattgtagacaaaataatggcatttaactaaagatggagcatgatctaagtacatagcacatgtgaataaaagaaaagctgacagtatattctggtttcaataaaatgacctatcagaaagtagaatttcatccccaagagtatttcagtttatccaatattgagtaagttctgaaacagttttagaaaaaattttctttttgttaaatgtgatgcactgatcaatttttgtcacagcattttcataccttcatggtggactactagtcactgcttccataaatattgtttacagggtgagatttggtttattcatcttaagtgctgtagcaaactgtggttcgagcaacctgtgggaaatctgtgagagggaatggggtgggagatgtgggggaatggtggtcagactgatgacagatcctagaccaatgtaaagaatgtgtatctgtatataaataatttatcaaatagttttctctttgtgtctgtgttagtgtttttaaagctgctcatttcattttgtccaaccaaaaagaaaagggagataactaatgagcttctagtgatgttcaaaattgctgttaataggcattataccctgcaagttcactgcatgtctgatgcttggtaaaactagtcttccctgtaaaatgcagattacaggtattaaagcaatctagtggtatacccgccccttgccttagtaagaggagcagtgaaatgtatatagttgatgttcagtatttccaagtaccatttttatatagtagcttatttgaccataagtcacacatcaaaaaaagattacccttagtgtatgtgttttaatattagaaaattggcatatgtactttatttttgaaaagggaagagatgggtgtggggtggcaatagcattgtgccattttgtcatagaatgtaaaaattggttaactttacaaatgtcagctagttttgactactaattgggggaaattttagataatttttaaattcaaagttatttataaaatgctagaatttgttttaattttttgtattttgagccacttcacatgaagactcagttgcatttttatcgaatacatttttatcaacagttaaagactatggtggttttttcagagtttggctaagaatgttgttaccatcttctttgtttgtggtacaatattttcagtgcaaaagagatgtcattcagttaaaaagacaaacctctagatgtgtaattacatggaaaatactagcaatgtgaatgcttttgtagtaaccatcttgtagtacctgtgaaatctataactcagaaatggtcagatggtcaggagccagctatgcagcagtataccatctgtttaattattttgtaggtcctgtgtgtggaaccaactataaacccagttctaaagttgtgtatgatggtgaacctttgggaatagttcttatcaacttaattggatacttttagcaaataggaacttaattctcagcactgaacatgaattacttccttggagttttttttcattcatatttttgttgtttccaggaatttatttgatattaatgggcgtaaaacagcatcattgtacttaagctatggatgtttttattttatattttctttatttataactgtgccaagtattattttgctacttaccgtgttattctgtggaaagaaaaacctgtaaagtgtttaataaattagccctccttacataaattaaatgtcaaaattttgtaaaatattaatcagaataaatactgactctt

SEQ ID NO: 44 - DNA, 5542 bp, Homo sapiens
  ref <308>: DATABASE ACCESSION NUMBER: AB023173
  ref <309>: DATABASE ENTRY DATE: 2001-06-18
ctgactgcactggtgatggtccctggcaatccaacctggcaccatcgcagttggagtactatgcatcttcaccagatgaaaaggctctagtagaagctgctgcaaggattggtattgtgtttattggcaattctgaagaaactatggaggttaaaactcttggaaaactggaacggtacaaactgcttcatattctggaatttgattcagatcgtaggagaatgagtgtaattgttcaggcaccttcaggtgagaagttattatttgctaaaggagctgagtcatcaattctccctaaatgtataggtggagaaatagaaaaaaccagaattcatgtagatgaatttgctttgaaagggctaagaactctgtgtatagcatatagaaaatttacatcaaaagagtatgaggaaatagataaacgcatatttgaagccaggactgccttgcagcagcgggaagagaaattggcagctgttttccagttcatagagaaagacctgatattacttggagccacagcagtagaagacagactacaagataaagttcgagaaactattgaagcattgagaatggctggtatcaaagtatgggtacttactggggataaacatgaaacagctgttagtgtgagtttatcatgtggccattttcatagaaccatgaacatccttgaacttataaaccagaaatcagacagcgagtgtgctgaacaattgaggcagcttgccagaagaattacagaggatcatgtgattcagcatgggctggtagtggatgggaccagcctatctcttgcactcagggagcatgaaaaactatttatggaagtttgcagaaattgttcagctgtattatgctgtcgtatggctccactgcagaaagcaaaagtaataagactaataaaaatatcacctgagaaacctataacattggctgttggtgatggtgctaatgacgtaagcatgatacaagaagcccatgttggcataggaatcatgggtaaagaaggaagacaggctgcaagaaacagtgactatgcaatagccagatttaagttcctctccaaattgctttttgttcatggtcatttttattatattagaatagctacccttgtacagtattttttttataagaatgtgtgctttatcacaccccagtttttatatcagttctactgtttgttttctcagcaaacattgtatgacagcgtgtacctgactttatacaatatttgttttacttccctacctattctgatatatagtcttttggaacagcatgtagaccctcatgtgttacaaaataagcccaccctttatcgagacattagtaaaaaccgcctcttaagtattaaaacatttctttattggaccatcctgggcttcagtcatgcctttattttcttttttggatcctatttactaatagggaaagatacatctctgcttggaaatggccagatgtttggaaactggacatttggcactttggtcttcacagtcatggttattacagtcacagtaaagatggctctggaaactcatttttggacttggatcaaccatctcgttacctggggatctattatattttattttgtattttccttgttttatggagggattctctggccatttttgggctcccagaatatgtattttgtgtttattcagctcctgtcaagtggttctgcttggtttgccataatcctcatggttgttacatgtctatttcttgatatcataaagaaggtctttgaccgacacctccaccctacaagtactgaaaaggcacagcttactgaaacaaatgcaggtatcaagtgcttggactccatgtgctgtttcccggaaggagaagcagcgtgtgcatctgttggaagaatgctggaacgagttataggaagatgtagtccaacccacatcagcagatcatggagtgcatcggatcctttctataccaacgacaggagcatcttgactctctccacaatggactcatctacttgttaaaggggcagtagtactttgtgggagccagttcacctcctttcctaaaattcagtgtgatcaccctgttaatggccacactagctctgaaattaatttccaaaatctttgtagtagttcatacccactcagagttataatggcaaacaaacagaaagcattagtacaagcccctcccaacacccttaatttgaatctgaacatgttaaaatttgagaataaagagacatttttcatctctttgtctggtttgtcccttgtgcttatgggactcctaatggcatttcagtctgttgctgaggccattatattttaatataaatgtagaaaaaagagagaaatcttagtaaagagtattttttagtattagcttgattattgactcttctatttaaatctgcttctgtaaattatgctgaaagtttgccttgagaactctatttttttattagagttatatttaaagcttttcatgggaaaagttaatgtgaatactgaggaattttggtccctcagtgacctgtgttgttaattcattaatgcattctgagttcacagagcaaattaggagaatcatttccaaccattatttactgcagtatggggagtaaatttataccaattcctctaactgtactgtaacacagcctgtaaagttagccatataaatgcaagggtatatcatatatacaaatcaggaatcaggtccgttcaccgaacttcaaattgatgtttactaatatttttgtgacagagtataaagaccctatagtgggtaaattagatactattagcatattattaatttaatgtctttatcattggatcttttgcatgctttaatctggttaacatatttaaatttgctttttttctctttacctgaaggctctgtgtatagtatttcatgacatcgttgtacagtttaactatcaataaaaagtttggacagtatttaaatattgcaaatatgtttaattatacaaatcagaatagtatgggtaattaaatgaatacaaaaagaagagcctctttctgcagccgacttagacatgctcttccctttctataagctagattttagaataaagggtttcagttaataatcttattttcaggttatgtcatctaacttatagcaaactaccacaatacagtgagttctgccagtgtcccagtacaaggcatatttcaggtgtggctgtggaatgtaaaaatgctcaacttgtatcaggtaatgttagcaataaattaaatgctaagaatgattaatcgggtacatgttactgtaattaactcattgcacttcaaaacctaacttccatcctgaatttatcaagtagttcagtattgtcatttgtttttgttttattgaaaagtaatgttgtcttaagatttagaagtgattattagcttgagaactattacccagctctaagcaaataatgattgtatacatattaagataatggttaaatgcggttttaccaagttttcccttgaaaatgtaattcctttatggagatttattgtgcagccctaagcttccttcccatttcatgaatataaggcttctagaattggactggcaggggaaagaatggtagagacagaaattaagactttatccttgtttgcttgtaaactattattttcttgctaatgtaacatttgtctgttccagtgatgtaaggatattaagttattaagctaaatattaattttcaaaaatagtccttctttaacttagatatttcatagctggatttaggaagatctgttattctggaagtactaaaaagaataatacaacgtacaatgtctgcattcactaattcatgttccagaagaggaaataatgaagatatactcagtagagtactaggtgggaggatatggaaatttgctcataaaatctcttataaaacgtgcatataacaaaatgacacccagtaggcctgcattacatttacatgaccgtgtttatttgccatcaaataaactgagtactgacaccagacaaagactccaaagtcataaaatagcctatgaccaactgcagcaagacaggaggtcagctcgcctataatggtgcttaaagtgtgattgatgtaattttctgtactcaccatttgaagttagttaaggagaactttatttttttaaaaaaagtaaatggcaaccactagtgtgctcatcctgaactgttactccaaatccactccgtttttaaagcaaaattatcttgtgattttaagaaaagagttttctatttatttaagaaagtaacaatgcagtctgcaagctttcagtagttttctagtgctatattcatcctgtaaaactcttactacgtaaccagtaatcacaaggaaagtgtcccctttgcatatttctttaaaattctttctttggaaagtatgatgttgataattaacttacccttatctgccaaaaccagagcaaaatgctaaatacgttattgctaatcagtggtctcaaatcgatttgcctccctttgcctcgtctgagggctgtaagcctgaagatagtggcaagcaccaagtcagtttccaaaattgcccctcagctgctttaagtgactcagcaccctgcctcagcttcagcaggcgtaggctcaccctgggcggagcaaagtatgggccagggagaactacagctacgaagacctgctgtcgagttgagaaaaggggagaatttatggtctgaattttctaactgtcctctttcttgggtctaaagctcataatacacaaaggcttccagacctgagccacacccaggccctatcctgaacaggagactaaacagaggcaaatcaaccctaggaaatacttgcattctgccctacggttagtaccaggactgaggtcatttctactggaaaagattgtgagattgaacttatctgatcgcttgagactcctaataggcaggagtcaaggccactagaaaattgacagttaagagccaaaagtttttaaaatatgctactctgaaaaatctcgtgaaggctgtaggaaaagggagaatcttccatgttggtgtttttcctgtaaagatcagtttggggtatgatataagcaggtattaataaaaataacacaccaaagagttacgtaaaacatgttttattaattttggtccccacgtacagacattttatttctattttgaaatgagttatctattttcataaaagtaaaacactattaaagtgctgttttatgtgaaataacttgaatgttgttcctataaaaaatagatcataactcatgatatgtttgtaatcatggtaatttagatttttatgaggaatgagtatctggaaatattgtagcaatacttggtttaaaattttggacctgagacactgtggctgtctaatgtaatcctttaaaaattctctgcattgtcagtaaatgtagtatattattgtacagctactcataattttttaaagtttatgaagttatatttatcaaataaaaactttcctatat

SEQ ID NO: 45 - DNA, 4343 bp, Homo sapiens
  ref <308>: DATABASE ACCESSION NUMBER: AB023211
  ref <309>: DATABASE ENTRY DATE: 2001-06-18
cgcacctgctgcaggtgctcccggccgccccggaccagcgagcgcgggcactgcggcggggaggatgctgcgcgagcggaccgtgcggctgcagtacgggagccgcgtggaggcggtgtacgtgctgggcacctacctctggaccgatgtctacagcgcggccccagccggggcccaaaccttcagcctgaagcactcggaacacgtgtgggtggaggtggtgcgtgatggggaggctgaggaggtggccaccaatggcaagcagcgctggcttctctcgcccagcaccaccctgcgggtcaccatgagccaggcgagcaccgaggccagcagtgacaaggtcaccgtcaactactatgacgaggaagggagcattcccatcgaccaggcggggctcttcctcacagccattgagatctccctggatgtggacgcagaccgggatggtgtggtggagaagaacaacccaaagaaggcatcctggacctggggccccgagggccagggggccatcctgctggtgaactgtgaccgagagacaccctggttgcccaaggaggactgccgtgatgagaaggtctacagcaaggaagatctcaaggacatgtcccagatgatcctgcggaccaaaggccccgaccgcctccccgccggatacgagatagttctgtacatttccatgtcagactcagacaaagtgggcgtgttctacgtggagaacccgttcttcggccaacgctatatccacatcctgggccggcggaagctctaccatgtggtcaagtacacgggtggctccgcggagctgctgttcttcgtggaaggcctctgtttccccgacgagggcttctcaggcctggtctccatccatgtcagcctgctggagtacatggcccaggacattcccctgactcccatcttcacggacaccgtgatattccggattgctccgtggatcatgacccccaacatcctgcctcccgtgtcggtgtttgtgtgctgcatgaaggataattacctgttcctgaaagaggtgaagaaccttgtggagaaaaccaactgtgagctgaaggtctgcttccagtacctaaaccgaggcgatcgctggatccaggatgaaattgagtttggctacatcgaggccccccataaaggcttccccgtggtgctggactctccccgagatggaaacctaaaggacttccctgtgaaggagctcctgggcccagattttggctacgtgacccgggagcccctctttgagtctgtcaccagccttgactcatttggaaacctggaggtcagtcccccagtgaccgtgaacggcaagacatacccgcttggccgcatcctcatcgggagcagctttcctctgtctggtggtcggaggatgaccaaggtggtgcgtgacttcctgaaggcccagcaggtgcaggcacccgtggagctctactcagactggctgactgtgggccacgtggatgagttcatgtcctttgtccccatccccggcacaaagaaattcctgctactcatggccagcacctcggcctgctacaagctcttccgagagaagcagaaggacggccatggagaggccatcatgttcaaaggcttgggtgggatgagcagcaagcgaatcaccatcaacaagattctgtccaacgagagccttgtgcaggagaacctgtacttccagcgctgcctagactggaaccgtgacatcctcaagaaggagctgggactgacagagcaggacatcattgacctgcccgctctgttcaagatggacgaggaccaccgtgccagagccttcttcccaaacatggtgaacatgatcgtgctggacaaggacctgggcatccccaagccattcgggccacaggttgaggaggaatgctgcctggagatgcacgtgcgtggcctcctggagcccctgggcctcgaatgcaccttcatcgacgacatttctgcctaccacaaatttctgggggaagtccactgtggcaccaacgtccgcaggaagcccttcaccttcaagtggtggcacatggtgccctgacctgccaggggccctggcgtttgcctccttcgcttagttctccagaccctccctcacacgcccagagccttctgctgacatggactggacagccccgctgggagacctttgggacgtggggtggaatttggggtatctgtgccttgccctccctgagaggggcctcagtgtcctctgaagccatccccagtgagcctcgactctgtccctgctgaaaatagctgggccagtgtctctgtagccctgacataaggaacagaacacaacaaaacacagcaaaccatgtgcccaaactgctccccaaagaattttgagtctctaatctgacactgaatgaggggagaagggaaggagattctgggattgccagttcttccagcagccatgctctgaaaatcaaggtagaatccatggaaagggaccccaggaccccgggaccctagacgtatcttgaactgccatcgtcatttcaaatacatctccctcagggtttccaggtggccacccccaattattcattccttaccaacctctcaaatcctcttggctttctctctgcagtgtggacactgttggctagtcctccccactccctgagggtccagtaagttagcttagaaccttcctggaaacatttcatctgagcaggtttccccacgtgtgggatgctccttttgcctcatctgtctcagggatgcaggctcccccgcatgcatggggatttctccccagaccagcatacttgtgacctgagagttcaatgcgtaaagatgcccctggtcagccatatccatcttctcttgcctggtccttgattctctggccgctccctgaccttcctccttccactgccttgactttcttcctttttattcctggtgccatctgtccaggcagctagacaagaacttgttcgccagcagccagattcaggccttcccaggggcataataagtgaccagcccctcctctccggacatcagatccaacacataaggaccctggcctaccctccagcccaacagccagttctgggtcagctgccaacttaggggtggtttgattatcccattgaaattcaccagtgcctttgccaaagaccctctcatttggacatacccagattcattccctggctccaactgaaaagactcagtttcaatcgttaaaagttcctttagggccagaagaataaatgaattataatcccattttgaagaaccgatttataaccaatgaaaaggttataatgtaatttatattcttggaggaacaagattttcatttgggattatttccttcaaccattcaacaaacatttgttgtatgccactaagcgccaggcacggcgttgggctctgcaaacacagtggttagtagcagtctggacctggtccctactggcatggaacccatcactccccaacatgcaaagcccacatttaaaggccagcctctgccccttcagtgatgcgctctttagaaatgccagcccactatattcagaaatccgcagggcacaaaacttccagcaagtcactgttgtggtgaaatgggcagtgggggtggggggtcttctttaaacaggcccccttcccatctacctagccagtacccatccaatgagtccccagagcctccagaagctgttgtctcctctctggggacagcagctcctgcctttggaggccaaagccccagatctctccagccccagagctgaaaacaccaagtgcctatttgagggtgtctgtctggagacttagagtttgtcatgtgtgtgtgtgtgtttggttaatgtgggtttatgggttttctttctttttttttttttttttttagtctacattagggggaagtgagcgcctcccatgtgcagacagtgtgtctttatagatttttctaaggctttccccaatgatgtcggtaatttctgatgtttctgaagttcccaggactcacacacccgttcccatctcacttgcccacccagtgtgacaaccctcggtgtggatatacccccgtggactcatggctcttccccacccccactttctataaatgtaggcctagaatacgcttctctgttgcaaaactcagctaagttcctgcttccaccttgatgttgaaatatcttatgtaagagggcaggggatgtcgtgaagatggcaagaagaacacagtttcaaatttctggaaaagagcctgtggtggagatctaaagatgtttagggaagagctcgactaaagaacaatgaaataaatggtccaaggggaagtc

SEQ ID NO: 46 - DNA, 3403 bp, Homo sapiens
  ref <308>: DATABASE ACCESSION NUMBER: AB024704
  ref <309>: DATABASE ENTRY DATE: 2001-06-18
caggtctgaggcgaagctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaagcggggcagggtgcgaacaggggcttcgggccacgcttctcttggcgacaggattttgctgtgaagtccgtccgggaaacggaggaaaaaaagagttgcgggaggctgtctgctaataacggttcttgatacatatttgccagacttcaagatttcagaaaaggggtgaaagagaagattgcaactttgagtcagacctgtaggcctgatagactgattaaaccacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaacaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacagttctttccttactggtgctgataacaacagggaaccgtgcagtgtgcattttaagacc

SEQ ID NO: 47 - DNA, 5285 bp, Homo sapiens
  ref <308>: DATABASE ACCESSION NUMBER: AB028985
  ref <309>: DATABASE ENTRY DATE: 2001-06-18
ggcatcctcacgtggtacattgaggctgtgcacccaggcatgtacgggctgccccggccctggtacttcccactgcagaagtcctactggctgggcagtgggcggacagaagcctgggagtggagctggccgtgggcacgcaccccccgcctcagtgtcatggaggaggaccaggcctgtgccatggagagccggcgctttgaggagacccgtggcatggaggaggagcccacccacctgcctctggttgtctgcgtggacaaactcaccaaggtctacaaggacgacaagaagctggccctgaacaagctgagcctgaacctctacgagaaccaggtggtctccttcttgggccacaacggggcgggcaagaccaccaccatgtccatcctgaccggcctgttccctccaacgtcgggttccgccaccatctacgggcacgacatccgcacggagatggatgagatccgcaagaacctgggcatgtgcccgcagcacaatgtgctctttgaccggctcacggtggaggaacacctctggttctactcacggctcaagagcatggctcaggaggagatccgcagagagatggacaagatgatcgaggacctggagctctccaacaaacggcactcactggtgcagacattgtcgggtggcatgaagcgcaagctgtccgtggccatcgccttcgtgggcggctctcgcgccatcatcctggacgagcccacggcgggcgtggacccctacgcgcgccgcgccatctgggacctcatcctgaagtacaagccaggccgcaccatccttctgtccacccaccacatggatgaggctgacctgcttggggaccgcattgccatcatctcccatgggaagctcaagtgctgcggctccccgctcttcctcaagggcacctatggcgacgggtaccgcctcacgctggtcaagcggcccgccgagccggggggcccccaagagccagggctggcatccagccccccaggtcgggccccgctgagcagctgctccgagctccaggtgtcccagttcatccgcaagcatgtggcctcctgcctgctggtctcagacacaagcacggagctctcctacatcctgcccagcgaggccgccaagaagggggctttcgagcgcctcttccagcacctggagcgcagcctggatgcactgcacctcagcagcttcgggctgatggacacgaccctggaggaagtgttcctcaaggtgtcggaggaggatcagtcgctggagaacagtgaggccgatgtgaaggagtccaggaaggatgtgctccctggggcggagggcccggcgtctggggagggtcacgctggcaatctggcccggtgctcggagctgacccagtcgcaggcatcgctgcagtcggcgtcatctgtgggctctgcccgtggcgacgagggagctggctacaccgacgtctatggcgactaccgccccctctttgataacccacaggacccagacaatgtcagcctgcaagaggtggaggcagaggccctgtcgagggtcggccagggcagccgcaagctggacggcgggtggctgaaggtgcgccagttccacgggctgctggtcaaacgcttccactgcgcccgccgcaactccaaggcactcttctcccagatcttgctgccagccttcttcgtctgcgtggccatgaccgtggccctgtccgtcccggagattggtgatctgcccccgctggtcctgtcaccttcccagtaccacaactacacccagccccgtggcaatttcatcccctacgccaacgaggagcgccgcgagtaccggctgcggctatcgcccgacgccagcccccagcagctcgtgagcacgttccggctgccgtcgggggtgggtgccacctgcgtgctcaagtctcccgccaacggctcgctggggcccacgttgaacctgagcagcggggagtcgcgcctgctggcggctcggttcttcgacagcatgtgtctggagtccttcacacaggggctgccactgtccaatttcgtgccacccccaccctcgcccgccccatctgactcgccagcgtccccggatgaggacctgcaggcctggaacgtctccctgccgcccaccgctgggccagaaatgtggacgtcggcaccctccctgccgcgcctggtacgggagcccgtccgctgcacctgctctgcgcagggcaccggcttctcctgccccagcagtgtgggcgggcacccgccccagatgcgggtggtcacaggcgacatcctgaccgacatcaccggccacaatgtctctgagtacctgctcttcacctccgaccgcttccgactgcaccggtatggggccatcacctttggaaacgtcctgaagtccatcccagcctcatttggcaccagggccccacccatggtgcggaagatcgcggtgcgcagggctgcccaggttttctacaacaacaagggctatcacagcatgcccacctacctcaacagcctcaacaacgccatcctgcgtgccaacctgcccaagagcaagggcaacccggcggcttacggcatcaccgtcaccaaccaccccatgaataagaccagcgccagcctctccctggattacctgctgcagggcacggatgtcgtcatcgccatcttcatcatcgtggccatgtccttcgtgccggccagcttcgttgtcttcctcgtggccgagaagtccaccaaggccaagcatctgcagtttgtcagcggctgcaaccccatcatctactggctggcgaactacgtgtgggacatgctcaactacctggtccccgctacctgctgtgtcatcatcctgtttgtgttcgacctgccggcctacacgtcgcccaccaacttccctgccgtcctctccctcttcctgctctatgggtggtccatcacgcccatcatgtacccggcctccttctggttcgaggtccccagctccgcctacgtgttcctcattgtcatcaatctcttcatcggcatcaccgccaccgtggccaccttcctgctacagctcttcgagcacgacaaggacctgaaggttgtcaacagttacctgaaaagctgcttcctcattttccccaactacaacctgggccacgggctcatggagatggcctacaacgagtacatcaacgagtactacgccaagattggccagtttgacaagatgaagtccccgttcgagtgggacattgtcacccgcggactggtggccatggcggttgagggcgtcgtgggcttcctcctgaccatcatgtgccagtacaacttcctgcggcggccacagcgcatgcctgtgtctaccaagcctgtggaggatgatgtggacgtggccagtgagcggcagcgagtgctccggggagacgccgacaatgacatggtcaagattgagaacctgaccaaggtctacaagtcccggaagattggccgtatcctggccgttgaccgcctgtgcctgggtgtgcgtcctggcgagtgcttcgggctcctgggcgtcaacggtgcgggcaagaccagcaccttcaagatgctgaccggcgacgagagcacgacggggggcgaggccttcgtcaatggacacagcgtgctgaaggagctgctccaggtgcagcagagcctcggctactgcccgcagtgtgacgcgctgttcgacgagctcacggcccgggagcacctgcagctgtacacgcggctgcgtgggatctcctggaaggacgaggcccgggtggtgaagtgggctctggagaagctggagctgaccaagtacgcagacaagccggctggcacctacagcggcggcaacaagcggaagctctccacggccatcgccctcattgggtacccagccttcatcttcctggacgagcccaccacaggcatggaccccaaggcccggcgcttcctctggaacctcatcctcgacctcatcaagacagggcgttcagtggtgctgacatcacacagcatggaggagtgcgaggcgctgtgcacgcggctggccatcatggtgaacggtcgcctgcggtgcctgggcagcatccagcacctgaagaaccggtttggagatggctacatgatcacggtgcggaccaagagcagccagagtgtgaaggacgtggtgcggttcttcaaccgcaacttcccggaagccatgctcaaggagcggcaccacacaaaggtgcagtaccagctcaagtcggagcacatctcgctggcccaggtgttcagcaagatggagcaggtgtctggcgtgctgggcatcgaggactactcggtcagccagaccacactggacaatgtgttcgtgaactttgccaagaagcagagtgacaacctggagcagcaggagacggagccgccatccgcactgcagtcccctctcggctgcttgctcagcctgctccggccccggtctgcccccacggagctccgggcacttgtggcagacgagcccgaggacctggacacggaggacgagggcctcatcagcttcgaggaggagcgggcccagctgtccttcaacacggacacgctctgctgaccacccagagctgggccagggaggacacgctccactgaccacccagagctgggccagggactcaacaatggggacagaagtcccccagtgcctgccagggcctggagtggaggttcaggaccaaggggcttctggtcctccagcccctgtactcggccatgccctgcggtcactgcggttgccgcccctaattgtgccaaaggctgacccggcccgggctgcgtacacccttgccctgctttgccttaaagcctcggggtctgcccggcccctcgcccctgcctggcactgctcaccgcccaaggcgacgccggctggaccaggcactgctggcctttctcctgcccggcctcggaaccagcttttctctcttacgatgaaggctgatgccgagagcgggctgtgggcggagctgggtcagtcccgtatttattttgctttgagaagaggctcctctggccctgctctcctgcagggaggtggctgtcccgcgggaagccatcagcttgggccagctggcaggtggcaggaatggagaagctgaccctgctggccaggcaaggggccagaccccccccaacccccagctgccatcgctctcccacccagcttggccccctgcccgcccacctccctgggagccgggcctgtacatagcgcacagatgtttgttttaaataaataaacaaaatgtc

SEQ ID NO: 48 - DNA, 5223 bp, Homo sapiens
  ref <308>: DATABASE ACCESSION NUMBER: AB028986
  ref <309>: DATABASE ENTRY DATE: 2001-06-18
gcagccgcagctcgggggcggtgcctgccttgcagcctcccctcggcgatcgcgcagccccatctttgtccggcctccgcgctttgttctcggcgcccgggccttggccagcctggccagccgccgagcagcccccacgccgcgctggcgtcgtcctcgcctccctcgccgccgccccccgcgcgcggccgggccttgccccccatggtgtcccggccagagcccgagggcgaggccatggacgccgagctggcggtagcgccgccgggctgctcgcacctgggcagcttcaaggtggacaactggaagcagaacctgcgggccatctaccagtgcttcgtgtggagcggcacggctgaggcccgcaagcgcaaggccaagtcctgtatctgccatgtctgtggcgtccacctcaacaggctgcattcctgcctctactgtgtcttcttcggctgtttcacaaagaagcatattcacgagcatgcgaaggcgaagcggcacaacctggccattgatctgatgtatggaggcatctactgttttctgtgccaggactacatctatgacaaagacatggaaataatcgccaaggaggagcagcgaaaagcttggaaaatgcaaggcgttggagagaagttttcaacttgggaaccaaccaaacgggagcttgaactgctgaagcacaacccgaaaaggagaaagatcacctcgaactgcaccataggtctgcgtgggctgatcaaccttgggaacacatgcttcatgaactgcatcgtgcaggccctgacccacacgccacttctgcgggacttcttcctgtctgacaggcaccgctgtgagatgcagagccccagctcctgtctggtctgtgagatgtcctcactgtttcaggagttttactctggacaccggtcccctcacatcccgtataagttgctgcacctggtgtggacccacgcgaggcacctagcaggctacgagcagcaggacgcccacgagttcctcatcgcggccctggacgtgctccaccgacactgcaaaggtgatgacaatgggaagaaggccaacaaccccaaccactgcaactgcatcatagaccagatcttcacaggcgggttgcagtcagacgtcacctgccaagtctgccatggagtctccaccaccatcgaccccttctgggacatcagcttggatctccccggctcttccaccccattctggcccctgagcccagggagcgagggcaacgtggtaaacggggaaagccacgtgtcgggaaccaccacgctcacggactgcctgcgacgattcaccagaccagagcacttgggcagcagcgccaagatcaagtgcagcggttgccatagctaccaggagtccacaaagcagctcactatgaagaaactgcccatcgtagcctgttttcatctcaaacgatttgaacactcagccaagctgcggcggaagatcaccacgtatgtgtccttccccctggagctggacatgacccctttcatggcctccagcaaagagagcaggatgaatggacagtaccagcagcccacggacagtctcaacaatgacaacaagtattccctgtttgctgttgttaaccatcaagggaccttggagagtggccactacaccagctttatccggcagcacaaagaccagtggttcaagtgtgacgatgccatcatcaccaaggccagcatcaaggacgtcctggacagcgaagggtacttgctgttctatcacaaacagttcctggaatacgagtagccttatctgcagctggtcagaaaaacaaaggcaatgcattggcaagcctcacaaagtgatcctccctggccccccccctcccccaagcctcccaccgcctccccggcctggtgacaccacctcccatgcagatgtggcccctctgcacctgggacccatcgggtcgggatggaccacacggacggggaggctcctggagctgctttgaagatggatgagatgaggggtgtgctctgggtgggaggagcagcgtacacccgtcaccagaacatctcttgtgtcatgacatgggggtgcaacgggggcctcacagcacagagtgaccgctgcctggcgttccccagcactcggtgtggaaaggcccctacctgctgtaagattatgggtccatgaaagcagtaagctggacacagaggtgtagtgtgcgggacagagggccttgcagatgcctttctgttggtgttttagtgttaaaatacggagagtatggaactcttcacctccattttctcagcggctgtgaagcagcctcctagcttcggaagtacggacactacgtcgcgttttcaagcgtgtctgttctgcaggtaacagcatcaagctgcacgtggaagcatctcgcggttttctagaaacaggcattttcttatccctctcccgctcctttttccacaaaggtgaatttcataaatgtaatactagtaaagtgaatgaattactgagtttatacagaaatttaggtaacttctcctttagtctcaagagcgagtcttgctttttaatgggtgccgtttatgttgctgcccgccctgtgtgcctggctcctctgggtgccttggtgtctgctggtggctggcagtgggcgcagcggaggagagttgtgctgcagctcatacggtgtgtctgtcatctcagtctggagtaaatgcagtgtctgccggtgtctgatgggttctgtccctcgtattttctttgccttctatcccattgcctggctaccgctgcctggcagccaagggtgttggtcgcgaagctggagtggcctctggtggagcctgcatcttgtctcgtctgcctctgctttacatttggtgtactttcgggcgtggtggcagtaaaatgacaccgtgattgagcttgtcagcagagctgaaagagaaagtagaaggatgtgcattgtttcttgtaagatatcttgcatgtatctgtgtattcaaattcaaacagagatggtttgtccatttgtccactgagaaattataaactagggacaagggggaggaaaagtactgaaatacagtttatgaagcaagtgtgtctcgggctgtgcttgtcccaggagccccagcagcatctgaactgaggcttcttcagtcctgcaggaacaggatcatctgtctcagcggtgggcagatgttttcatagacagccagggagtaaacactgttggctctgtgggctgtatggtctctgccataaatagtacagagatgtggctgtgtctagtacaacttttagacacagaaatctgaatgacatatattgttctgtgtcaagaaacttagattttttttttaactatttaaaaacgtgaaacctattcttagctcacaggccatggagaagctggtggggaccagacccagctccttagctggctgggctggggagggggcagtgacagtggcagctgctactcactgctcagtgtggaaaacacaggacttggcaatcacagcccgcagaaccatcatgtgtggcagaagcctgagggatgcggtttcttgcccacgtgctctgttcattttctgttgtttttctgcacttaaagaattcacatggaagcatgttttataaaatgaattaccagagaaacagagatgggccgagattctcagaaatggtcccatgtgaccaagttctgctgtttgggtgacagtgctttgaagatctcctttgaggatgtgcagtctttttttttttttttttttttttgagatggagtttgttgcccaggctggagtgagtggcacagtctcggctcactgcaacctccacctcctgggttcaagcagttctcgtgccgcagcctcccaagtagctgggactacaggcatgcgccaccacgccaggctaatttttgtatttttagtagagatggggtttcaccatgtctcaaactcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctaaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatgactgtgctgtggttggagactttatttaccaagatgtttactcttcctttccccttccattttgaggagctgtgtcactcctcctcccccccagtgctttgtagtctctcctatgtcataataaagctacattttctctg

SEQ ID NO: 49 - DNA, 4692 bp, Homo sapiens
  ref <308>: DATABASE ACCESSION NUMBER: AB028998
  ref <309>: DATABASE ENTRY DATE: 2001-06-18
gcgcggcccggctggccgtctgcgcaccctctctcccctcggctctttcctaggaaagctgagcctcatagcttccgggagaaggttttccggaagaaacctccagtctgtgcagtatgtaaggtgaccatcgatgggacaggcgtttcgtgcagagtctgcaaggtggcgacgcacagaaaatgtgaagcaaaggtgacttcagcctgtcaggccttgcctcccgtggagttgcggcgaaacacggccccagtcaggcgcatagagcacctgggatccaccaaatctctgaaccactcaaagcagcgcagcactctgcccaggagcttcagcctggacccgctcatggagcggcgctgggacttagacctcacctacgtgacggagcgcatcttggccgccgccttccccgcgcggcccgatgaacagcggcaccggggccacctgcgcgagctggcccatgtgctgcaatccaagcaccgggacaagtacctgctcttcaacctttcagagaaaaggcatgacctgacccgcttaaaccccaaggttcaagacttcggctggcctgagctgcatgctccacccctggacaagctgtgctccatctgcaaagccatggagacatggctcagtgctgacccacagcacgtggtcgtactatactgcaagggaaacaagggcaagcttggggtcatcgtttctgcctacatgcactacagcaagatctctgcaggggcggaccaggcactggccactcttaccatgcggaaattctgcgaggacaaggtggccacagaactgcagccctcccagcgtcgatatatcagctacttcagtgggctgctatctggctccatcagaatgaacagcagccctctcttcctgcactatgtgctcatccccatgctgccagcctttgaacctggcacaggcttccagcccttccttaaaatctaccagtccatgcagcttgtctacacatctggagtctatcacattgcaggccctggtccccagcagctttgcatcagcctggagccagccctcctcctcaaaggcgatgtcatggtaacatgttatcacaagggtggccggggcacagaccggaccctcgtgttccgagtccagttccacacctgcaccatccacggaccacagctcactttccccaaggaccagcttgacgaggcctggactgatgagaggttccccttccaagcctccgtggagtttgtcttctcctccagccccgagaagatcaaaggcagcactccacggaacgacccctcggtctctgtcgactacaacaccactgagccagccgtgcgctgggactcctatgagaacttcaaccagcaccacgaggacagtgtggatggctccttgacccacacccggggtcccctggatggcagtccttatgcccaggtgcagcggcctccccggcagacccccccggcaccctctccagagcctccaccaccccccatgctctctgtcagcagcgactcaggccattcctccacgctgaccacagagccggctgctgagtcccctggccggccgccccctacagctgctgaacggcaggagctggatcgcctcctaggaggctgcggagtggccagtgggggccggggagctgggcgcgagacggccatcctagatgacgaagagcagcccactgtgggcggaggcccccacctcggagtgtatccaggccataggcctggcctcagccgccactgctcctgccgccagggctaccgggagccctgcggggttcccaatgggggctactaccggccagagggaaccctggagaggaggcgactggcctacgggggctatgagggatccccccagggctacgccgaggcctcgatggagaagaggcgcctctgccgatcgctgtcagaggggctatacccctacccacctgagatggggaaaccagccactggggactttggctaccgcgccccaggctaccgggaggtggtcatcctggaggaccctgggctgcctgccctatacccatgcccagcctgcgaggagaagctggcgctgcctacagcagccttgtatggactgcggctggagagggaggctggagaagggtgggcaagtgaggctggcaagcctctcctgcacccagtgcggcctgggcacccgctgcctctgctcttgcctgcctgtgggcatcaccatgccccgatgcctgactacagctgcctgaagccacccaaggcaggcgaggaagggcacgagggctgctcctacaccatgtgccccgaaggcaggtatgggcatccagggtaccctgccctggtgacatacagctatggaggagcagttcccagttactgcccagcatatggccgtgtgcctcatagctgtggctctccaggagagggcagagggtatcccagccctggtgcccactccccacgggctggctccatttccccgggcagcccgccctatccacaatctaggaagctgagctacgagatccctacggaggagggaggggacaggtacccattgcctgggcacctggcctcagcaggacctttggcatctgcagagtcgctggagccggtgtcctggagggagggccccagtgggcacagcacactgcctcggtctccccgagatgccccatgcagtgcttcgtcagagttgtctggtccctccacgcccctgcacaccagcagtccagtccagggcaaggaaagcacccggcgacaggacaccaggtcccccacctcagcgcccactcagagactgagtcctggcgaggccttgccccctgtttcccaggcaggcaccggaaaggcccctgagctgccgtcgggaagtgggcctgagcctctggcccctagcccagtctctccgaccttccctcccagctcgcccagtgactggcctcaggaaaggagtccagggggccactcagatggcgccagtcctcggagccctgtgcccaccacacttcctggcctccgccacgccccctggcaaggccctcgaggcccccccgacagcccagatgggtctcccctcactcctgtgccttcccagatgccctggcttgtggccagcccagagccgcctcagagctcacctacacctgctttccccctggctgcctcctatgacaccaatggccttagccagcccccacttcctgagaaacgccacctgcccgggccggggcaacagccaggaccctggggcccagagcaggcatcatcgccagccagaggcatcagtcaccatgtcaccttcgcacctctgctctcagataatgtcccccaaaccccagagcctcctacacaagagagccaaagcaatgtcaagtttgtccaggatacatccaagttctggtacaagccacacctgtcccgtgaccaagccattgccctgctgaaggacaaggaccctggggccttcctgatcagggacagtcattcattccaaggagcttatgggctggccctcaaggtggccacaccgccacccagtgcccagccctggaaaggggaccccgtggaacagctggtccgccatttcctcatcgagactgggcccaaaggggtgaagatcaagggctgccccagtgagccctactttggcagcctgtccgccttggtctcccagcactccatctcccccatctccctgccctgctgcctgcgcattctcagcaaagatcctctggaagagaccccagaggctccagtgcccaccaacatgagcacagcggcagacctcctgcgtcagggtgctgcctgcagcgtgctctacttgacctcagtggagacagagtcactgacgggcccccaagctgtggcccgggccagctctgcagctctgagctgtagcccccgcccgacaccagctgttgtccacttcaaggtgtcagcccagggcattacactgacggacaaccaaaggaagctcttctttcgccgccattatccagtgaacagcatcaccttctccagcactgaccctcaagaccggagatggaccaacccagacgggaccacctccaagatctttggtttcgtggccaagaagccgggaagcccctgggagaatgtgtgtcacctctttgcagagcttgacccagatcagcctgctggcgccattgtcaccttcatcaccaaagttctactgggccagagaaaatgaaggaaggccacaagctcagagcccacatcaacactgcccccctcccagcaccccacagccctcacatcccctggcctggacccaggagacccaggagaaagcaccctcccttaggaatgaggagtgggcatcaggcctgggacactgctctccttccccgcccccagcctgctaagttaagtggacaggcccacaagatgaccttgcatgtgagcagatggcagagatgggtgtgtgaggggtgaggaggcatcagcagttgagccccgaaggagatcaggcagccccacctgcaggagaacgtcagccctccaggggatcagcccctgccagttccacccagctgcaggtgccagcacggcagggatgggagaggggtggggagcgagtcactgcctcctctgagcagagattcagagtaggatcacatgaataggggaaaaaagagagtctatttttgtctaataataaagaatttctataaacttt

SEQ ID NO: 50 - DNA, 4341 bp, Homo sapiens
  ref <308>: DATABASE ACCESSION NUMBER: AB029025
  ref <309>: DATABASE ENTRY DATE: 2001-06-18
cgctctcggcagacgccttcaccagatgtagtcctcaggggaagcagcgatgggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcagatacggtccgagaactcctgtgtctgatgacgcagagagcaccagcatgtttgacatgcggtgtgaggaggaggccgcggtgcagccgcacagcagggcccgccaggagcagctgcagctgataaataaccagctgagggaagaggacgacaaatggcaagatgacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaaagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagcaaccactgagaaaacggaaccgaatagtcaagaggacaagaatgatggtggaaaatcaagaaaagggaatatagaacttgcctcatcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtggtaaagccaaaatctccagaacccgaagcaacgctgacatttccatttctggacaaaatgcctgaagccaaccaactacatttgccaaatctcaattctcaagtggattctccaagcagtgagaagtcacctgttacgacaccttttaagttctgggcatgggacccagaagaggagcgcaggcgacaggaaaaatggcaacaggaacaggaacgtttgctccaggagagataccagaaggagcaggacaagctgaaagaagagtgggaaaaggcccaaaaggaggtggaagaggaagaacgcagatactatgaggaggagcgtaagataattgaagacactgtggttccatttactgtttcttcaagttccgctgaccagctgtctacctcttcctccatgactgaaggcagtgggacaatgaataagatagacctgggaaactgtcaagatgaaaaacaagacagaagatggaagaaatcattccagggagatgacagtgacttattgctgaagactagggaaagtgatcgactggaggagaagggcagcctaactgaaggggccttggctcattctgggaaccctgtatcaaaaggagtccatgaagaccatcagctggataccgaggctggggccccacactgtggaacaaacccacagcttgctcaggatccatcccagaatcagcagacatcaaatccaacgcacagttcagaagatgtgaagccaaaaaccctcccgctggataaaagcattaaccatcagatcgagtctcccagtgaaaggcggaagtctataagtggaaagaagctgtgctcttcctgtgggcttcctttgggtaaaggagccgcaatgatcatcgagaccctcaatctctattttcacatccagtgtttcaggtgtggaatttgtaaaggccagcttggagatgcagtgagtgggacggatgttaggattcgaaatggtctcctgaactgtaatgattgctacatgcgatccagaagtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctgtcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaat

SEQ ID NO: 51 - DNA, 2576 bp, Homo sapiens
  ref <308>: DATABASE ACCESSION NUMBER: AB029031
  ref <309>: DATABASE ENTRY DATE: 2001-06-18
aattcttccaaaacaaaactagaactgcaaaagcacctgacgacattaaccaatcaggagcaggcgactatttttgaagaggttcagaaattgagaccgagaaatgagcagcgagagaatgaattgattatttcttttctgagatgtttatatgaagagaaacagaaagaacacatccatattggggagatgaagcagacatcgcagatggcagcagagaatattggaagtgaattaccacccagtgccactcgatttaggctagatatgctgaaaaacaaagcaaagagatctttaacagagtctttagaaagtattttgtcccggggtaataaagccagaggcctgcaggaacactccatcagtgtggatctggatagctccctgtctagtacattaagtaacaccagcaaagagccatctgtgtgtgaaaaggaggccttgcccatctctgagagctcctttaagctcctcggctcctcggaggacctgtccagtgactcggagagtcatctcccagaagagccagctccgctgtcgccccagcaggccttcaggaggcgagcaaacaccctgagtcacttccccatcgaatgccaggaacctccacaacctgcccgggggtccccgggggtttcgcaaaggaaacttatgaggtatcactcagtgagcacagagacgcctcatgaacgaaaggactttgaatccaaagcaaaccatcttggtgattctggtgggactcctgtgaagacccggaggcattcctggaggcagcagatattcctccgagtagccaccccgcagaaggcgtgcgattcttccagcagatatgaagattattcagagctgggagagcttcccccacgatctcctttagaaccagtttgtgaagatgggccctttggccccccaccagaggaaaagaaaaggacatctcgtgagctccgagagctgtggcaaaaggctattcttcaacagatactgctgcttagaatggagaaggaaaatcagaagctccaagcctctgaaaatgatttgctgaacaagcgcctgaagctcgattatgaagaaattactccctgtcttaaagaagtaactacagtgtgggaaaagatgcttagcactccaggaagatcaaaaattaagtttgacatggaaaaaatgcactcggctgttgggcaaggtgtgccacgtcatcaccgaggtgaaatctggaaatttctagctgagcaattccaccttaaacaccagtttcccagcaaacagcagccaaaggatgtgccatacaaagaactcttaaagcagctgacttcccagcagcatgcgattcttattgaccttgggcgaacctttcctacacacccatacttctctgcccagcttggagcaggacagctatcgctttacaacattttgaaggcctactcacttctagaccaggaagtgggatattgccaaggtctcagctttgtagcaggcattttgcttcttcatatgagtgaggaagaggcgtttaaaatgctcaagtttctgatgtttgacatggggctgcggaaacagtatcggccagacatgattattttacagatccagatgtaccagctctcgaggttgcttcatgattaccacagagacctctacaatcacctggaggagcacgagatcggccccagcctctacgctgccccctggttcctcaccatgtttgcctcacagttcccgctgggattcgtagccagagtctttgatatgatttttcttcagggaacagaggtcatatttaaagtggctttaagtctgttgggaagccataagcccttgattctgcagcatgaaaacctagaaaccatagttgactttataaaaagcacgctacccaaccttggcttggtacagatggaaaagaccatcaatcaggtatttgaaatggacatcgctaaacagttacaagcttatgaagttgagtaccacgtccttcaagaagaacttatcgattcctctcctctcagtgacaaccaaagaatggataaattagagaaaaccaacagcagcttacgcaaacagaaccttgacctccttgaacagttgcaggtggcaaatggtaggatccaaagccttgaggccaccattgagaagctcctgagcagtgagagcaagctgaagcaggccatgcttaccttagaactggagcggtcggccctgctgcagacggtggaggagctgcggcggcggagcgcagagcccagcgaccgggagcctgagtgcacgcagcccgagcccacgggcgactgacagctctgcaggagagattgcaacaccatcccacactgtccaggccttaactgagagggacagaagacgctggaaggagagaaggaagcgggaagtgtgcttctcagggaggaaaccggcttgccagcaagtagattcttacgaactccaacttgcaattcagggggcatgtcccagtgttttttttgttgtttttagatactaaatcgtcccttctccagtcctgattactgtacacagtagctttagatggcgtggacgtgaataaatgcaacttatgtttt

SEQ ID NO: 52 - DNA, 4147 bp, Homo sapiens
  ref <308>: DATABASE ACCESSION NUMBER: AB032951
  ref <309>: DATABASE ENTRY DATE: 2001-06-18
ggagtgtagaggaaataaaatcatgtctgtggctcatgacagcattccatattcagttgttgggttgtgttgttgttgttgtgtgtgtttttaataataccatgtaactgtttaaaaaaatttcctttttgatcaagtcccaaatctgccagcctgttctctcttcctaactgtggaaaaatgagacggttgcttgaacatttgttggcttggctgaagaggaaataaaaacagaacaggaggtggtagagggcatggatatctctactcgctccaaagatcctggctctgcagagagaacagcccagaaaagaaagttccccagccctccacattcttccaatggccactcgccgcaggacacatcaacaagccccattaaaaagaaaaagaaacctggcttactgaacagtaacaataaggagcagtcagaactaagacatggtccgttttactatatgaagcagccactcaccacagaccctgttgatgttgtaccgcaggatggacggaatgatttctactgctgggtttgtcaccgggaaggccaagtcctttgctgtgagctctgtccccgggtttatcacgctaagtgtctgagactgacatcggaaccagagggggactggttttgtcctgaatgtgagaaaattacagtagcagaatgcatcgagacccagagtaaagccatgacaatgctcaccattgaacagttatcctacctgctcaagtttgccattcagaaaatgaaacagccagggacagatgcattccagaagcccgttccattggaacagcaccctgactatgcggaatacatcttccatccaatggacctttgtacattggaaaagaatgcgaaaaagaaaatgtatggctgcacagaagccttcctggctgatgcaaagtggattttgcacaactgcatcatttataatgggggaaatcacaaattgacgcaaatagcgaaagtagtcatcaaaatctgtgaacatgagatgaatgaaatcgaagtatgtccagaatgttatctagctgcttgccaaaaacgagataactggttttgtgagccttgtagcaatccacatcctttggtctgggccaaactgaaggggtttccattctggcctgcaaaagctctaagggataaagacgggcaggtcgatgcccgattctttggacaacatgacagggcctgggttccaataaataattgctacctcatgtctaaagaaattcctttttctgtgaaaaagactaagagcatcttcaacagtgccatgcaagagatggaggtttacgtggagaacatccgcaggaagtttggggtttttaattactctccatttaggacaccctacacacccaacagccagtatcaaatgctgctcgatcccaccaaccccagcgccggcactgccaagatagacaagcaggagaaggtcaagctcaactttgacatgacggcatcccccaagatcctgatgagcaagcctgtgctgagtgggggcacaggccgccggatttccttgtcggatatgccgcgctcccccatgagcacaaactcttctgtgcacacgggctccgacgtggagcaggatgctgagaagaaggccacgtcgagccacttcagtgcgagcgaggagtccatggacttcctggataagagcacagcttcaccagcctccaccaagacgggacaagcagggagtttatccggcagcccaaagcccttctctcctcaactgtcagctcctatcacgacgaaaacggacaaaacctccaccaccggcagcatcctgaatcttaacctggatcgaagcaaagctgagatggatttgaaggagctgagcgagtcggtccagcaacagtccacccctgttcctctcatctctcccaagcgccagattcgtagcaggttccagctgaatcttgacaagaccatagagagttgcaaagcacaattaggcataaatgaaatctcggaagatgtctatacggccgtagagcacagcgattcggaggattctgagaagtcagatagtagcgatagtgagtatatcagtgatgatgagcagaagtctaagaacgagccagaagacacagaggacaaagaaggttgtcagatggacaaagagccatctgctgttaaaaaaaagcccaagcctacaaacccagtggagattaaagaggagctgaaaagcacgtcaccagccagcgagaaggcagaccctggagcagtcaaggacaaggccagccctgagcctgagaaggacttttccgaaaaggcaaaaccttcacctcaccccataaaggataaactgaagggaaaagatgagacggattccccaacagtccatttgggcctggactctgattcagagagcgaacttgtcatagatttaggagaagaccattctgggcgggagggtcgaaaaaataagaaggaacccaaagaaccatctcccaaacaggatgttgtaggtaaaactccaccatccacgacggtgggcagccattctcccccggaaacaccggtgctcacccgctcttccgcccaaacttccgcggctggcgccacagccaccaccagcacgtcctccacggtcaccgtcacggccccggcccccgccgccacaggaagcccagtgaaaaagcagaggccgcttttaccgaaggagactgccccggccgtgcagcgggtcgtgtggaactcatcaagtaagtttcaaacgtcctcccaaaagtggcacatgcagaagatgcagcgtcagcagcagcagcagcagcagcaaaaccagcagcagcagcctcagtcttcccaggggacgagatatcagaccagacaggctgtgaaagctgtccagcagaaggagatcacacagagcccatccacgtccaccatcaccctggtgaccagcacacagtcatcgcccctggtcaccagctcggggtccatgagcacccttgtgtcctcagtcaacgctgacctgcccatcgccactgcctcagctgatgtcgccgctgatattgccaagtacactagcaaaatgatggatgcaataaaaggaacaatgacagaaatatacaacgatctttctaaaaacactactggaagcacaatagctgagattcgcaggctgaggatcgagatagagaagctccagtggctgcaccagcaagagctctccgaaatgaaacacaacttagagctgaccatggcggagatgcggcagagcctggagcaggagcgggaccggctcatcgccgaggtgaagaagcagctggagttggagaagcagcaggcggtggatgagaccaagaagaagcagtggtgcgccaactgcaagaaggaggccatcttttactgctgttggaacaccagctactgtgactacccctgccagcaagcccactggcctgagcacatgaagtcctgcacccagtcagctactgctcctcagcaggaagcggatgctgaggtgaacacagaaacactaaataagtcctcccaggggagctcctcgagcacacaatcagcaccttcagaaacggccagcgcctccaaagagaaggagacgtcagctgagaaaagcaaggagagtggctcgacccttgacctttctggctccagagagacgccctcctccattctcttaggctccaaccaaggctctgaccattcccggagtaataaatccagttggagcagcagtgatgagaagaggggatcgacacgttccgatcacaacaccagtaccagcacgaagagcctcctcccgaaagagtctcggctggacaccttctgggactagcagtgaatcgggacacaaaccacccaccccattgggagaaaaacccagacgccaggaaaagaagaaacaacaaaggcaggagaacagccactttcagacttgaaaatgacaaaaccctcagttgagcctgagcccccggcgcgggggctgctacactacaggacacccagcatcggctttgactgcagactgttcacccacacgagccctgtgcttttggtgtaaataatgtacaatttgtggatgtcattgaatctagaggactttcccctttttatatttgtattaactttaacttattaaaaaaaaaaaaagaaaaagaaaaacgattt

SEQ ID NO: 53 - DNA, 4350 bp, Homo sapiens
  ref <308>: DATABASE ACCESSION NUMBER: AB032966
  ref <309>: DATABASE ENTRY DATE: 2001-06-18
tctttccagcatgcctccggcttcttgggggaacacagtcccggtggtcagaggtcctgcaggggaggcctctctctggaacgcctacccaactccatcgcctcccgcttccgcctgacagagagggaggaggaagtgatcacctgttttgagagggcctcctggatcgctcaggtgttcctgcaggaattggagaagaccacaaataacagcacgtcgaggcatctgaaaggctgtcacccgcttgactatgagctcacctacttcctggaagctgccctccagagcgcctatgtgaaaaacctgaagaaggggaacatcgtgaagggcatgagagagctccgggaagtgctgcggactgtggagaccaaagcaactcagaacttcaaagtgatggcggccaagcacctggcgggggtcctgctgcactccctgagtgaggagtgctactggagccccctgtcccaccctctgcctgagttcatgggcaaggaggagagttctttcgccactcaggccctgcggaaacctcacctctatgaaggagacaacctctactgccccaaggacaacatcgaggaagccctcctgctcctcctcatcagcgaatccatggcaactcgagatgtggtgctgagccgggtgccggagcaggaggaggaccggacagtgagcttgcagaatgccgcagccatctatgacctcctgagcatcacgttgggcagaaggggacagtacgtcatgctctcggagtgcctggagcgagccatgaagtttgcgtttggagaatttcacctttggtaccaggtggccctctccatggtggcttgtgggaagtcagcctacgctgtgtccctgctgcgggagtgtgtgaagttgcggccctcggaccccaccgtgcccctgatggccgcgaaggtctgcatcgggtcccttcgctggctagaggaagcagagcactttgccatgatggtgatcagcctcggagaggaagccggggagttcctccccaagggctacctggctctgggtctcacctatagcctgcaggccaccgacgccaccctgaagtccaagcaagatgaattgcaccggaaggcactgcagacgctggagagggctcagcagctggcgcccagtgacccccaggtcatcctctatgtctcgctgcagctggccctcgtccgacagatctccagtgccatggagcagctgcaggaggccctgaaggtacgcaaggatgatgcccacgccctccacctgctggcactgctcttctctgcccagaagcaccaccagcatgccctggatgttgtcaacatggccatcaccgagcaccctgagaacttcaacctgatcttcaccaaggtgaagctggagcaggtgctgaaaggcccagaggaagccctcgtgacctgcagacaagtgctgaggctgtggcagaccctgtacagcttctcccagctgggaggcctagaaaaggatggcagcttcggtgagggcctcaccatgaagaagcagagtggcatgcacctgactttgcctgatgcccatgatgcagactctggctcccggcgggcttcgtccatcgccgcctcccggctggaggaggccatgtcagagctgactatgccctcttcggtcctgaagcagggccccatgcagctgtggaccacgctggaacagatctggctgcaggctgctgagctgttcatggagcagcagcacctcaaggaagcaggtttctgcatccaggaggcggcgggcctcttccccacttctcactcagtactctatatgcggggccggctggctgaggtgaagggcaacctggaggaggccaagcagctgtacaaggaggcgctcacggtgaacccagatggcgtgcgcatcatgcatagcctgggtctgatgctgagtcggctgggccacaagagcttggcccagaaggtgcttcgtgatgccgtggagaggcagagtacgtgccacgaggcgtggcagggcctgggcgaggtgctgcaggcccagggccagaacgaggctgccgttgactgcttcctcaccgcccttgagctggaggccagcagccctgtactgcccttctccatcatccccagagagctctgacgacgctgcagccgcagggagggaggggctggccagagggagaggcagcagggaacgtgggtcagggtggggcaacagtggcatcaggtgcggggcctcagggaaatacatctttagtgaacgcctctgcagctgcagccctcgttctcttggctgggccaagagggccttcctggatttctttgttggtgccttgggaaacagtctgacttgaaccctaagtgcctttggagagttttgtggtgaccagacttgctccccaagagctgggcagcggggagcctcacagctgtccttcaccctcacccatgcctctggcttggggtctgggtggggggttctcactccccactctcagcacagtacagacttctggatctctctcaggtcttgcccagggcggtcacaatgtgaagaaactgcgggcaagtgggaagactatgagatttctgggttcccttctcagacttggagttagtagatgattcctgcattgcccctgcttgccctctgagaccagctgggccccaccttgctctttccccctgctaccaagtgcctttggggcctctggggtctgaccaggggtactgagcaccggccctaacacttccatctccacccaccccatctccctggcgatgtgctccagcccaagcagcctccgtaggctttagatcctgtggttgctagatccagtcctttctaataccctgagtcaacacattactcctgcaggtcttaggctacaatgcaggtcccttgagggccaccaacatggaggtaggcagtttctaggactgtccccagtacatctcaccacccacagccctttttttgccttgattcgagcctcaccctggccttttggcttcccctgcctgagagagacctgaggaggggacagagcccagcccctctcctgtggctgagcaggcctctgtgtccatgacacctgtcttccgggcctgggggctgtgggtgtatgtcctccctactggcttccccggcccctgctgcatgatgctcttggaactcttctccaaggagtcagtcccccaggcctatcaggggatccttttgtatctgcactttgggttttagtttcaaagctccatcaggtacagcttgcatttcaggatgtgtggaaagctcgggtgagggctgccctggttcatcatagctccaccttcctcggaaggagtgggctgttggagaccccccatccatggcacactagctcagcactgcatttcccgagatgattcccaagacagctggtgcctcctggctttcctgtgccaggccaaggggcaccacagaggaccctggatcctttgcctcttcttggttgaaggatctctatgtatgtgtgtatataaatatagttttttatctatatatataaaatagagatctattttttttctggaattctgttagaaaagtaaagaaaaagcaaatgctgttggtttatctcagggtgcccaaagtggttatagtcaatttttggtactaggaaaggcacccaatgcatttcctgacttttaagcatttccttgttggaagcagcagagggccaggccaagttgctgacagtgactttgcaggttgaataaagaaacccttggaggggaagcaggcttgtctgaagcagcatgtatattcactgggcatgtagctcccacaccagccttgagccaggccctggacaggaggggctgttgcaggatgagggaggccagagaaggcatcgaagccaagacctgggcccagctggggagggatgtgggaaaggaaggatgggagggaggaccctctgggaaaatgtggatttgagctggtgagagtgttgctaaggctgggctaaagcctggagagggtaggaggaggcaagaggggtccaggcagggctgatcctggcctctgacctgtccagggcgacccctgaagcccctgctgcctctgggcattgctgggagaggccaaggcaggactcacgtctgaacagagatcccctcgggcattgctgatgggccaccttcagctgcagggaagaagcctaggagaggaggcatgggagggacctgggccttgttcagattggccacctctgctgagaagtccataccagtacacccctaataagttatgccacataccaacgtactgtggatattataacctgcattaaaacaactctaaagaacgctgctcatttac

SEQ ID NO: 54 - DNA, 4946 bp, Homo sapiens
  ref <308>: DATABASE ACCESSION NUMBER: AB032969
  ref <309>: DATABASE ENTRY DATE: 2001-06-18
cagcctcagcccccagatgaagatggggatcacagtgacaaagaagatgaacagcctcaagtggtggttttaaaaaagggagacctgtcagttgaagaagtcatgaaaattaaagcagaaataaaggctgccaaagcagatgaagaaccaactccagccgatggaagaatcatatatcgaaaaccagtcaagcatccctcagatgaaaaatattcaggtttaacagcaagctcaaaaaagaagaagccaaatgaagatgaagtaaatcaggactcggtcaaaaagaactcacaaaaacaaattaaaaatagtagcctcctttcttttgacaacgaagatgaaaatgagtaagtgtaaatattttgaatttagtctactttgaaagtatatggagtgttcattaaaatcacattttttcctattataaagatactacaagttctttatagaaagtttaggaaatagagaaaaaaatttaataaactacatctattcatcaatacccctctgacttaaaatgccaactctatagaaattagctagtattaacattttgttatttcccttgtgtggttgtatatatatgtaaattatatttttaagcaaaatacattttttgtgtgtaaacaaaattttataaatacaactgtattgcaaatgttctttgtcctgcttctcacttgacattgcattatgagtattcttccaggtcagtaaatttcaaaaacctgacattaatagctacagataatttcataaacatctcattgtatctttttcattagcaatagctccactttgggtgggggagatgataatgtgccttgttaaaaatacctccccaactcctgctaagggtggccatgagactcagctctggcaagttaagaaatacaggtggaattctgcttgataaagctgctgggttttttgttacaaaaggacagacttggcaaacatgagcctttgctcttatcttttcatcctacttggagtgcagagataaaacctgagtaccagagccacttttaggcataaggaaggcagccatgtgctttgggtcatgttagtaaaaagactcagagcttggctccttgctgacatgcctggaggagctgctacaccagcttggattgctgacctctgacttcttggtagtgagaagaataaacactgtgcttaattaggccttggtcaggtttcttttatatgcagccaaatgcagtcctaagtaatacaataaataactggtcaaactgttactggtggagggtgtccaggttcttggcattttggacaaataattgaacaaaacgcacaaagcaatgaatatcctctagaggtttgccattggttacttggcgtacaccctgtgtaaatgaagtagtggcccgtgacctgtctgattggtgcagaaagtgaccaatcagaggctgaagtgaagttacaaagttatactcctgtgtaaatgaggacttggcctatgaccagtctgattggttgcaggaggggaccaatcagaggcactttcatttttcatctgcaatgcagaaaaggcaaggggattgcaaagggagtagcctctgatccttttgttacttaggtatggagaggtggggttttccttttgattcagttctaggaagtcaatgtgaatcagccttaggttccctgtctccagaccctattctcctgcctcattttccccctgagagacgtgatcctcgtaaatctttatgggaggctgagagactgagggtctttcttctgtaactgcttcatgctaacttgggacacagtccctacctattggagatcacgtaactctcaccctgctttgtctaggggagacagggtagcttcttgatggccggtggtgtcttctcctgaaactggctagaaatcttgtcacatgatcatctaacttggtggtctctaggcaaaaggaaatggatttggttaaaagatttaacagatatggtccaaaaaccaaggcaaatataatcattaataatgggctggccaagggagggagccatgaaacccaacttagtgccctttaggtgccccagctgttgtcatattttagaggcccagtcagctagttttcaggtggtgtcccttactaatcctgattggttgacatcaaaacagcattcttcttctaggaaaatacataagccacctgtttcagcagttaggagatctagtccccttcgattttgcaaagcgaccactgccaaggagcctatccgaatttgtaaggtgacaatactttgagcaatgttatccaggctttccataaaatccttggacaagcgttggtaataggatagggaagttgcaatcccgctaactcccattcctacctctgctgttattcctagccgttgtgtctggtggttgcagttaaaggtataatgagggattggttgttgggagctatattaatttagggacatacaatatttctgtctccagtctaccacttccaccaaagacaaatcacagcagaaccgacctaacttcaaaataaactgcagtcccatatactgggcctgattacccacacaaagtgcaacaagaatcattgtccatatagactctcctagattggctttgctagaacatttcacaaggccatttcagtcaaagtcctgagaaagtaaccggtttcaattgtgccctattacaaaagaaaacgtggttattaactttatacagacaaatgccatgaattaagaatattcataaatagtttacaaattctggagaaattagaatactcaatacacttaaagtgtatttcaaggctataaatagctcaaaataaaaagattattcagactctgaaaaaacaaaaagaagtagcaatatttcaaacaacaaaagccatacaaattatttcagtcttccattagttcatttcagtccatgtaatcaactcctgctctacttcatattcatctttatgaacacatcagcctttcaattagtgccttggaagttttctgtctaatccaatggcacactctccaaagttaccagaaacctgcattcaagagttcttttcatgaactccaaagaagtaagccttggactgtagctgattataagtcactttttttttttgagaaggatcaaagcaaaacatcaattatggatgacaaaagtcttaagacagccataaagacacagttgacaaatgtggctatttctgtggcttacaacaatttaacataatcattacaacatatattaagacatatcagaattttagaactctcatacaatcctggaacacatattaacaacaaatctctatcagtataacccaaaggaagctaaacaccacctcacacttgacaatgtttcctgtataattcaaacattacaaataagcctaatataagcctaatatgtcactcttgaacttcaggaagcctaatatccaaaaagttagtttaaggtcaaaagtttttgaattaacttttttccattagtatggtcatatctttcttactaatttgtaagttatgtaatttatcaatttttttttgttgttctgtttcccaacctctatgtcagataaagaatcacccaggccagacacagtggctcatgcttgtggtcccagcactttgggaagccaaggtgggagaattgcttgaagccaggaatctgagcccagcctgggcgacaaagcaatacccctatctctacaaaaaataaaaaatagccaggtgtggcgacacacacctgtggtcccagctgctcgggaggctgagcgggaggatggcttgggcccaggggttcaacgctgcagtgagctgtgattgcgccactgcactccagcctgggcaacagagtaagaactgtctcaaaaaaaataaaaaatagaaataaattttaaaaaaagaattacccatattctctttgtttttgtttattcacattaacctttattctatctggaatttatttgagtatacttttttctcaaataatcaattgtcctagaaccatgtgtttctcatttatttgaaaggccatctagtgagagatttctccaaatgttggggtagggaagggaggggaagcactttaaagtctgagcctttagaggtgattcctcaagaccctgcttaatcctaacaattttcctcattagtaaaagtcagcccaaactgggggcttgttaagatccttaccagccacatccatctgaaattatgaatttcaaagtatcttacaaatttggtgccacattatcttttttaagtttgttttgttttgtttttttgagacagagtctcgctctgtcacccgggctggagtgcagtggcgcgatctcagctcactgcaagctccgcctcctgggttcacaccattctcttgcctcggcctcccaagtatctgggactgcagtcgcccgccaccacgcccggctaatttttttgtatttttaatagagacggggtttcactttgttagccaggatggtctcaatctcctgacctcatgatccacctgcctcggcctcccaaagtgctgggattacaggcaggagccaccgcgcctgggcctttttttaagttttaagtacctataaagaacactgaaaggtgatgtgtgtggatgagctaggaagacctgaaataggctctctctaaattaatcaaattaatcctgaagccattctgcaatactgtctttaatgtatactcacttgttatagaagccagggttttttcccctaatttgtatcattgctatatgtgttattgtaccaaactacactgttttaattgctgtaaattttaatatgtcttagtatctgggtgtgggaatcttgaaagcatggagtttgtgttattcaccactgtattctcaaatatcagaagagtatctggcctactaagtgcacaataaacatagttaaaatg

SEQ ID NO: 55 - DNA, 6496 bp, Homo sapiens
  ref <308>: DATABASE ACCESSION NUMBER: AB032973
  ref <309>: DATABASE ENTRY DATE: 2001-06-18
gtgggcgtggtgtgctatagagtgtactgctgctgctgcttggccaacgtttcactgcctggcatcgggggcaccattcctgagtccaaacctttcttctacgtgaacgtggctgacatcgagagcctggaggtagaggtgtcctatgtggcctgcaccacagagaagatattcgaggagaagcgggagctgtatgacgtctacgtggataaccagaatgtgaagacacaccacgaccacctgcagccgctgctgaagatcaacagtgctgacagggagaagtaccgccggctcaacgagcagaggcagatgctgttgtactcccaggaagtagaagaagactacaacccttgtgaagaggacctcttcgtgctgtttttcctagaacaaaacaaccggatatttcagactttgttggaggtgtctgccagtcaagacaaaactctgacagcagagcatgcccggggcatgggcctagacccccaaggagaccggagctttctcctggacctgctggaggcctatggcattgatgtcatgctggttatcgacaacccctgttgcccgtaggaggagccaacaggactgggagccgcttcacgtgggatgtcagcagcccggagttcaccccagggccccagagggcctcattttttattaagttgacacaaaggaatattgtttatactttccaacaaacataatttttgcaatttcctttctgcccttttccctagagataaggtgagatcaccttggttttgtgtcctgccatgttaggatattggaatctgccactttctcccagagctgctggtcctctgggcttggtcatgggagttgtatcactaggagtaggctgagctctggaaacattgggatggactgttcagaaagtctgtgtggtctttgtcccttgatgtatttgagaataagacaaccacctgtcccctgtggccttagatgttcatctgcctaaaggcagaaactagaccagatgatcttttaaggtttttagtagttctaggagtctatagtcttgggatcaaatcccttttcttgttcattagggcaactttatgtcttctctgtttacttgagtagggaccacaaagagggaaaaaaggatgtttctgacaccaaatatgagcttatcttatggtcagaatgaaagaggttgcttatcagtgagctgaaaactaaaattatagaatgaagcctggaaaccttcctcaaagtaacttgatggtggccatgcaatgtaatgttcctctttgtctgaaccttcctcttcttgggatgaattggtgaattgctaagggccaatgctggccttggagcttgcaagcaaattaattttccagtttagtctcttaagggttcaataatgctcttggagtaagttgggtatttttaaaggctgaagtttggactaccggaggatagagcaattgaagttcgagcaggatggagaagccactctaagtctcttcatctggacacgaattctctggaggcattagcagcagcacctctgggtcaacacagatttactggattccaaaatctagcaaggatctgagctggttaactcagagggtggagcatgatgctaacaagacggtttatcattttggacccctcacaaacacacttctctttagcagaggtgacattccttaggctaaataattggatccagggacataacagatttgttgagagaaaatgtggcagtgccttcacccgggacagtggtcaggaagccctgagcatccctgatggatttatccatcctcttctgaagtgctctgctctaggctgggtcctgttgccacctgcctgttctctggttggcttttgcaggagggcagcttacgtgtttgtcaaccagttagaaagccagttcctgtgggtcgagtttaggcctttttggccatagttgagaattttgacttgggatactgggttgttggtgacaaataatgtcttccttttcccccttcccgcctggctcggttatgggaatagccgtcagtgcatccatgtctgtgaccaacacccagccagactaatgtacacagcagggagaaataacattcaaatggtggttcacacatctcatctcaagataagattcttagggttcactgctttattcaaaagtgttttcactgtagctccttcatatggaatatcaaaactgaagaaattcacatgtggaaatgcaaatagacattgattaatcaaggtagcatctttatgtaaatatataaataagtttgggcattgaaatgtaaactgtacagctaatagacttttctcctctgcaatgtgggttgctgtcatttcagtaatgtgtatgtttacaaaagaaaaaaaaatctgtgtttcgaggttgaagcctcaccttttattctcctttacatgcaaccctctcttcttgcctctcaagggttgaggggtcctttctgtcaagtaatggttatttttcgtggtatcctgaggttcagggtgttttaagctgggggtaggtggttagaggcaggagtagaagtgaaaggaaaggtctgattctcctagaggacacaagaagacctcctttttctggaattagggaatctgccggaaggagctgtttgaggcatttctgctctgagccttctatatgcaaacactgcagttttaactgcaagctcagaagtgctggtgtaaacatagcagggtgagaatgaagttcctgttttttcctttgaatggtgagtcagggcttctgggttcccttaactttgtgcttgtctcggtagctttctgtctcacatctccacgtgtccaccctcctgctcatgcagagggccagggtatgggtggccccagaggagaacgtgccagtgaggcagtgccatgtttcaggtcataggggccttgggctcagctgaccccaatgcagaacttctccctttaagagagattccaataaattggtccttccctaccttgccagcttcttcataggaccagaaatcttgtgcagagcctctgcttggctgaacagcgtgtgctttatctcttcagttacctttgccactgttgagcatcctcagagtatgtcttgcctgggctatgaagtggagcctgtggcttcggaaatcacctttcgaagccttgctctatgccagattctgctccccaacatgacagattaacaggcacaacctaggatcctttgctaccagttctctactagggaattccacagtggcagcagaagctaggagccatgtggacctgcttttctgccagtcttgaaatattttctgagaaaccatctgcttttgttcagaagaaagtgctgaacatcgttcacagacttctaggtctgtaagctctttaggggcgggcattatgatgaccaccggcctcctggaggagggttggatacctgtggtgtgacaccttctgccaccatctcctgccgggcctcagccctcgcctgcctgagcaggcctagttctcctgtgaagctgtcagcctgatctcatgccacactgtgaaatgaactatgtgccagtttggaaatgattgctgacctgagatgctggctgggctgccctgttgttcctgaataagtcagaagaagttccaggtgggagtggaattcaggtttggggctcgttggtatccatgcaaaatatgacaaaggcctgttcaagagggcattttcaattctgtaggctcagcagatgatactgcccagcctttgggaaaatgtccagttggcccctggcttaggactctccacaaggagtttgaaatggtagggcttatcccctaccagactaaaagtatggcccaaattatgtgtttagaatttgcttggcctttaaacacgaaccattccctatgcctggtagagaccattccagtatcagtgtcccacctgggacctgtacagtcctcagtaaattatgattgcaatgaattagaaggcttttgccttccatatccatcatccattatagcatctgtgcttccacctggttagggggagggaagctgaaatcattgatgtatcaatagaagtaatttagcttaggaacttgcatctataacttaccttgttttgttccactttaaagtcaagacaagaaagttaagatagcacacaggtgcacatgcttccagatgccacatgtgaacatttgttgatcatgtgactaccgatgacactttagctagaagataaattaaatcttagctaaatcattgtttttccttctggtggctatgaggatgaatttgctctcagtcttgatgcactgaaagcccttcaaacacagtaaaagatgaaatcactcatctttaaactgaggccttcagggaagcttttgtaaaggacagtaatgaattaggctttcagttttaggacatcaaccctccgagaaaaggcagaaacccgagggaccatttatttcccttcgaaactgtatagcccagggaatggattgagatgctttctccagaccctgtataggtcaaccttgcagaggtaaaggaggaggggcaggtggatgaataaaataggataatgctcagcttggcagtggacttgccttagtgtgatgacaggtctaacatgggcaagacaattagaatggggaccaatatgccaggcatgggcttttatctccctagtagatcccaagctagtaggcttggattctgccaaatggccagccctcctgtcttctccccgtaccttgtagttagaccgaggtgagaatcctgctgaccccagtcccatcccctctcatttcaggaaaacccttttgtgattcaggtagggggagaggaggagttaagggctccgtttactcccaagtcatggatttttaatattccatttttatcactaatatacctctcttcctagaagctactggagtattgagtgttgtgggaaaaggctaactgtgaattaagttaatgtttttcttataagaaatggaagtttatttttttattgatattactatgtgatgaactgagtatgcatatactgaaatggaaggaaattttaaaactattattctagaagaaatgggcagttttgtaatttggtggtggctgagaccccatagaagttttactatgtaaataatttggagagtgaataaggagattgtgctatgaaatcctgacagcgctctttaggaggcagacttgacagtcctaggaaggttgacataaaaataccaaccttcagtaaagctctagtacaaaaaagggtaaatgtcatcattcttatttttaggcctctttcttgagagaggtgggagtgggaggtagtgttataactggcactttaatttgtttttggaactagaatttaggggcagttggatgaaattgcaaatttagaaggggaataagaattttctagtgctatataaagaaatgatgatggagacaaaagccttgctttcctctttttagaatttattttcgatttttagcatactgtggggcttttagagctaatatgatctaaattcagaaaatttaattttcatagtaggccaggtgtgaattacttatgtttgctatagaatgcttatttagactaacaataaatttactttgctttctaaggccagtcagcgaatgtggggatgaggcaggatgttttaaatgagccagagatgatccacaaagtgaacagtcgacacagaggtctttgagttggatggttgcaaatatattgacattagagtgaaaactccttcctttgggtaaactaaagaaagataaagtatactaaaaaattttaagatggtgttatacaaaaaaaagtttgggtctaacgtgtccacaaagactgtcaagtgaagaatggtggagattcttggtgtttgagcagccaacctggatgagtgacttcagggacagagcagaggaaagcaaaatgaatttcctttatttacccaaaacttgttgactgaatttttgtataggtccgggaaaataagcctaaacaaatagttgtagccttagaaaaactgttttcccatttctttctgagttagaatcagcatagcctccctgtcgccttaaatgtaaaaatcctattttgattaataccccagcctaagagttatagcaatacgagagactgaatctatttttgtttcgggtctttacctcatagtatgaaattagtaagacactgcatagattttgccctgaatactggtgtgcccaggtatgccgtgctctctctctgtttccagtggtggtaattttaaggcctaaagaaagctggggttaatcctgaagctaaaagtaaatgtttcttgaattgattttgttctgtggtacaaataacatctatgaatatcatatctgtatatatctgaaccaagttgtgtgcagagaggttgatataactatatttacagaaaatgatttttacaattaaagttcacattttaacatg

SEQ ID NO: 56 - DNA, 6083 bp, Homo sapiens
  ref <308>: DATABASE ACCESSION NUMBER: AB032977
  ref <309>: DATABASE ENTRY DATE: 2001-06-18
cataaatgtccctatattataggtaccaccaatcagcctgtaaaaatgacacccaaccatggcttgcacttgagcttcaggatgttgaccttctccaacaacgtggagccagccaatggcttcctggttcgttacctgaggaggaagctggtagagtcagacagcgacatcaatgccaacaaggaagagctgcttcgggtgctcgactgggtacccaagctgtggtatcatctccacaccttccttgagaagcacagcacctcagacttcctcatcggcccttgcttctttctgtcgtgtcccattggcattgaggacttccggacctggttcattgacctgtggaacaactctatcattccctatctacaggaaggagccaaggatgggataaaggtccatggacagaaagctgcttgggaggacccagtggaatgggcccgggacacacttccctggccatcagcccaacaagaccaatcaaagctgtaccacctgcccccacccaccgtgggccctcacagcattgcctcacctcccgaggataggacagtcaaagacagcaccccaagttctctggactcagatcctctgatggccatgctgctgaaacttcaagaagctgccaactacattgagtctccagatcgagaaaccatcctggaccccaaccttcaggcaacactttaagggttcggcaatcactgtcacccccggacagcagaacgctggcatcagctatcttagctcctcctctcccctctcctctttcagagcactggctctccagccccaggaggagaacaggagggaggaggagatgaaagaggagggacaggttcttggtgctgtacctttgagaacttcctaggaaggaatggtggggtggcgtttgggaacttgtgccccctaaacacatttactggcctcctctaatgactttggggaaaagatgattctgggtctttcccttgacttcttgtttcaattacaaactcctgggctttctggggaggggttcagaaaacatcaaaacactgcagcagttcctaaatgattctcacaagcaaccctgagagagacagtcttgtgagggagatctgggggaggcaggaagctcctcagattttctcacagacccttcccaattccatcaccactgccaacaactcctcccccagagatctggctggagcccagaaaaagaagcatgtggtttaaaaaatgtttaaatcaatctgtaaaaggtaaaaatgaaaaacaaaaacaagcaaacaaacaaaaaacaatggaaaagatgaagctggagagagaggaaccagttgccaaggtagagagctgcccgctcctgccctctggatgacataggggacatcaacaagacggctgccaacctgagaagtcaccaaaccacaaaaataaccttacagccttcagggaaagactaccagctctgtctttctaccctctaatttaacaatgcataagagtcaataaaccctacttttttatttttggtttttattttgttttcatttttttctcccatttgcctatttatttttttgtttcccttttttttttctttttccgtttttccatttcctcacatgtccacgagatgcttgggttgcttttccaggggctagtttggcttttccaagtgggttttctttggagaatctgatgccatgcaattggcatgacacctgccatgccactatctttggcatccatggggcttatatgagacatgaagcattggctcagaagtagagggagaagaggaacccagttcccttgacttcccttttgagagcacacgttctgctgggtagctcaattgccagcctctgtcatgagaaggtatagccccatcttgatagaagagttactccgagctttatcatggaccagaggaaaaccagaaaactgaaaacattcctctgtcttgtggccagtttggcctttcactgcactattctgatggtgcctgactgaatccaaatatcctagctggctcttactatttttcacaaatgagtattcacatataagagatgaacatccatgtgagatcatcccaatcagaatataagactcaaggagtttgacttggtggccaatacctgccttccaaagagatcctacctttgcagatttgctcctttcccattgccttgaaggtctggcaatccctgttctttcatttgacaagtacttactgagtactcactatatacaaatcattaggttaaaacagacacacacacacacacacacacacacacacacacacacacacacaagacctgggcccttaagtttacagtccagcaggaaatgttaacctccattcagctacgcccccttgttatctagaccttcgggatcatctaagaaatgtagctgaaacccaaggagccagctagaaagaagcttttgattagatgtacaatacattgggggcagaagatctgggatcaattaagatggagcctgaaggactatggaatcttgcttgtcaggaatgggcaagtctacttcctgccatttctgaaagccccgcgggaccagcttctaggctgagctgcctagtaggctgaagcttcaggactctgcaggtcaaggatatgtgatgagcaccggcctaagtgtttgctcttcagattcctaagtagcacaagactttatcagaatctataggcataccaacctggatcactcttccacccaaccgaggagtagatgcatctgaatcttcatatcggtatattaagtccaaaagatggtccgggctgcccctcacaaaagcttctgcatccacgtggtaagctcccatggatgacagggttctgtatgatggagactattattgctattgctgctaattccatgagctgtgaagatccctaaccaactcagctgtaacatatgcaattctgtggtgggaagaggctgtgtgtccaaggatggtgctgaaatcactgccttaaggtctctgctgtgcagaatgaggaggcccccgagctggctgttctaacttagaaggaagagaagactggatgggcctgcttgggatctaggcctcttctaaaccctatcctaagctccagttccatggcaaggctcagacttttaatgccatcttaatctgatggttgagcgcttcactctattttctggtgctgcccagccagtgccttctgccatggatgttactggctacttgagaaaaaggagaggggagaaccccttctttcattccaactgcctccgaccccaaagggattcttggctctctggtaaccatggataccaccatgaattttatttggatcctcagcaggttgattctggaggcctcatgctatgactttttatttctcttcctgggatccaccaccctctactctcagctgactgctgcatttaggccaggtctccaattgctttcctccagaaagtgtgttcccgtctagtgaggtagtattgaagcctcggctttccctctggagcctgggaccctgtttacagttgcacatctgggcccctcactgtggggattgatcattctcatgaaggaatcacagttatatggcaactgcagaaggctgagcctcctcatggtgctataaccccttgggacactcatccagacttctctgaagcagaaaacctgagctccccactcactgccctagaatttatggcaaggagcaaatctacagcattctctcccacctacgtcctgcttcttggttgagactactgggatccttcagaaaagaaacactgggtcccatagctaaattctcaaccgccaggcaccttcagaagaatccagcctaatactggaatttgtgctattatcttcctctccagccccccaactccatccctcaccacagttgtctaggaaatgacatgaattcaatatctaatgtcaaccaatggggagagccacaactccaggagaggttcctgagctgagtcccttaatttctggatgaagaagaccaacaagttttgtccaatgtatttgtttctcagaccttgcctaggcactaaaaataaaatactaggtcattggaggctaatgtgggacctgatgtctgcgtgtgtgtgtgtgtgtgtgtgtgtgtgtgtctccctctctcacacacacaagagcagtttgctgttgctgtttcctaccttctgaggcttcaaagtattttttaaaatctatgctttgtggcagctctacggtgcttatctctgtctttgtgtcaatccttaagtacccatgtctttttcatgtctaaccattgggaaggtagaggctggcagggaagacaaatctgctacaagtccatgggaagaccctacaatgaaatgttcattggttggtatactgttttagtcttgaattgccaactttccaactgatctatccatattccttaagtactaaagacaaaatagagggcttctttttctctcttaatgtcttgccttctggttttcctggtttgcaagactaagtgtacctaatctcaccatctcttcacttctagctctctgaaacaagggtcacactactcagagggataaccccttacagtggtctgaggagtaactatttcctaaagtattctaaaagagtaggaagagagaaatggtagcctgctgcttctcacagacacctcacatcctcacttgggatggcatccacatagaaaccctgcatttaggtaaaatttgcctgactgaaggggactcagtcctccaaatcaaggtcaagaagatatctgcatgagaccttaagaactctttattgccattatttggagagggcgggggaattatcctaatcacacatttaacacagggaataagtgctgaagtgacccagatcaccaagcgcagttcctcatcatactttatttttgctttccttattccttggcactgactaagctaaagttaagaagccgacttcataagccaacccctgtgatgggatggaaaaatgggcttttgcagagggtttattaatagagatggatatactactcacaagttctggctcatggctccactgagaaggccatagtaataaaatgatcttatgaacactgttccccaaaggccaaagcctgaagatattgccccttataatccaatcagccttatattttaataagtcctgaatcaacctgactacggatatatggggccaccagggtgcatgggtgcatgtctgctcagcctagccctggaagtgagcactgccggccacagatcctgggaaaggtggtagtaacccagaagatgtagccttgaagggaggatacctatcaaaatgccaaagctgcagggacacgaagacggttgaaaattcaacctatgtatactagatccttccagtttgatggtttggtcattcttcttcatgattataccatggagaattttctgtgacaagggtggtcatggaagtaagtgagtgatcccctggtttctcattccttaaagcagtggttcgcaaagtatggcacaagaccagcagcatcagcagcctttgggaacttgttagaaacgaaaattctcaatcccatcccagatctgctgaatcagaaactctaatgagaggacccggcaatccacgttttaataagccctcctggtgattctgatgcacactaaattcaactgttttaaagggaaagccctttatagtattggagttcccacactgagaggctttggggcccaaaataagaaggttctaggttgtcattcagactttaacattaatttcaaagtcacctttctcatgcttccttgtgtttctgtttttccatttatgattttaacaaagaaaggtatgtgtgcttttgggtggaagttaggagaatgtttgtgtctttcctagttgaatacaaccttcagagaaaaaccttatgccttggaaattactacctggcacacaaaggggcttcaacaaggaaaagcagttggaggtctcttccagattgctcttctgccgaattatttgtatctattccgagctgattatgtaataggatggaaaaagt

SEQ ID NO: 57 - DNA, 5224 bp, Homo sapiens
  ref <308>: DATABASE ACCESSION NUMBER: AB032988
  ref <309>: DATABASE ENTRY DATE: 2001-06-18
ggctcatagagctgaacagttgcaggatgcggaggaggaaaaagatgattcaaatgaagaagaaaacaaagacagccttgtagatgatgaagaagagaaagaagatcttggcgatgaggatgaagcagaggaagaagaggaggaggacaacttggctgctggtgtggatgaggagagaagtgaggccaatgatcaggggcccccaggagaggacggtgtgacccgggaggaagtagagcctgaggaggctgaagaaggcatctctgagcaaccctgcccagctgacacagaggtggtggaagactccttgaggcagcgtaaaagtcagcatgctgacaagggactgtagatttaatgatgcgttttcaagaatacacaccaaaacaatatgtcagcttccctttggcctgcagtttgtaccaaatccttaatttttcctgaatgagcaagcttctcttaaaagatgctctctagtcatttggtctcatggcagtaagcctcatgtatactaaggagagtcttccaggtgtgacaatcaggatatagaaaaacaaacgtagtgttgggatctgtttggagactgggatgggaacaagttcatttacttaggggtcagagagtctcgaccagaggaggccattcccagtcctaatcagcaccttccagagacaaggctgcaggccctgtgaaatgaaagccaagcaggagccttggctcctgagcatccccaaagtgtaacgtagaagccttgcatccttttcttgtgtaaagtatttatttttgtcaaattgcaggaaacatcaggcaccacagtgcatgaaaaatctttcacagctagaaattgaaagggccttgggtatagagagcagctcagaagtcatcccagccctctgaatctcctgtgctatgttttatttcttacctttaatttttccagcatttccaccatgggcattcaggctctccacactcttcactattatctcttggtcagaggactccaataacagccaggtttacatgaactgtgtttgttcattctgacctaaggggtttagataatcagtaaccataacccctgaagctgtgactgccaaacatctcaaatgaaatgttgtggccatcagagactcaaaaggaagtaaggattttacaagacagattaaaaaaaaatggttttgtccaaaatatagttgttgttgatttttttttaagttttctaagcaatatttttcaagccagaagtcctctaagtcttgccagtacaaggtagtcttgtgaagaaaagttgaatactgttttgttttcatctcaaggggttccctgggtcttgaactactttaataataactaaaaaaccacttctgattttccttcagtgatgtgcttttggtgaaagaattaatgaactccagtacctgaaagtgaaagatttgattttgtttccatcttctgtaatcttccaaagaattatatctttgtaaatctctcaatactcaacctactgtaagtacccagggaggctaatttccttaaaaaaaaaaaatctatccatctacttctctcttacctgatttatgtgttagaataaattcatgaaattcgattccaagcatacgaaagatgcctaaagttgattctatgctccttagatccagacagaataatgagtacaggtttatgaaattctaaaagtttctgtcgtctttaaaaaggaacgtgcagtatatttctatctggctgtttagataaccctttccttgtattaattgtgagcacggagctcactggtgggggaggttctgaaactctctgccctcctgtggttgaatgaagatgttgcaagacttgcacaaaggaggttattcttctgacagcatcaacttttagagatggttctttttcatctttccaattcagttacttgacagtctccttccccagtatgctgaagtttgttaagagtcaccagtaattgtgcttttcagacagtagtgcagcttcaaaatcgaggccatcactgggctgatgggctgggagaaccttgccatgtgcctgcctgtttcctgcccccttagtcactgcccatttcctgcccccttggtcgctgacacaccttcacccaaagtgccatggttctgatggtggcagttccatctccctgacatcaggaagcttttctcgatcagagcagagcggggcctgcctgccctcgtgtcactggatttctttctcttataatcagctgaaacagagttctcaaagaacagtaaactcaggttcagaggtattatggaataagaatggtttcatagtttggcttttctatataattcctccctctcaaactgaaatattcatttttttagtggagtatttgactagagagaaggtaaggcagaaatacagtctacactggcttttaaaaatgtaaagccaatttccaaccggaccccaaatagtacaggttgaacattccgttccaacaatccaaaaccccaaatgctccaaaatcttaaactttgagttccagcattccgtcagaagtggaaaattttacacctgacctcatttgacaggtggcagttacagtgcaatcaaaactttgttccatgcccaagattattaaaaatattggataaaattaccttcaagctatgttgtataaggtgtatataaaacaaatgaattttgtgtttagacttgggtctactcccaagatacctcattatatatatacaaaaatccccaaatccaaaaacatttgaaacacttctggtcccacacattttggataagggatatttgacctatatctaattatataataagaaaaatgtattttctttttttttttttttttgagatggagtttcactcttgttgtcgcccaggctgcaatggcacaatcttggcttactacaacctccgcctccctagttcaagggattctcctgcctcagcctcccaggtagctgggattacaggcatgtgccaccatgcctggctaattttgtatttttagtagagacggggtttcgccatgttggtcagactggtcttgaactcctgacctcaggtgatccgcccgcctcagcctcccaacgtgctgggattacaggtgtgagccaccgtacctggcagaaaatgtactttctttctcagaaatacttttaaaaaaaattgaagggtgaggagaaaaacatcttggagaagaggacccattaaaactttaaatatctgtgggaaccatttttcctgattttcccttttttaacatcatggcaaagatgggtttttttccaacaaaatttaatttaatatctttccacttgaagattttaggtttgttttcaatacttaatgaatataaaactaaaggagaaaagccaacctgaaataatttaaactttatatgaacatttcgataagagtttgtggattttttctgtagataatatatttgatccagaactcaagtgcatggaaacatgattttgatttttaaaatctaaaaaaaaaaaaaattaaaatcatgcttccctctattgcagtatcagttatttagtcacagaatggtattttatgtaaattaaaattaggtgaatgcaatgcaggtaactggttttggaatgggaatgtgcagtgctttatgtttggggagttggagcagggtatcttttcatcaattagaaggaaagtttgaaacttctgattacctttatgttggtttctcttattatttgtctcttgctagatctgctaaaccaacccagcttgctcagagatctcatattgaagcaacatacaggcaatccacatctttctttccctttgaagtatagtcattggatgggatgagggacagggcctgttgggttcacagggccttgcactgcatgggcacatacttaaaagctcttgtgcatggaatccctgtctgttagccacaggcctctttagctctatacattcaaaataactactgtagtagaaaatagataagcttcagctgagttggcttttgatagtggaaaaaaaacaaaatttgactttttatggccaaaattccttgttgacagctgtgatgttctaatatgatttgggaatatgtcagtctacagaacctgcatcctgtaaaaacacctttggggtagacgataaaagtcatttttaaggcaaatacttaccatgtgactttttattaccaaatgcatcagtagtggagctggtatgttgtttcataggatggaaacattagaagtccagagaaaaataaattttaaaaaaaggtggaaaagttacggcaaacctgagatttcagcataaaatctttagtatgaagtgagagaaagaagagggaggctggttctgttgctcgtatcaataggttatctgtgtccctcatcttggtgttacagtgttatttctgtcagtattatgaatatgtggttgacccatcctgtcaaatgtaccaacattttcgaaagaattcattcaaatctcttatgccaacagaaaagttccttcttgtttaatatctctttacctcagtcctacattttgattctctggaggagattttagcttgtcttaaaaagccaaatttggagtcatcaagcctgctgaacctgatggggcagctttttgaacagctttctggaagtaagaacttcagttgaaaagccctttgatcgcttcagcccgggacatgcccttcagatggcttattctcagtaaagctttatgtagactgtgacactgtatatgtgtgactcgtacaactttgacgtgtttctgaagtggtttaatcgtatttgttattagcttctttgtggaaatgcaatttttatactaaaaacattgcttatttgcaatgcaatatgttataaatttgttgtttatattactggtattagtcttagcctaatgaacctaattatttttctttctgtattctttgcttcctcaaatagcatctgcagcaattggaatgagaaatccagatatgtgtttcaagtagtacattgcctgaatcacaaatcacttgatcacagtattgtatataatccctgatcctatttgtttcattttattgtaaattcccatttgcatcaaaacctaatgatagtgattggtaagtaaaaacaaatggtgtattgcttttcatacaagtgttttcacaaaagccatttgcctaggcagcaaaaaatattaatttgtt

SEQ ID NO: 58 - DNA, 2432 bp, Homo sapiens
  ref <308>: DATABASE ACCESSION NUMBER: AB033007
  ref <309>: DATABASE ENTRY DATE: 2001-06-18
ggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagccaacgtacaccggggccattatctccatctgctgctgcctcttcatcctcttcctcttcctctcggagctcaccggatttataacgacagaagttgtgaacgagctctatgtcgatgacccagacaaggacagcggtggcaagatcgacgtcagtctgaacatcagtttacccaatctgcactgcgagttggttgggcttgacattcaggatgagatgggcaggcacgaagtgggccacatcgacaactccatgaagatcccgctgaacaatggggcaggctgccgcttcgaggggcagttcagcatcaacaaggtccccggcaacttccacgtgtccacacacagtgccacagcccagccacagaacccagacatgacgcatgtcatccacaagctctcctttggggacacgctacaggtccagaacatccacggagctttcaatgctctcgggggagcagacagactcacctccaaccccctggcctcccacgactacatcctgaagattgtgcccacggtttatgaggacaagagtggcaagcagcggtactcctaccagtacacggtggccaacaaggaatacgtcgcctacagccacacgggccgcatcatccctgcaatctggttccgctacgacctcagccccatcacggtcaagtacacagagagacggcagccgctgtacagattcatcaccacgatctgtgccatcattggcgggaccttcaccgtcgccggcatcctggactcatgcatcttcacagcctctgaggcctggaagaagatccagctgggcaagatgcattgacgccacacccagcctaatggccgaggaccctgggcatcgccagccttgcctccagtgccctgtctcctttggccctcaatctggtcccaaatctggctgtgtcccaaagggtgtgtgggaagtggggggaaagtagaggatggctcgatgttttgcagctacctcttttccccgtgtttctttttagacaaattacactgcctgaagttgcagttcccctttccctggggagccccaagaacagagtcaggcaaggggtggggagtccagggatcttggggacccctcctaggagagctgcagtctcttccctcaggggaacatcccagaatgcatatcgatcagctctcagccaggcttcgacaatctcgcagcccccactaggtggacacattaatgatttggtttctcccctgggcagccaacctgccccagaggcaccagacctgggctttcagctttgggaccaggctgcccaaaggtactcctttatacacccggcaccttccacgaaagatggtacttcccaagcaagcccctatgatttgtcactatagatggaaccctgacttctgccccatcccttcctgcccaacctagaacccaggcctcaagtctttaccccacccctttcttgttcttccaagaagcagatgcccagttgctcagcagcagcggtagagacttgaatctgcccaccagtcacaaggcgggtcacagattcctcttcctctcttctcctcgttcctctgaaccctccaccaatgtgcctcagcctgtgtgctgtgtggcaacagcattctggttcccactgccaagatctcccaccactctgctgggatctgcagtggcagggagtgggggttgtgtaaaggggaagtcatcttttgagatccagatagacatggtttgtgcacttacgtccagatgggaagcatccttcctgcaaccctaaaataatcatgcagcctctcagacggacgccatcggtcccaaggccttaggtggaggaagcaaagcaggccaggcctgtcctgtccgtggacctctaccttctggactccctacgggtgcagagcacttgggtttctctacagccatcgtggcccacttgacactgtgctcctccatcagctggtcacatgccaacacgttcccagcccctgaggcagctccagggtgccccacctgctcctgaggtgggtccctaccctgctgctcctcttcatcctttcccttttgtcctgaaagggaggagcaatggtccaggcattaattccacccagggaattttagctatgccctcatgtcccagggagagagccacacgcctgttttccatttatagcaagattgtttgcatacttttgtaatgaaggggagtgtccagtggaaggatttttaaaattatcttatggat

SEQ ID NO: 59 - DNA, 6447 bp, Homo sapiens
  ref <308>: DATABASE ACCESSION NUMBER: AB033034
  ref <309>: DATABASE ENTRY DATE: 2001-06-18
gaaaactcagactcaaagaattaaaggaaaacagaggaaaaatgcccagttaaaaaaaaaaaaatcatgtttctgttttttcctctagatcattttcatgaattgtataaagtgatccttctcccaaaccagactcactatattattccaaaaggtgaatgcctgccttatttcagctttgcagaagtagccaaaagaggagttgaaggtgcctatagtgacaatccaataattcgacatgcttctattgccaacaagtggaaaaccatccacctcataatgcacagtggaatgaatgccaccacaatacattttaatctcacgtttcaaaatacaaacgatgaagagttcaaaatgcagataacagtggaggtggacacaagggagggaccaaaactgaattctacagcccagaagggttacgaaaatttagttagtcccataacacttcttccagaggcggaaatcctttttgaggatattcccaaagaaaaacgcttcccgaagtttaagagacatgatgttaactcaacaaggagagcccaggaagaggtgaaaattcccctggtaaatatttcactccttccaaaagacgcccagttgagtctcaataccttggatttgcaactggaacatggagacatcactttgaaaggatacaatttgtccaagtcagccttgctgagatcatttctgatgaactcacagcatgctaaaataaaaaatcaagctataataacagatgaaacaaatgacagtttggtggctccacaggaaaaacaggttcataaaagcatcttgccaaacagcttaggagtgtctgaaagattgcagaggttgacttttcctgcagtgagtgtaaaagtgaatggtcatgaccagggtcagaatccacccctggacttggagaccacagcaagatttagagtggaaactcacacccaaaaaaccataggcggaaatgtgacaaaagaaaagcccccatctctgattgttccactggaaagccagatgacaaaagaaaagaaaatcacagggaaagaaaaagagaacagtagaatggaggaaaatgctgaaaatcacataggcgttactgaagtgttacttggaagaaagctgcagcattacacagatagttacttgggctttttgccatgggagaaaaaaaagtatttccaagatcttctcgacgaagaagagtcattgaagacacaattggcatacttcactgatagcaaaaatactgggaggcaactaaaagatacatttgcagattccctcagatatgtaaataaaattctaaatagcaagtttggattcacatcgcggaaagtccctgctcacatgcctcacatgattgaccggattgttatgcaagaactgcaagatatgttccctgaagaatttgacaagacgtcatttcacaaagtgcgccattctgaggatatgcagtttgccttctcttatttttattatctcatgagtgcagtgcagccactgaatatatctcaagtctttgatgaagttgatacagatcaatctggtgtcttgtctgacagagaaatccgaacactggctaccagaattcacgaactgccgttaagtttgcaggatttgacaggtctggaacacatgctaataaattgctcaaaaatgcttcctgctgatatcacgcagctaaataatattccaccaactcaggaatcctactatgatcccaacctgccaccggtcactaaaagtctagtaacaaactgtaaaccagtaactgacaaaatccacaaagcatataaggacaaaaacaaatataggtttgaaatcatgggagaagaagaaatcgcttttaaaatgattcgtaccaacgtttctcatgtggttggccagttggatgacataagaaaaaaccctaggatctcactctgttgtccaagctggaatgcagtaatgcaaacatggctcactgtagcctcgacctcgtgggctcaagcaatcctcccacctcagcctcctgactagtggaaccacagacatgagctgctgcacccagctaaaatggagtatttttaatttctgggtcttttaaatgcatttggaggtctttagttttacctcactgaaattaggattttaattataaataatcaaagatgtgaaccttacagacattttaaagccattatattttttctataaaccctgttctcgtttggaggagaaagaaattggaattttcaaaaaaaataaaaatacctttaacacctatttagtgtctttagtaatccagtaaaatacttgattttttactaaatgtttcccacaagccaagcaaaccataagctacaataataattacctagcgtacagccctctttgcatatgctgttccctccacttgaagtgtactgtttaatttcttaaaataactttagcttttaagaaccaattttgatgggagtacagacttcccccattttcttgatgagttctctccgtcatgtgtagtaataatgtgagaatttgcagtttttagttgtagcctatacttttaggtctttgtgccaatttgaaagttattgggttagagtattcatagacattttcatggtacttaaagggacaggggtttagtaaaaagacacatggcaagccaggctttttccacagtttgccaggcccagctgcctcttgtgtacctgaacagattttatcattaacccttgtttatgttgttttgttttatttcgacgaaggcttattttaagtcaggcatggaaaactagacttcagactgacttcagctttaaggacatgtttatcccgttaacagggagtctgggatagacaatctccaggctttgtttttctctgaatttcttagctctgcttgtgatggcttcatcatcaggccacagaccattaacacattctagaactttaacattggttaaataataccatctaatagcctgtcttcagcatttccccagttgcctccaaatgcccttcatagctgttctctgcctctgtttgtttttaatccaagatacactcaaggctcatatattaggttgacatagctctttagtatcctttaatttaaagcagtctccaggtttagagaaagatgaatgagctttcacatacccctcacttgtcttcttcagaagtgtaggctacaactaaaacttccttcttcagaaggaagacaagtgatttatatttatttacttccatttctatttgaccttgtttcatctaaacacacccactccaccactgctacctgattaatattaagtgaatctcaaacattgtatcattttagctccacgttttttgtatgtatctccaaaatataaagattcttaaaaatataaccacaataccattatcaccctaaaaaaatcaataatgattccttaatatgaccaactactttgtcaatgtacacctttcactcctcttaactttcataaagacttatgtgtttttttggtttttaagtttgttggtttgaagttaaatctatgggttttccctccatctctctttttttaaccgtataattttttgcatgtgtatatgaataaatctgattatagattctatagctatcttacactttgtccctctctgattgaatcctagttaacaagtttctatgtctcttgtatttcccataaattggtagttggatctgaaggctttatcaggtttgtttgatttttttttttttaattttggcgaatctacttcaaaagtattggcctacctacaagccactttaatgggcccttagtttagtgacctttgccttgaaaggaacttgaaacaagcaaggaagcaccactgtaatctgcttttttgccagaactgtagcatcttacagcttggttagagacatagtaagcagaaattatcaaattcatataatctgtagctataaggcactgtctctctctctcaattatttacatgatttttctttgtaatataactatcatttcagagaacttggttttgattttttttttttaatctttttgagacagagtctcgctttatcacccaggctggagtgcagtggtgcaatctaaagattgctgactgcaacctctgcctcccgagttcagcaattctagtgcctcagcctctcgagtagctgggattacaggcatgccaccacacccggctaatttttttgtatttttagtaaagacagggtttcaccatgttggctaggctggtctcaaatttttgacctcaagtaatcagcctaccttgatctcccaaagtgctgggattacaggcatgagccaccatgcatggccttcagagaacttggttttaggtacttacggattgtctttcttttttttcctcactgcagcctctccctcccaggttcaagcgattctcctacctcagcttcctgaagagctgggaccacaggaagtttgtttgcctgaatgacaacattgaccacaatcataaagatgctcagacagtgaaggctgttctcagggacttctatgaatccatgttccccataccttcccaatttgaactgccaagagagtatcgaaaccgtttccttcatatgcatgagctgcaggaatggagggcttatcgagacaaattgaagttttggacccattgtgtactagcaacattgattatgtttactatattctcattttttgctgagcagttaattgcacttaagcggaagatatttcccagaaggaggatacacaaagaagctagtcccaatcgaatcagagtatagaagatcttcatttgaaaaccatctacctcagcatttactgagcattttaaaactcagcttcacagagatgtctttgtgatgtgatgcttagcagtttggcccgaagaaggaaaatatccagtaccatgctgttttgtggcatgaatatagcccactgaccaggaattatttaaccaacccactgaaaacttgtgtgttgagcagctctgaactgattttacttttaaagaatttgctcatggacctgtcatcctttttataaaaaggctcactgacaagagacagctgttaatttcccacagcaatcattgcagactaactttattaggagaagcctatgccagctgggagtgattgctaagaggctccagtctttgcattccaaagccttttgctaaagttttgcactttttttttttcatttcccatttttaagtagttactaagttaactagttattcttgcttctgagtataacgaattgggatgtctaaacctatttttatagatgttatttaaataatgcagcaatatcacctcttattgacaatacctaaattatgagttttattaatatttaagactgtaaatggtcttaaaccactaactactgaagagctcaatgattgacatctgaaatgctttgtaattattgacttcagcccctaagaatgctatgatttcacgtgcaggtctaatttcaaagggctagagttagtactacttaccagatgtaattatgttttggaaatgtacatattcaaacagaagtgcctcattttagaaatgagtagtgctgatggcactggcacattacagtggtgtcttgtttaatactcattggtatattccagtagctatctctctcagttggtttttgatagaacagaggccagcaaactttctttgtaaaaggctggttagtaaattattgcaggccacctgtgtctttgtcatacattcttcttgctgttgtttagtttgttttttttcaaacaaccctctaaaaatgtaaaaaccatgtttagcttgcagctgtacaaaaactgcccaccagccagatgtgaccctcaggccatcatttgccaatcactgagaattagtttttgttgttgttgttgttgttgtttttgagacagagtctctctctgttgcccaggctggagtgcagtggcgcaatctcagctcactgcaacctccgcctcccgggttcaagcagttctgtctcagccttctgagtagctgggactacaggtgcatgccaccacaccctgctaatttttgtatttttagtagagacgggggttccaccatattggtcaggcttatcttgaactcctgacctcaggtgatccacctgcctctgcctcccaaagtgctgagattacaggcataagccagtgcacccagccgagaattagtatttttatgtatggttaaaccttggcgtctagccatattttatgtcataatacaatggatttgtgaagagcagattccatgagtaactctgacaggtattttagatcatgatctcaacaatattcttccaaaatggcatacatcttttgtacaaagaacttgaaatgtaaatactgtgtttgtgctgtaagagttgtgtatttcaaaaactgaaatctcataaaaagttaaatttt

SEQ ID NO: 60 - DNA, 6110 bp, Homo sapiens
  ref <308>: DATABASE ACCESSION NUMBER: AB033035
  ref <309>: DATABASE ENTRY DATE: 2001-06-18
ctatgatgtggtgcttgatgctatagacacaatgcagcgagtcgcctggcatatcaatgacatgaagcggaaacacgagcacgcggtccggttacaggagatacagagtttgctcactaactggaaggggccagacctgaccagctacggggaactggtgcttgagggaaccttccgcatccagcgagccaagaatgagcggacgctcttcctcttcgacaagctgctgctcatcacgaagaagagagatgacacgtttacatacaaagctcacatcctgtgtggcaacctcatgcttgtggaggtgattccaaaagagccgctcagcttcagcgtcttccactacaagaatcccaagctgcagcacacagtccaggccaaatcccagcaagacaaacgcctctgggttctgcacctaaagagactgattctggagaaccatgcagccaagattccagctaaggccaagcaagcaatccttgaaatggatgccattcatcatccaggcttctgttacagtcctgagggagggacgaaagcactgttcggctctaaagaaggttctgctccatatcggctgagaagaaaatctgaaccttcctcacggtcacataaagttttgaagaccagtgaaacagcacaagacatccaaaaggtttctagagaggaaggatctccccagctgtcttcagcaaggccgtctcctgcccagagaaatagtcagcctagcagttctaccatgatcagcgtgcttcgagcgggtggagctctcagaaacatctggaccgatcaccagatcaggcaagccttgtttcccagccgacggtccccgcaggagaatgaggatgatgaagatgattatcagatgttcgtgccgtcattttcctcctcagatctgaactctaccagactatgtgaagatagcacttctagtcgcccttgcagctggcatatgggacagatggagtccacagagacctccagctctggtcacaggattgtcaggcgggccagcagtgctggggagagcaacacatgccctcctgaaataggaactagtgacagaactagggaactgcagaacagccccaaaacagaagggcaggaggagatgactccctttgggtcatccatagagttgactattgatgacatagaccatgtctatgataacatcagttatgaggacttaaaactaatggttgctaagcgggaagaagctgaatccactccctctaaatcagccagggactccgttcgccccaagagcaccccagagttagccttcacaaagaggcaagctggccacagtaagggctctctttacgcacaaacagatggcaccctctcaggtggagaggcatccagccaaagcacgcatgaactccaagcggttgaggagaacatctatgacaccatagggctcccagatcctccgtcgctgggttttaagtgcagcagcctaaagcgtgcaaagcggagcacctttttgggtctggaggccgacttcgtgtgctgtgacagcctgaggccatttgtttcccaagacagcctccagctcagtgaggacgaagccccttaccatcaggccactcccgatcatggttatctgagtttgctgtatgactctcccagtggtaacttgtctatgcctcataagcctgtatctgataaactgtccgaagaagtagatgaaatctggaatgacctggaaaattacatcaagaaaaatgaagacaaggccagagaccgtctcctggcagcgtttcctgtgagcaaggatgatgtgccagacaggctgcacgcagagagcacccctgagctgagccgggacgtggggcgctctgtgtccacgctgtccctgcctgagagccaggctctcctcacgcccgtgaagagcagggctggcagagccagccgcgccaactgcccctttgaggaagacctgatttctaaagaaggctcctttatgagccttaaccggctttctctggctagtgaaatgcccctcatggacaatccctacgacctggccaacagtggcctgtctcaaacagacccagaaaaccctgacctggggatggaggccacagataagacaaaaagcagggtgtttatgatggctcggcagtacagtcagaagattaagaaggcgaatcaacttttaaaagtgaaaagtctggagctggagcagccgccggccagtcagcatcagaaatccatgcacaaagacctggctgccatcttggaagagaagaagcaaggagggcccgccattggtgccaggattgctgagtattcccagttgtatgaccagattgtattcagagagtctcccttgaaaattcagaaggatggctgggccagccctcaagaatcctccctcctgaggtctgtgtcaccttcccaggtccaccatggtagtggagactggcttctgcattcaacctatagtaatggagagttagcagatttctgtctcccaccagagcaagacttgaggtcaagatatcccacgtttgagatcaatacaaaaagtactcccaggcaattgtccgcagcttgctctgtgccttctcttcaaacctctgaccctctgccaggctctgtgcagagatgcagcgtggtagtaagtcagcccaacaaagagaactggtgtcaggaccatctttacaactccttgggtcggaaagggatcagcgctaaatctcagccttatcacaggtcccagtcatcttcctccgtcttgatcaacaaatcaatggattccatcaactaccctagtgatgtgggaaagcagcagctgctgtctttacacagaagttcaaggtgtgagagtcaccaggacttgctgccagatattgctgactcgcatcaacagggcactgaaaaactctcagatctcacactccaagactcacagaaagttgtggtggtcaatagaaatttacccttaaatgcccaaattgcaacacagaattatttttccaatttcaaagagactgatggagatgaagatgactatgtggaaatcaagtcagaagaagatgagtcggagttggagctatctcacaatcgtagaaggaaatctgactcaaagtttgtggatgctgacttttctgataatgtctgcagcggcaacacattgcattctttgaatagtccgcgcactccaaaaaagccggttaacagcaaacttggcctttcaccatatctgacaccatataatgattctgacaaactgaatgactatctttggagggggccatctcccaatcaacaaaatattgtccagtctctaagggaaaaatttcagtgtctcagttcaagcagctttgcttaaggttcttcataataactgcttgaatcaacttcttattttgctcataaaacgttacagatactgatgaggtgttttatgtataccagattaaaacaattttgtaagaaccagaggtgtaaaatatactttcttttacagcacaacttttggaaatggctgacgatgcagcccggattgtactgtagcacatgttggcatcaacagtatattttctcatgctgagtgtcttcatgtttcatgtaagtcaatcttacttgaaagtttttagacttttaacacgatggccataacctgacaatagtgcccacaccttaagaaatgcaataatcctttcctgttatccagaaggcccaggtagttttatcctgtgactcaaaggcagcaaggagactttttcacattttaaaaggcaacgaaagctgttgaaagaattatgcttatatctcacattttggttatatttgtggtaacaccttaggataacgtaagccagagatctgtaaattggactgcagtctgaggtgcccattttagggtttttgtgctagtattcttttatgtcattttgatgcagaaattgtgtgactgttgaaaattaaaatgtagcgggacccattttctgtacgcagaaccctttacctgtattcctggacaaggcctagagaacgagctgctcatcatgtttctaatataatttctggggtgaaatgaatgatttccttactggcttagagaaaaccaaggtcaataaaatgcagattgacttaactattagaaaagatgggatgacttctgggaaccacttaactcttcaaatgactgttgaaagagaaaaagcaaaactgaaatcccaccagaccattttgtgtgcctgtttctaatcgatacaaagttaagcatgagctaaaatcagacaaagcactttaaatttatcctttccagagcgctttgcacatgcaccctcctgagtttgggattctgccaaatgaccaacttgatcctggccctgaggagtcattggctgcaggaatagggcaagaatctatttcctaaactacacataacatgggagcctttttttcgttgttttcaggtatattaaagaatgaaatctttggttactaggtgctgactaataaataacaccttttatattctgaccatttgtcacatttcattgtgatactgtatactgatctaactccttatgaaaggcaacaaacaaaaataagacattgaataaaaagcaaaatcaaagaagctaaagagaaaaatgaaggcagatatattgcaactttataacatattctattttattgaagactgcaattaatgcagcaagaatgctttctcaagcggtggcctttgtattctcattttaatcaggtgtacattctatggcctctcccccatgctgttagtttctattttaaaagatacaataatatatgtagggaaaggggcctgggctcttcatttaaaggtaagcagtaatattgagtaagtgacataattctttttctctttgttaagtcctatgcctctttttcttaactgtaaaacatagaatatgagcgtttttatcttacaaataggtacctaaggcatgtgattttatttttaaataacaaaaaataacccaagtttcttgcttctccaaagtattcttctcatagcttataaaagaaagtccacattgaatagcatggtctgggaacattccttctttattgtgtttatttgaacatgatatgagtttccaagatgaaatgatcaaaaaagataagtaccacaagaaagtttttttgtttggttggtttttttgtttgtttgtttttttcttgagactgagtctctccctgttgcccaagttggagtgcaatcttggctcactgcagcctccacctccccggttccagcgattctcctgcctcagcctcttgaatagctgggattacaggcgcccgccaccacacctggctaatttttgtgttgttagtagaggcggggtttcatcatgttggccaggctggtctcgaactcctgatctcatgatccgtctgcctcggcctcccagagtgctgggattacaggcatgagccactgcgcccggccaagaaagtatgtttttagaggtgtgtgtaagtgcatttgtattacctatgaacaaaattacctgactcttgtcccaggaaagctgtttcgcattttcgctttttgattggtattatccagttctatgtagttcatattattgttctgtctgactctcagaaattacttcttcacgccagtgtcttgttgcatgactttgatgtcacctataggaatacacctcactgcacgtaagtgggtatcttactgtataaaaggtctacatggctttaggttttaggacaaatgtgtagatttatagaccatttctgttggccaggacacagattttgagagctgtgtgtatatatatataatcatgtttgtatttttttcctgaaagttatcaattgcttttgtttaaaacagtttgttttagaggtggggtggggatgtatataacgaggaaaagttatatgtactttaaagtatgtcaagttcttactagtttcctgtactgaaggttcaattttttttatataagtttacttttcacctgctctattctttgtggggaaaaaatgcatctagaaaaacatagtttaaatactgtatataagataatgaaagttagtaacgtccattatttaataaagtttgtaaagtacaaggt

SEQ ID NO: 61 - DNA, 5111 bp, Homo sapiens
  ref <308>: DATABASE ACCESSION NUMBER: AB033040
  ref <309>: DATABASE ENTRY DATE: 2001-06-18
cacacacacacggaccgcttactccgctctgcctgctcgctcccactgtccccaagcccgccccgcccgcggcaagtgcgtgcccaggcgcagccaccggcgagatcaggagcgcagcgcccgcagcctgagggaaccggcgcagggcagcagcggctgcagctggattcgcgcgccccagcgctcagtggcggcggccgggacaccctgggcagcaccccgcaccgcagcaccccagactacgagcaatcgtgcccgtccccgccggggctggagggcgcagggccgccaccctgcaagttcgtgggcccccggccacccttatgagagaaggcgaagccgggcgaaggagcaggacgctcggcagcaggactcctccgcaagccccgcgggccctctgttcccgcgccccccgggcgcccaagaagcaaaatgcaaccaccgcgctacagctgagaggggaaggggccagcgccatccgctcgcccggaatccggtccccgcggcggctgcgcgtcccggccgcggcccctccggcccgggagtgagcagcagcaggaggagaggcagcggcccggggttggccggggctggggaggagggacgggacggagggagggcgcgggggcggggagggggccccggcggataaagatggcaatgtctctcatccaagcgtgctgcagtctggctctctcaacatggctgctttccttttgtttcgtgcatctgctctgcctggactttaccgtggccgagaaggaggaatggtacaccgccttcgtgaacatcacctacgccgagcccgcgccggaccccggggccggggcggcgggcggcggcggcgcggagctgcacacggagaagacggagtgcgggcgctacggagagcactcgcccaagcaggacgcccgcggggaggtggtcatggccagctcggcccacgaccgcctggcctgcgaccccaacaccaagttcgccgccccgacccgcggcaagaactggatagccctcatccccaagggcaactgcacgtacagggataagatccggaacgcgttcctgcagaacgcctcagccgtggtcatcttcaacgtgggctccaacaccaacgagaccatcaccatgccccacgcgggtgtagaagacatcgtggccataatgattcctgagccaaaagggaaggagatagtaagcctgctggaaagaaacatcaccgtgacaatgtacatcaccatcggaacccggaacttgcagaaatatcgccgactgggggatgcagcaaagaaagccatcagcaaactccagatcaggaccatcaagaagggtgacaaggaaacagagtctgattttgacaactgtgcagtttgtattgaagggtacaagcccaatgacgttgtccggatcctgccctgccggcatcttttccacaagtcctgtgttgacccctggcttctagaccatcgtacctgtcccatgtgcaagatgaacattcttaaagccctagggatcccgcccaatgccgactgcatggacgacttgcccactgacttcgagggctctctgggaggtccacccaccaaccagatcacaggtgccagcgacacaacagtgaatgaaagttcagtcactttggaccctgctgtccggactgtgggagccttgcaggtggtccaggatacagaccccatcccccaggagggagacgtcatctttactactaacagtgagcaggagccagctgtaagcagtgattctgacatttccttgatcatggcaatggaggttggactgtctgatgtagaactttccactgaccaggactgtgaagaagtgaaatcttgaaacgacaaatccagaagcaaagagatagtaggacccaagggaaaggaagggaagagtgctccaagacttggaccaggcacacacacacctccagatcaccttggcaactccagggcgctccgttcaagaatgctgacgaaaagcaatatccaaagtcttgtcaatcaggatgcagtttctccatcggtatggcagtctgtggccttggcagctgggaagttgaaagctgatttccactcctatgtccatgtagacatacacttcagaagctcctaaaacagagactgaaaggccacctttaggatttcttagtttcatttcaattctttccatgtctcatcattcttgtttttggcatgttgtttgatttctttggcaatttttttaaagattatttgtagtttactttccatctattcctttgtttttcctttgatgcactccagcttttgtataggtttctgtttagaagcaccagttcctgctatgatcagtttgtattccatctctgagatatgtggtcttgacctcccagcatgaagtgtgcatggctttgagaagtgcctcagcaccctgaaatggactaaggccagctttcattaagaatctaagttcttctaagtgggccttagtgctccaagacttggaccaggcacacacacacctccagatcaccttggcaactccagggcgctccgttcaagaatgctgacgaaaagcaatatccaaagtcttgtcaatcaggatgcagtttctccatcggtatggcagtctgtggccttggcagctgggaagttgaaagctgatttccactcctatgtccatgtagacatacacttcagaagctcctaaaacagagactgaaaggccacctttaggatttcttagtttcatttcaattctttccatgtctcatcattcttgtttttggcatgttgtttgatttctttggcaatttttttaaagattatttgtagtttactttccatctattcctttgtttttcctttgatgcactccagcttttgtataggtttctgtttagaagcaccagttcctgctatgatcagtttgtattccatctctgagatatgtggtcttgacctcccagcatgaagtgtgcatggctttgagaagtgcctcagcaccctgaaatggactaaggccagctttcattaagaatctaagttcttctaagtgggcctttaaaaaccccagctgccagagaccccaacactaagccctaaatctgctgaggccactgctggttattttaagccacatcacacttgcttccacttgccgggcttgattaagggcccacgtgacatgagaagggagctctagggaagccgtttcattcttctgggtcttacagtctttggctgaaattctgaactcagaagtcccctccaaggcatccagtctttggtggttgtagggctggttttaaaaccagataccacattttcttcctattgaaaacaaaatgccagttgcattggtttcccctgggctagaacagtttttttcttacctctgtaagtgggttctgtaaaaaatggaggctttagagaaaagccaatcatttttaagtccaatggcaaacatagtgggggctgcagtagcacctagcttttaccttaatttcgacacacttctgttgaatctcaccagaccatgtgggaggatttaggtgaatccctagcagattgcttcccagggctccctgagtgtgtccagataccaagtgaggaatgaggtgtgatttgctgtatcatttgaaccaaaaagtatgcagcatgagaatttgctagatcgtttatcctgactgaaatagacaaagtaagagggaaaggaaaagaggtatcaagtaaatactgaaacccaatggtgtttttaaactgtttctgtttttattcatcttttgtaactatgacagaaatgtgctattttttcagtgggcaattttgtaatatattcagactatccagatacagagatgactaaggtcattgatagcgtctctgaacaatcagacggatcaccttatctctacacagctggcaaacaccaggctgcggcttggattaaccaggaaagaaagcttttctcactgagttgtttttatgtattgatggggacttttccacctcattagactaatactcattcaaaaagagtttggttctgctgtaaatccttgccgcctgctgaaacatggtgtgcaggtcaacggagaatactagctgctcctttttcaccacctttaccaatttcctatttgatggtttgtaagtagacagtaaggcaaggcagatgattattaccctcagaaaggttgcatctccctaggagtccaatgcttcctgtaatgaaatccactctctatgtgtgggaaaagaggcagggaggaatgaagagagctctgaatcgagaatcctagatgaaccacacgctttactaagcctcggcttcttcatctataatgtgaagggtttaataacatgagtccccaagctcctctggctgtgggaccacagatgagtctttcagaggcaggatccatttttgcagatagctatgacttgtggcaatcaggcttcgtagcttggggaggtagagttacttgacatgtatcatgtaataacagcctttgagacttggcacaactatggtgctgagaatgaaaatctaaatgattgaagttttaagtccaagtaggagttggtttgttttgccttgtttaaaaattgctgttagtcacagagtttgcaatctctggataccttcaaatcctagctctcactgtgggattcttgatctcagaggtgtttatttttcacagtcagcataggcttgcgccactgactcctccttcagtcggctttgcccaaaacaaattttagtattactggtattaagtttagtccagtggaattagaaggataattcaatagcaacagaaatataaattatattccattcccagagagagaatgcgctttggattgtttagtcctctgattaacgagtattttctcttcctgccaagaactaggtgaatcaggaattgattgcatatgcaagccctggccacagctgcacttacaggatgcctcatagacgatgaggggtctgaaaggccaacccgaggctggcagatctgaccccaaggaggtcctgctgcaaaccccctgagcctttgccattcactacttaccaaagtttgtttctggaggattttcctgtagctttgatagttt

SEQ ID NO: 62 - DNA, 5380 bp, Homo sapiens
  ref <308>: DATABASE ACCESSION NUMBER: AB033043
  ref <309>: DATABASE ENTRY DATE: 2001-06-18
taatttttttttttccaaagagatgggatcttgctacattgcccaggtgggtctcgaactcctggcctcaagcaatcctcttgccatggcctcccaaagcactgggattacaggcataagccattgcacccagcccttgaatttttgaaaattaggctctttaacacctgcttggacttcaaagaacgaaggtgagtacttacacaataaccaaacagtgcattccttggaaattccaaacctagatctcttgttacatgcttgccaagcttgtcctgaacgttcctaagtgcagcaggaaagaagtggctcagcttgtgctgtgtgtcccctgagtcttgacctgtgactaataactgtttcctttgtgtgcaggggttctctatctccagtatggagatgaaaccaagcagctcaggatgccgaatgaaatcacaagtgcagacacaatccgtgctctcttcgtaagtgcctttccacagcagctcaccatgaaaatgctggaatcgcccagtgtcgccatttacatcaaagatgaaagcagaaatgtctattatgaattaaatgatgtaaggaacattcaagacagatcactcctcaaagtgtacaacaaggatcctgcacatgcgtttaatcacacaccaaaaactatgaatggagacatgaggatgcagagagaacttgtttatgcaagaggagatggccctggggcccctcgccccggatctactgctcatccaccccatgcgattccaaattccccaccgtctactccagtgccccattccatgcccccctccccgtccagaattccttatgggggcacccgctccatggttgttcctggcaatgccaccatccccagggacagaatctccagcctgccagtctccagacccatctctccaagcccaagcgccattttagaaagaagagatgtcaagcctgatgaagacatgagtggcaaaaacattgcaatgtacagaaatgagggtttctatgctgatccttacctttatcacgagggacggatgagcatagcctcatcccatggtggacacccactggatgtccccgaccacatcattgcatatcaccgcaccgccatccggtcagcgagtgcttattgtaacccctcaatgcaagcggaaatgcatatggaacaatcactgtacagacagaaatcaaggaaatatccggatagccatttgcctacactgggctccaaaacaccccctgcctctcctcacagagtcagtgacctgaggatgatagacatgcacgctcactataatgcccacggcccccctcacaccatgcagccagaccgggcctctccgagccgccaggcctttaaaaaggagccaggcaccttggtgtatatagaaaagccacggagcgctgcaggattatccagccttgtagacctcggccctcctctaatggagaagcaagtttttgcctacagcacggcgacaatacccaaagacagagagaccagagagaggatgcaagccatggagaaacagattgccagtttaactggccttgttcagtctgcgctttttaaagggcccattacaagttatagcaaagatgcgtctagcgagaaaatgatgaaaaccacagccaacaggaaccacacagatagtgcaggaacgccccatgtgtctggtgggaagatgctcagtgctctggagtccacggtgcctcccagccagcctccacctgtgggcacctcagccatccacatgagcctgcttgagatgaggcggagcgtggcggaactcaggctccagctccagcagatgcggcagctccagctgcagaaccaggagttgctgagggcaatgatgaagaaggccgagctggaaatcagtggcaaagtgatggaaacaatgaagagactggaggatcccgtgcagcgacagcgcgtcctagtggagcaagagagacaaaaatatcttcatgaggaagagaagatcgtcaagaagttgtgcgagttggaagactttgttgaagacttgaagaaggactccacggcagccagccgattggttactctgaaagacgtggaagacggggctttcctcctgcgtcaagtgggagaggctgtagctaccctgaaaggagaatttccaaccttacaaaacaagatgcgagccatcctgcgcatagaagtggaggccgtgcggtttctgaaggaggagccacacaagctggacagtctcctgaagcgtgtgcgcagcatgacagacgtcctgaccatgctgcggagacatgtcactgatgggctcctgaaaggcacggacgcagcccaagccgcacagtacatggctatggaaaaggccacagccgcagaagtcctgaagagtcaggaggaggcagcccacacctccggccagcccttccacagcacaggtgcccctggcgatgcgaagtcggaagtggtgcctttgtccggcatgatggttcgccacgcgcagagctcccctgtggtcatccagccctcccagcactccgtggccctgctgaaccctgctcagaacttgcctcacgtggccagctccccagccgtcccccaggaagcaacctccactctgcagatgtcgcaggctccgcagtccccacagatacccatgaatgggtctgccatgcagagcttgttcattgaagaaatccacagtgtgagtgccaagaacagggcagtgtctatcgagaaagcagaaaagaaatgggaggaaaaaaggcaaaatctggatcactataatgggaaagagtttgagaagctcctagaagaagctcaggccaatatcatgaagtcaataccaaatctggagatgccgccagccacaggcccactgccaaggggagatgccccagtggacaaggtggaactttcagaagattctccaaattcggaacaggacttggaaaagctggggggaaagtcgccccctcctcctccgccacctcctcgtcgaagctacctgccaggatcgggactcaccaccacgaggtcaggcgatgtggtctacaccggcagaaaggagaacatcaccgctaaggcaagcagtgaagatgctggaccaagcccacagaccagagctacaaaatatccagcagaggagcctgcttcagcctggaccccatccccaccgcctgtcaccacctcctcctcaaaggatgaggaggaagaagaagaagaaggagacaaaataatggcagaactccagggctccagcggggccccacagacgagcaggatgcctgtccccatgagtgccaagaacagacccggaaccctggacaaacccggcaagcagtccaaactgcaggatccccgccaatatcgtcaggctaatggaagtgctaagaaatctggtggggactttaagcctacttccccctccttacctgcttctaagattccagccctttctcccagctctgggaaaagcagttctctgccctcttctagtggtgacagctctaacctccctaatccacctgctactaaaccatcgattgcttctaaccctctcagcccccaaacaggaccacctgctcactctgcctccctcatcccttctgtctctaatggctctttgaagtttcagagcctcactcatacaggtaaaggtcaccatctttcattctcaccgcagagtcaaaatggccgagcaccccctcctttgtcattttcctcctcccctccttctcctgcctcctccgtctcactgaatcaaggtgccaagggcaccaggaccatccatactcccagcctcaccagctacaaggcacagaatggaagttcaagcaaagccaccccatccacagcaaaagaaacctcttaaaggtcaaatcctattaggcacaagtcggagttacatttaaaaaaaattaacagtctacaacaactgttttcacaagagaatgtaacatattgctgtatcgtttgaggcttaatgctaaatatgtgctaaatactggattaatagatttcagtaaagctcgttcgttttgtttggttttctttttacctagttgctatagtgtctacagtctatactcaatacctataaaatgcagtaagcatgtgttacagaaagaggttctggtgggagagaaaggtgcgtgtgagacaggagaattgtcttaagcatataaaacatgtatgattccagaattttagtatgttttgtataaaactatttttcattacggagactagaagtgaacagagaattacacaagtgtgactatacaaattgtaaaacagatactataatatttccttttattttagtgttatttagctttattacagatttctatttttgtcaaaacttcatggttcctttcaagatcttttttgccaaaacattttgatactatagcattgtacatttgaaagtagtgttctagactataaaaccaatgaacttctacatgagccctacagacaggcatgtgtagaaggcaatttatcaaacctattgcactgccatgaaaagtgtgtataataatttgctagcccaagcaagctagttttctttgcttgcttcttttctttcttttttccttcctttttttttttttttttcttttttaacatgttgagattctctagttgttttctttggcgtatctaaccccttcttttgttttctgagacctggtaacccacgctcttgcattgtggattttaaaatgtatactctgtacggttctgtaaaccgaaaaacttttgtaaatataaatatacatagacataaaaatactgtatgtgacagcacatagagtagttttcccacaccaaagttaatttttatgcatgctttaaaagtatatatcgggaccggcagaaatggaagtatccatacatttttaaaaagcaacaagtttgcacagctagagtgtttttgtaaataaatgtatttgtataacacagtcatgtaatatacagaactataagcagagactttgcaaaactaaataaagggctgcatgcttattattttttgtaccttgtcactataactacttcctagtcaaagaacgaaatgtaactgttaccgagttaaatgtttttccgctttgagggatgtaaccacatccactcagaggacactacttttctgaaagctctggggtgactaatgatgagttcctaataaattaattgcaagtgtggtgccttggatgtggcctgttggctcgctttcttctctgtggcttatcaaggtgtagatgacagaaagcaaacctggatacagagtttccaccctcagttcctggaggggctcttattattttctctctttttaaaaaacttccagtagaagtaaagtggaaataaaatgtctttatcacttgg

SEQ ID NO: 63 - DNA, 5338 bp, Homo sapiens
  ref <308>: DATABASE ACCESSION NUMBER: AB033049
  ref <309>: DATABASE ENTRY DATE: 2001-06-18
tgaatttgctacaacatggcgctgaagtgaacaaagctgataatgaaggtagaactgctttgatagcagcagcatacatgggacatagagagattgtggaacacctactggaccatggagcagaagtaaatcatgaggatgttgatggcaggactgcactctctgtagctgcactttgtgtgcctgcaagtaaagggcacgcatcagttgttagccttttaattgatcgaggtgctgaagtagatcattgtgataaagatggcatgactccactgctggtagctgcctatgaaggacatgttgatgtggttgacttgcttctagaagggggagcagatgtagatcacacagataacaatggccgtacacccctcttagcagcagcgtctatgggtcatgcatcagttgtaaatacacttttgttttggggtgcagctgtggatagtattgatagtgaaggtaggacagtcctcagtatagcttcagcacaaggaaatgttgaggtggtacgtactctactggatagagggttagatgaaaatcacagagatgatgctggatggacacctttgcacatggcagcttttgaagggcacagattgatatgtgaagcacttattgaacaaggtgctagaacaaatgagattgacaatgatggacgaatccctttcatattagcttcacaagagggtcattatgattgtgttcaaatattactggaaaacaaatccaacattgatcaaagaggttatgatggaagaaatgcactgcgggttgctgcattagaagggcacagggacattgttgaattgctttttagccatggtgctgatgttaactgcaaagatgctgatggtcggcctacactttatatcttggccttagaaaatcagcttacaatggccgaatattttttagaaaatggtgcaaacgtagaagcaagtgatgctgaaggaaggacagcacttcatgtgtcttgttggcaaggccatatggaaatggtgcaggtcctgatagcataccatgctgacgtcaatgctgcagacaatgaaaagcgctctgctttgcagtctgcagcctggcagggccatgtaaaagtggttcagcttctgattgagcatggtgctgtagttgaccatacatgtaaccaaggtgcaactgcactctgtattgcagcccaggaagggcacattgatgttgttcaggtcttattagagcatggtgctgatccaaaccatgctgatcaatttggacgcactgctatgcgtgttgcagccaaaaatggacattctcagataattaaattattagaaaaatatggtgcatctagtttgaatggctgttccccatctcctgttcacacaatggagcaaaaacctctacagtcattgtcttcaaaagtgcagtcattaacaattaaatcaaatagctctggtagtactggtggaggggatatgcagccttcgttacgtggtttacctaatgggcctactcatgcttttagttctccttcagaatctccagattctacagttgaccggcagaagtcatcactgtcaaataattccctgaaaagctcaaaaaattcatctttgagaactacttcatctacagcaacggctcaaacagtgccaattgatagctttcataacttgtcatttacagaacaaattcagcagcattcattgccacgcagtagaagtcgacagtcaattgtttccccatcttccacaacacagtccttaggacagagtcataattcaccaagtagtgaatttgagtggagtcaagtaaagcccagtttgaagtcaactaaagcaagtaaaggggggaaatcagaaaattctgccaagtctggatcagctgggaaaaaagcgaaacaaagtaattcttcacagccaaaggttttagaatatgaaatgactcagtttgatagaagaggacctatagccaaatccgggactgctgcaccacctaaacaaatgccagcagaatctcaatgcaaaattatgataccttcagctcagcaggaaattggtcgatctcaacagcagtttcttattcaccaacaaagtggggaacagaagaagagaaatggaataatgacaaatccaaattatcatcttcagagcaaccaggtttttcttggtagggtttcagtcccacgaacaatgcaagatagagggcatcaggaagtgttggagggatacccttcctcagagacagaattaagccttaaacaagctctgaagcttcagattgaaggttctgaccctagcttcaactataaaaaggaaacaccattataaaagtttcctattctgtgaaacagaagacattgtgatggagtggttcttcagctactggatggaaacatatgcctgttgatttgctgaaaaaacaaaaaaaatgaagaatgtgatctctgcagtacagttaccttaattactgtaatgtgcctaaatagtaaggctgccttctcaatgtaaccctctgtgcttaaaaaatttcattttgtgtgctttgtattcactacacaggaataagcactttttaaaaatgcagatacatactgcagttccctgataaaagctgaaaagaaaatttgagtattttaagttaagatgtgataaaaaatgtgcatgtgccataatcaaatatatatgaaaaggcagtgttccttgtatttatttttttttctttttgtggcaaaagaaacttaaacatactgtttcagtcacattgcattgtagtgtatggcctgtttcttgtatctttaaagacgttgctcaataaaacaaatcttgcaactgttctatgttcactacaccttcagcattggataaaaatcattttctatataaatatcacattgaaatgaaaaaatgatttcttggcagtttaaaaaaaatattttatagtagtttagggagctgctttaagtagtttaaatctggattttcccagtagaattcttctcatctctggctaaacatgtcagaacaaacaaccaaccagtctgtaggcagaacaaagtcctatttcatccgctgggatacaatttcatcttccattcactttgtcattccacctctaagaagacagactatcattcctgaggcatgaaaattctcagggacaaagccatgcctcagtcacatgtgtgtgcagagagaaatgcacctgtctatctaagggtagatttttgatccctgaataattcattgactaaactgacctcttcctcctggctaaataaattaattttgctggcttctctctcagcggtttctattttgtaaattgctgcatgaccaaaatagccccactcaaaatcaattggattaattttaatggtttggttggatgaatattctggatgaatataaaatgtgctgcccttcacagatgacaccactcccctgtcaatcatagcacatgtgtactttttattgttacttaatagtgatggatttgcacttttctatcctcatactctttcctgttttcttctttgtacaattgcatgcaggagggctggatgccagggttaagagagaaattcatgacaaggaaggtaaaattggttcaaatgagcatgtgtcccacagccttagtctccttactcttaaatcagtggagctgtagcttagatgggtcgtttatatgtctggaaaagttgtcataacagtttagaagccaaggttgtggatttgatcttagaatgggcctgttaatcttatagaacccagaaattctgttcttttcatgtactgttgatgaggaatgaggaaagagaatttggagattcagcacaaaaccattgctacttctagaacaaaatctttagaatatgtcctaataacaaaggtcagtaatgtcatcttcatatatgaaggacacatgtgatacattgttcgtggaaatagaaatgtataattatgataaatgtttcacttgaatcttattgtaaggcttttcttgcttttattttttaaagtcagcaaaactcattttgtctgtcatctataagtcatagtgaggactacgagataagttgataagttcaattgatattaaggtgacatggcaatattaataactcaaatgtgaatgtttcaagtattgaattcttgtccctatgggacatttattaaataaaattaatgggactcttgcaaagtagccttaaaagtgttaatgagtctattaataaatatgaacacatactattattagaaccaactttactcatatctcaaatacagtacatttacattactgtagaggatgaagctctaatttctattacatgtaattttctttagaaagagaaccctgaaagctgccagtttttctattaactttgaattattgaaattgtatttatttaattttattgtttttacaaaattgcaccttgtgtccaaagggcgaagatatgacattgcataagggatttatgtttttcaaagagctaactgttttcatatccatactatatacacttgaagcaattggtaggaagagaacctattggaaaaatacgattttcaaaagtaagtattcctcgggatgtttttatataaattatgttttggaatagaacataaatgactttgagttaggataaggatgataggatgggtgctggagatgccctgccttgcttatttgtttctgtgggggatttaatactataaatgaaaatggcttctgctccattaaaaagtaaaaattgtcctccaaatataaaactccttaatagatatttttgaaattaaaatctttaaattttataaatcagctgttgccactacacaactatgatggcatgtgcttataacatttttataacattccgtctgtgtctattccctaaatatcatgagtttataataaggaaagtgataaaaatacagtaatgaaataaaaatctgaatgtttctaagaaaggttttggaaggaaaaatgacctgaaatcagtgcgtactgcaaagtacagccaataatttttgttctttgttttcacccccaccctcactggaattctcaccaaaaatagtttgatacttaaaaaacagaagtaaatacttttctcaatattgttttggctatgcaaatatttgttttgcttaatgtcctccatttacacttctcagcaaatgtagttgcaaacaaatgctttctttttatttttcccttggtttgaggtatgtaaatagccaaaaatgtacattgaatttcacattgtaaaagttttattttatcccttgtatgatattactcaaaaaatccctgtgtatatgaaagtgcataataaatatatttgctttac

SEQ ID NO: 64 - DNA, 5676 bp, Homo sapiens
  ref <308>: DATABASE ACCESSION NUMBER: AB033050
  ref <309>: DATABASE ENTRY DATE: 2001-06-18
agcccccaaccccccgaggccactcacctcccccaactacccaggacagaggatgcccagccagccgagctccgggcagtacccgccccccacggtcaacatggggcagtattacaagccagaacagtttaatggacaaaataacacgttctcgggaagcagctacagtaactacagccaagggaatgtcaacaggcctcccaggccggttcctgtggcaaattacccccactcacctgttccagggaaccccacaccccccatgacccctgggagcagcatccctccatacctgtcccccagccaagacgtcaaaccacccttcccgcctgacatcaagccaaatatgagcgctctgccaccacccccagccaaccacaatgacgagctgcggctcacattccctgtgcgggatggcgtggtgctggagcccttccgcctggagcacaacctggcggtcagcaaccatgtgttccacctgcggcccacggtccaccagacgctgatgtggaggtctgacctggagctgcagttcaagtgctaccaccacgaggaccggcagatgaacaccaactggcccgcctcggtgcaggtcagcgtgaacgccacgcccctcaccattgagcgcggcgacaacaagacctcccacaagcccctgcacctgaagcacgtgtgccagccgggccgcaacaccatccagatcaccgtcacggcctgctgctgctcccacctcttcgtgctgcagctggtacaccggccctccgtccgctctgtgctgcaaggactcctcaagaagcgcctcctgcccgcagagcactgtatcacgaaaatcaagcggaatttcagcagcgtggctgcctcctcgggcaacacgaccctcaacggggaggatggggtggagcagacggccatcaaggtgtctctgaagtgccccatcacattccggcgcatccagctgcctgctcgaggacacgattgcaagcatgtgcagtgctttgatctggagtcatacctgcagctgaattgcgagagagggacctggaggtgtcctgtgtgcaataaaaccgctctgctggagggcctggaggtggatcagtacatgtggggaatcctgaatgccatccaacactccgagtttgaagaggtcaccatcgatcccacgtgcagctggcggccggtgcccatcaagtcggacttacacatcaaggatgaccctgatggcatcccctccaagcggttcaagaccatgagtcccagccagatgatcatgcccaatgtcatggagatgatcgcagccctgggccccggcccgtccccctatcccctcccgcctcccccagggggcaccaactccaacgactacagcagccaaggcaacaactaccaaggccatggcaactttgacttcccccacgggaaccctggagggacatccatgaatgacttcatgcacgggcccccccagctctcccaccccccggacatgcccaacaacatggccgccctcgagaaacccctcagccaccccatgcaggaaactatgccacacgctggcagctctgaccagccccacccctccatacaacaaggtttgcacgtaccacaccccagcagccagtcagggcctccattacatcacagtggggctcctcctcctcctccttcccagcctccccggcagccgccacaggccgctcccagcagccatccacacagcgacctgacctttaacccctcctcagccttagagggtcaggccggagcgcagggagcgtccgacatgccggagccttcgctggatctccttcccgaactcacaaatcctgacgagctcctgtcttatctggacccccccgacctgccgagcaatagtaacgatgacctcctgtctctatttgagaacaactgagggccacccggtcggggccatccctccacactctgcatcctaccccacctacccaacacacttttccacctgggagcctgtgccctcagaccgccccgcaccagagccacgggctgtggggcggggagccctcccccgctgcagccctctcagaacagaggggtagggagggtgcaccagtgcaccaggaaggctgtgtgggtctggagcccacgtcccacctccacacccttggcttgggcccatgcccagcgcaggcctgaagaccaccctcccgagaggaaccagcccggtaagagggcacacgctgatgcggcttcccggtccctccgcgtgtgccgattccaaatgaccttccagtgtccccaaggttcttccatcttctagactgtaaccctgcctccctgcttcctggtccagagcctccctccagtgactgtggagcctgagaaggcccccgggccccagcatgggccccgagccttggaggagcactggcagttggtggcagtgagaccagcccacccaccaccacccaccacagaaaagcacaaacctctgggaaagacaacgtctctcgggggccaggggtcatcggtttgacccctgacctataagccaagataccccataaacacactcagaaagcagagaaaaaggacaagagtctgtgtttgagagggggtctgccattcctgcttggggactggtggggaagagggccaggacatcttctgagccaggacgtccctgaggctccacctccaagctcagacagggcccaggcttggggaacagagagagcaggtgtacacccaaccaaagtgattgtgcccttggttggggggcgcgggcatataacctgtcagaagcaaacaggagcggcaacttctaactttgctccaagccactctctttttaaacagcaacaatttaaagctatgaagtcacctggagaaaaggaacgttgctcttggacagcaagcaaaccatttctctccgtctgttctgtttttctcctagtccctctcctgccacctctccaagacttccgtgggacacccacttccctctgtcctagttctctttgtccaatcagatggcaagggcagtgcgtggaaaggccggggaggtgcagaaaccagagcccagggcaatggtgtctgtccagcccctccctctgtccctgtgctccaagctgcccccggctgcagcccaggccatggacatgtgcaccagtatgtacctgcaggcatcagggggaggggggcgtgtttctgggcctgccccagacactgcccttggctgccagcctaccctgcctgcactcctccaccatcacaatctcacccaaactcctgctcactcaagcaaaagcagcctctggccttccctccaccgctttgctccatctggcttaccactctccagggcctcctggggagcctgtcctgtgttcactttgtttcaggctggtctgtgccccgtgagccacatggcctagggtgatgccaggttgtcccgtcactggggtcccatctgtaaattctttgcgcccttcccggctgctgcctggggccctttcctgctctcccgtccgctgtgggtggtccccagcactcctctgtgggttttaccggaaaggtggccccagctgttgacttccagtcactgtcccagacggcacaaggttttctgtaggaaagctgccattgccccggccccttttcttcctttgtcccgttgtcgaggttttttcaaatagcgtgttgttcagtatgcaaatcaattattttaagaatcgcttttgtaaatatctttgtgaatattttagtatcgtctttgataatattcaacattttcatgacctggttatagcctttgctggtgtttttaaaatacctggactcaatgacaaagaccgagtcttcttttttttaaacaaaaacaaaaaaagcaaccagggctatttgtacagttgaaggggtgaacagaatgggcggctgtgctgggagttggaagaccgggcagcccgctatttagagccatccctcagtcagctggcagggacaagccaacgccaggtagcatgtggccacccttgcccagtgtctgtggcctggcaagtggccacgccctgtgtcagaccatctgggaattaagctccagacagacttacagatgccttccttaggagttcttgcttcttgcgttgatactttgccccagaaaggcctgggattcattctggttcttatcagggtgtgtccacactctgctcacaggtggatccacggctttccagtgcggagagtcgagatgctccctgcagcccaggccccgggcacctcctgcaaccatctctgggctcagcacctgaggcgggtttcctgggtcccctctccagcaagcctccaccagcaagctcggcccagagcttcccttccggctggctctgaaccgtgcgtggtgcctacagcctgcagtctggagacaagctcttccggagtgctctgggagccaggccagggtgtgagggaggtgcagaggcatccggggcgggagcaagccccaggttgtgacaggtgcaggtagacaacgcccataaacagagatggtcctgaactctggagagatccttccctgatcctttcggacgactacttggagccataagtaacctcagcaaaaacgaggcctctgcaagccacttttccatgccaagcatccacccggcccacaggcatgtttctgccgccactccgcaagatggacagggagccagcaggcaggcgggaagggccaagtacaggcaatcacccccatcttcttggtttgaagctttatccatgtatcatgttccgtgtagccattttattttttaagaaactgctaatactttctccctaatggaagccctgatcccccagagagctacaggtctgctcccgacgggcctcgggcctgacccgtccacacagggccgtgtcaacagcagcgactcaagggacgtgtgtacatatgtaaatgagaaatagagacgtgtcaacagatgcattcatttctcttggaatgtgtattgtttttattttgcgaaacaaaacaaaacaaaaaaaaaagcttggaactccatcacgtggaaaaactagatcctgttggttatagcatttgtgagttctccacgtctgtctctctcgctcatgtaatatactctgaccctgagtggaaaggggtttttgttctgtttttattttacctacatgtactatttagcttcagtgtactagtcctgccacctgtgtatttttagggtgctatggaaataatgaaaagaaacggggattttcagaagaaaattgtaaccaaattcatactttgtataatttttgatatcatgatcacaggtgattcacacgtacacacataaacacacccaccagtgcagcctgaagtaactcccacagaaaccatcatcgtctttgtacatcgtatgtacaatgcaatcatttcatactttaaactggtcaaaaaactaattgtgatttctagtcttgcaaagctgtatgtagttagatgatgtgacaacctctaatatttatctaataaatatgtattcagatgaaacctgtatattaggtgttcatgtggttattttgtatttaaagatcaaattatttgactattgctagacatttctatactctgttgtaacactgaggtatctcatttgcccatgttaatttttttctaaataaattgacaaaaac

SEQ ID NO: 65 - DNA, 5561 bp, Homo sapiens
  ref <308>: DATABASE ACCESSION NUMBER: AB033053
  ref <309>: DATABASE ENTRY DATE: 2001-06-18
atggaatcacagcggcagcggcggctgcggcgcgcgcgagccgagtgtgagcggaaaggggcccggcgtctgcctcgagactgaagaccgataaactcaagccatggagggattactgcattacatcaaccctgcacacgccatttctctcctaagtgccctgaatgaggagcgtctcaaaggacagctgtgtgatgtgctgctgattgttggagaccaaaagttccgagctcataaaaacgtcttggctgccagcagcgaatactttcagagtttattcacaaataaggaaaatgagtcacaaactgtatttcagcttgacttctgtgagccagatgcttttgataatgttttaaactacatttattcttcctctctatttgttgagaagagcagccttgctgctgtgcaagaacttggctatagtcttgggatttcctttctgactaacatcgtttctaaaacacctcaagccccctttccaacgtgtcctaatagaaaaaaagtgtttgtagaagatgatgaaaacagttctcaaaagagaagtgtcattgtttgtcaaagtagaaacgaagcacaaggaaaaactgttagtcaaaatcaacccgatgtaagccatacttcccggccctctcctagcattgcagtcaaggccaataccaataagccacatgtcccaaaaccaatagaaccacttcataatttgtcattaactgaaaagagttggccgaaagatagttctgtggtatatgcaaagtctcttgagcattctggatctttggatgatcctaatagaatcagtttggtgaaaagaaatgcagtgttgccttcaaagcctctgcaagacagagaagctatggatgataaaccaggtgtgagtggtcagcttccaaaaggaaaagctctagagctggctttgaagagaccacggccacctgttttgtctgtttgtagctcatcagagactccctatctattaaaagaaactaacaaaggaaatggtcaaggtgaagatagaaacttgttgtactattcaaagttaggcttagtgatcccatccagtggatctggttctggaaaccaaagcattgacaggagtggcccacttgttaagagtctcctcagacggtcattgtcgatggatagccaggttcctgtctattcaccttccatagatttgaaatcttcccagggatcatcttcggtgtccagtgatgcaccagggaatgtgttgtgtgctttatctcagaagtcatctttaaaagattgtagtgaaaaaacagccctagatgacaggcctcaagtgctacaaccgcatcgcctcaggtcctttagtgcttctcagtcaacagacagggagggagcttcccctgtgactgaggtgcgcataaagactgagcccagcagcccgctgtcggacccctcggacatcatccgcgtcactgtgggagatgcggcaacaacagcagctgcctcatcttcgtcggtcacaagagacctgtctctgaaaacagaagatgaccaaaaagacatgagcagactcccagcaaaaaggaggttccaagcggaccgaagattgccgtttaagaagttaaaggtgaatgagcacgggtctcctgtgtcagaagataattttgaggaaggctcaagccctactctccttgatgcagattttccagattctgatttgaataaagacgaatttggtgagttggaggggacgagaccaaacaaaaaatttaaatgcaaacattgccttaagatctttagatcaacagcaggtcttcaccgtcatgttaacatgtaccataacccagaaaagccctacgcttgtgacatctgtcacaagaggtttcacaccaacttcaaagtgtggacacactgtcagacccaacacggcatagtgaagaacccatcaccagcctctagttcacatgctgttttggatgaaaaattccaaagaaagctgattgacatagtgagagagagagaaattaagaaggccctgatcattaagttaaggcgcggcaagcctggttttcagggacagagtagctcccaagcacagcaagtcatcaagaggaacttgagatctcgagccaaaggagcttacatttgtacttactgcggaaaagcgtaccgctttctctctcaatttaagcagcatataaaaatgcatccaggagaaaaaccccttggagtaaataaagttgctaaaccaaaagagcatgctcctcttgcaagtccagtagaaaacaaggaggtttaccagtgccgcctctgtaatgctaagctctcttctctcctagagcaaggaagccacgagcggctgtgccggaacgcggccgtctgcccttactgcagcctcaggtttttctcgcccgagctgaagcaagaacacgagagcaagtgtgagtataagaagctgacctgcctcgagtgcatgcgcaccttcaagtcctctttcagcatctggcggcaccaggttgaagtccataatcagaacaacatggcacccaccgaaaacttttctttgcccgttttggaccacaatggtgatgtgactggttcttcaaggccccaatcccagcctgagcccaacaaagtaaaccacatcgtcaccacaaaagacgacaacgtgttcagtgattcttcagaacaagttaacttcgactcggaagattcctcttgtcttcccgaagaccttagtctttccaagcaactgaaaatccaagtcaaagaggagcctgtggaggaggctgaagaagaggcacccgaggccagcacagcccccaaagaagcgggtcctagcaaagaagccagcctgtggccctgcgagaagtgtgggaagatgttcacggtgcataagcagctggagcgtcaccaggagcttctgtgctctgtgaaaccatttatttgtcacgtgtgcaacaaagcttttcgcactaattttcgactctggagtcacttccaatcgcacatgtctcaggcttcagaggaatcggcacataaggaatctgaggtgtgccctgttcccacaaactctccctctccaccacctctgccaccgccaccaccactgcccaagatccagcctctggagcctgacagccccacaggcctgtccgaaaacccaactccagccacagaaaaactgtttgtgccccaagaatcagacacccttttttaccatgccccacccctttcagcaatcacatttaaaagacagtttatgtgtaaactttgccacaggacattcaagactgcatttagtctttggagtcacgaacaaacacacaattgaaagaccaacactttttacctatgggaggcagtccccagatttcaacctgaattgtgaaatgtgtcataagaaacaaaatattttttaaacaagaataataaaggttggagattgttacgcttgaaattaagttggaggcaaattgataattacttagtaatgtccttaactttagaaatacagcttttaaaatattgtggttctggaccttacaagaacaagatggtttgatttcattaatgttgaaattggattagtcttgattgtgtgcatggttcctcattccatggtgtcagtataatcatttaattgaggtttttggttttttattgattagtggaatactgtcgaagtattccttcttttaattattttagacacttgagttctagttaaatcttaaccatgttcttaagtccaaaataggaagaagtggagtagtttgcagtattgatttatatcttagactactttagcaataaaagataaatctcaactttaataagttatcctgacacttgataaaaataaatatttggtattttgtggtcatgtaaaacttctttttgtatgaaaattgtgagaaatttaaatcagcaatagtaacacttagatttttataaactaacaaaaacttgctctcagtcaatataataaatgatagttaaactctaaggaagacctgggaaatgaaaacaatttatggaagtcccctacagtcagtttataagggcttcagtagtgatagacattgttataaaaacttgtaccatgttacatgtacactgcaccacagtctaaattcagaccagcatttgaaggactgcacatatttcatttcctctgatttatgctgtcacaaattgaaaatctgagtgtagttaggacaaaaaacaaagctaaccatatggcactaattttgattttaacattagtgtaacaaataaggtcgggacatatatttacatagatcccagacactcaagaattagcacagctgatgtaaaattctaaattaccatttacttccagatagagcagaggagaaacacctcactgcagtttcaacatgctttccaagaacaatatatacgacatatacattttcctgcctctctcttgtgacaatttctgttagaatttgttgggggtctgatggttaaaatcatgggcaaggccattctctacatcattgcttaatatttcaaaaataggtattagagcactatcagtggtccaaaattagttttagctacttattttgctccatgggttttgggcttttcaaagaatactatgtataatttgtaattgaaagcctttcagtaggatatccaaagttcaatgtgtttcaaaagggaaaacttttacttgtgggggtgggagttagatgtattaaaaaaacgaaactacaaaatccttttaagaaagtaataccaatttagactctagtttgtgttacgaggtattctttcaaattttttttaaaagccaactactgtcattaagaaataattttagatttgtgctctagcagaaaataactctgtacccatcaatcttattgccaacattccataccagtggtaggaaagatattctcattttttttattgaaccagacatttttataaaatactgattgactttgtacattatggatattatatatgaaattttgccttgtattctttcacttgaaaaaactccaaaattccacaatattttagtagttaacttcctattctttcttaaatttgatggagaagggaaaataaattgcagttattgattcttgccatctttgttttcttaaagaaatctatgcattttaaggataaaactaaagcatatgggtttacatgaaacatcaggatggattattgtacattgaattcattccgcgtataatgtggtatttcttactctgtccatcttggtagctgtcacttcaaaagaagacagtttccctgagtaatcatcacctacatggccattagagtatctatcggtgataattccatgatacagagtatcttggcattataaattcagtatcccaggacctaaacctttatgctacattttcgaagattttttaaaaataatattgttaatcagtaaaaaaaaaaaatatttttgatctaaacataggttctgcatatctgttagattttaaaaatgactggtgttttgtcttcacatttttgtctaagcaaggaatataagatttcaaataaaattttgaaccaaaaac

SEQ ID NO: 66 - DNA, 5654 bp, Homo sapiens
  ref <308>: DATABASE ACCESSION NUMBER: AB033055
  ref <309>: DATABASE ENTRY DATE: 2001-06-18
cggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttatatcgcggcgacggcgggctgtcgtcacgacgacgtgcggacgcagcggcgggggccttatgtggagaagtcgctgtgaagccacctataaatccatttactgaatttatggagaaggctgtaaatgatggaagtcattcagaagaactcttttgccatcttaaaactatatcagagaaagaagatttaccacggtgtaccagtgaaagtcatctcagctgcctgaagcaggacattctaaatgaaaagactgaattggaagcaacacttaaggaagcggagttggtaactcattctgtagaattgcttttgccactatttaaggacaccattgaaaagattaattttgaaaatgcgaatctttctgcattgaatttgaagatttctgaacagaaggaaatattaataaaagaattagacaccttcaaaagtgtaaaactagctttagaacatcttcttagaaagagagactacaaacaaacaggagacaatttatccagcatgttgctagaaaatctaactgataatgaaagtgaaaatactaatcttaagaagaaggtatttgaaaaggaggcccatatccaagaactttcttgtttgtttcagagtgaaaaggcaaatactttgaaagcaaaccgtttttcccaatcagtaaaagtagtacatgaacgactacagatccaaattcataaaagggaagctgagaacgataagttgaaagaatatgtaaagagcttagaaaccaagatagccaagtggaacctgcaatcaagaatgaataagaatgaggctatagtgatgaaagaagcaagtaggcaaaaaactgtagctttaaaaaaggcatctaaagtttacaaacaaaggcttgaccattttacaggagctattgaaaagcttacttcccaaattagagatcaggaagccaagttgtctgaaacaatttcagcttccaatgcctggaaaagtcattatgagaaaattgtaatagaaaaaaccgaattggaagtacagattgaaacaatgaaaaagcaaatcattaatcttttggaagatctgaagaaaatggaagaccatggaaaaaattcatgtgaagaaattcttagaaaagttcactcaattgaacatgaaaatgaaactctgaatcttgagaatacaaaattaaagcttagattcccatgtagaattactgagtcaaagaatatgaacattttgattgttcttgatatgctttgctacatttcttctgaaaagactacacttgctgctttgaaggatgaagttgtatctgttgaaaatgaactctcagaattgcaagaagtagaaaaaaaacagaaaacccttattgaaatgtataaaactcaggtacaaaagttgcaagaagcagctgaaatagtaaaaagcagatgtgaaaatttgctacataaaaataaccaaataacaaaaaccaaaaataaaaatgtagagaagatgagaggccagatggagtctcatctgaaggagttagagcgtgtctgcgattccttgacggcggcggaacggaggcttcacgagtgtcaggagagtctgcagtgctgcaaggggaagtgtgcagaccaggaacacaccattagggagcttcagggccaggttgatggaaatcacaatcttctgacaaagctttctctggaagaggaaaactgtcttattcagctgaagtgtgaaaaccttcaacaaaaattagaacagatggacgcagaaaataaagagcttgagaagaagctggcaaaccaagaagaatgtcttaagcacagcaatcttaagtttaaagagaaatctgcagaatatacagcattggccagacaactggaagctgctttagaagaaggaagacaaaaggttgctgaagaaatagagaaaatgtcatctagagagagtgctttacaaattaaaatattagatctggaaactgagcttagaaagaaaaatgaagagcaaaatcaacttgtttgcaaaatgaacagtgatccagagactccatgaaatctatttttttaattcccaagtgtctaaaaagttgaaaacctaaaagattcaagagttaaatgatttttggcatgcacaatttgattttattgccatcaaaagtttcatgacaacttagtcagaacaaaacgtcgatcacctttaatttagcacaggccttccatttatttctaaacttttttttaactcaccatttgactttctgatattgtaaaatgtgtgtgctgtttttttgtgtaattgaagcctctgaaaaaataaatgaggtgggttttgctgtaatgtccctagtacttggctaaagctagtaaaataaagagatcccattcacaattgccacaaagagaataaaatacctaggaatccaaattacaaggaatgtgaaggacctcttcaaggagaactacaaaccactgcttaaggaaataagagaggacacaaacaaatggaaaacattccatgcttatgaataagatgaaacaagatcatgaaaatggctatactccccaaagtaatttatagattcagtgctatccccatcaagctaccattgactttcttcacagaattagaaaaaactacttcaaatttcatatggaaccaaaaaagagctcacataaccaagacaatcctaagcaaaaagaacaaagctgtaggcatcacgctacctgacttcaaactatactacaaggctacagtaaccaaaatagcatggtactggtgccaaaacagatatatagaccaatggaacagaacagaggcctcagaaataactccacacatctacaaccatctgatgtttgacatacctgagaaaaacaagaaatggggaaaggattccctatttaataaatggtgttgggaaaactggctagccatatgctgaaaactgaaactggatcccttccttacaccttatacaaaaattaactcaagatggattaaagacttaagtgtaagacctaaaaccataaaaaccctagaggaaaacctaggcaataccattcaggacataggcatggacgaatacttcatgactaaaacaccaaaagtaatggcaataaaagccaagattgacaaatgggatctaattaaactaaagagcttctgcacagcaaaagaaactatcatcagagtgaacaggaaccgacagaatgggagaaaatttttgcaatctatccatctgacaaagggccaatatccagaatctacaaagaacttaaacaaatttacaagaaaaaaaaccccatcaaaaagtgtgcaaagaatatgaacagacacttctcaagagaagacatttagtcagccaaaaaacatatgaaaaaaagctcatcactggtcattcagagaaatgcaaatcaaaactacagtgagataccatgtcacaccaattagaatggtgatcattaaaaagacaggaaacaacagatgctggagaggatgtggagaaataggatgcttttacactgttggtgggagtgtaaattagttcaaccactgcggaagacagtgtggcgattcctcaaggatctagaaccagaaataccatttgacccagcaatcccattactgggtatatacccaaaggactataaatcatgctgctatagagacacatgcacacgtatatttattgtggcactattcacaatagcaaagacttggagccaacccaaatgcccatcaatgatagactgaataaagaaaatgtggcacatacaccatggaatactatgcagccataaaaaaggatgagttcatgtcctttgcagggacatggatgaagctggaaaccatcattctcagcaaactaacacaagaacagaaaaccaaacaccgcatgttctcactcataagtgggagttgaacaatgagaatacatggatacagggcagggaacatcacacaccagggcctgtcagggcgtggggggctaggggagggataacattagaaattcctaatgtagatgacgggttgatgagtgcagcaaaccaccatggcacgtgtatacctatgtaaccaacctgtacgttctgtacatgtatcccagaacttaaagtataataaaaattaaaaaaaataaagatctgatgttttgttaaacctgataagttttgtactagtaaaattctagaattctaagcatagatttaaacattgctgaaaaatgagtttgtgtgttttatgccttccaggggacagttaagtgggcagtatttatttaatatacctgcttcagccccatttgaattgtaagcactctgaaagcatgtctcatagtcgtctgtatccctggtgtctcccacagtgccctgcttacctgcaggcctttttgtattttctgtccaagtaccctaatagggtggtgcagaatggatgtacagatctgtggatgacctcagcagcttaatccaaggcacccctcgggaagcctgaaatgtctttgaagtcttatgtattatcctaaaatccattgacattttatattctaccctacaaaataagtatgtgttactatttttctttccaaattgttgagtaaaactcactgtattcatcctgtggctttgtactgcccagcctagctcattgttttttacctgcctcatttcctgagctgggcattgctcagtttcagaaggtatcaggtgtcattgaacacctgatatgaaggatgtaaaagttctctcttttctatctaggtgtctatattttaattggaggctagatgatatttgcaacctgtctttatctaaagcattgtcagtgaactcacctacttaggaattcatatgcaccttagttaaaaaaaatgtattgtggttttaaattttttcctcaaccactgtaatatgaagaattctttttattttttaagagattctaagaaaatgttcacattatcaaaactagaattctatcaacttttaagacatttaattatttggaataaaatgtgaatttttagacagaaaatggcaaaaactagtatgaaaatatatcatgttacatgtgaaattatgacagttgttaacctattaagttaatcatgttaaatatgtaataatttggggctaaatgaatgtatattataaattatatcagtgaagatcaaccatgtgtatgctttaattattaattttaaagagtgagctctaagaatgaacacatcagatgtaagtattattttaaaaaatcaaaaagaattatctagttattgtatatatgtttttaatattatgactctggtcctttggaatgaatgctattattgcttatctgtatttttttccttttttctttagaaagcacaacatcaggaagtgtgtttgaaagaagtacaaaatagtcttgagaagtcggaaaatcaaaatgagagtattaagaattatttacagtttcttaaaacttcttatgtaacaatgtttgaataaattgtcaaatttattttctct

SEQ ID NO: 67 - DNA, 5072 bp, Homo sapiens
  ref <308>: DATABASE ACCESSION NUMBER: AB033058
  ref <309>: DATABASE ENTRY DATE: 2001-06-18
ggggctgaggaggcgagggcagcggagtttcctgccctgagatagttgcagcccgctctgctgcaaccatttcaaattagagaagaaagcagttcagccggtggggctggcgggactctgaccggcccggtggcctcgccggcaacggccccgccccgctggcggcagcggcggcggcagcggctgcgcggggcctggaactggtcgggccggctggggttccgggggacaggtttgcagggtggggcccgagaggctggcgggcaggcagcagtggagccggaagggtaggcagccaggagagagagaggagctatggagagggcccgcaagttctcgggctccggcttggccatgggcttgggctccgcctccgcttcggcctggaggagggcttcgcagaggtgggcctggccgctccgctccctgcggcccggaggggatgccagagagcctcgcaagatcatcctgcacaaaggctccacaggcctgggcttcaacatcgtaggaggagaggatggagaaggcatttttgtctccttcatcctggcaggaggcccagctgacctgagtggggagctgcgcaggggagaccggatcttatcggtgaatggagtgaatctgaggaatgcaactcatgagcaggctgcagctgctctgaaacgggccggccagtcagtcaccattgtggcccagtacagacctgaagaatacagtcgctttgaatcgaagatacatgacttacgagaacaaatgatgaacagcagcatgagctctgggtctgggtccctccgaacaagtgaaaagaggtccttgtatgtcagggccctgtttgattatgatcggactcgggacagctgcctgccaagccaggggctcagcttctcttatggtgacattctgcatgtcattaatgcctctgatgatgagtggtggcaggcaaggctggtgaccccacacggagaaagtgagcagatcggtgtgatccccagtaagaagagggtggaaaagaaagaaagagctcgattgaaaactgtgaagttccatgccaggacggggatgattgagtctaacaggtcgatcaaaacgaaacgtaaaaagagtttccgcctctctcgaaagtttccattttacaagagcaaagaaaacatggcccaggagagcagcatacaggaacagggagtgacatccaacaccagtgacagcgaaagcagttccaaaggacaagaggatgctattttgtcatatgagccagtgacacggcaagaaattcactatgcaaggcctgtgatcatcctgggcccaatgaaggaccgagtcaatgatgacctgatctccgaatttccacataaatttggatcctgtgtgccacatactacccggcctcgacgtgataatgaggtggatggacaagactaccactttgtggtgtcccgagaacaaatggagaaagatattcaggacaacaagttcatcgaggcgggccaatttaatgataacctctatgggaccagcatccagtcagtgcgggcagttgcagagaggggcaagcactgcatcttagatgtttccggcaatgctatcaagagactgcagcaagcacaactttaccccattgccattttcatcaagcccaagtccattgaagcccttatggaaatgaaccgaaggcagacatatgaacaagcaaataagatctatgacaaagccatgaaactggagcaggaatttggagagtactttacagccattgtacagggtgactcactggaagagatttataacaaaatcaaacaaatcattgaggaccagtctgggcactacatttgggtcccatcccctgaaaaactctgaagaatcccctccaaccattctcttgtgaacagaagaaatcaagtccctcttccctcctccctcttcattcctgtccccatggggagaacaaatgctactgttcttgtccccttttttagatatgtcaaaaaaaattaagttttctagtcctgttctttttttttttttaagtttttgtttgtttcagtttattttttgggatgatgccatctcattcatcatgtgactgtgcccattcctgcatggacctttcccaagcgctagcacaggtgcaaaatccatcagagccattgttttcataaaaaccaagcagaagtgaagagaaaagaggaggactgatggaaagacagactctggacagctgcacggcttgtgaagtgagctaaatgcaccacatgatgagatgctcctgggcatttctccctatctgtactgctgtcttgcagctctgaacggtgcaacgtaatggcgacagaaagtatcttatttatatatagatatatatatgtaatttatataaaatatatagaaattattatatatatatattatacactctcatataatatatatatattcacacacatttgggttagaaaatctatggagacttcatcaatggtactatgttattagagaaatgctttaattttcatattccaatcagatggcatcttctatcccagctggttgggaagggattgaagatggtagcaagtgctgcactaagggcactcgcatttggtcattctcttgagagctaggaggggtcagcctgaggccggagaggaagggcttttgcctggggtgagagggtgagagacttgacctgaaagcagctgctgcccctgaggtgcagccagagtcctgtgtgcggacagagagaatggctaatgatgctccgcgtggaattgcctattgttttatgccacctgatgtgtctgcatgagaggtttcctttttgttcctttttaagctgctgttaaaccaaaaccatgttgtgctactgtgtcagccttttcattattgcaaattttacttttactatttaagtgaatgcatagaatccaatttgccaaggttctaaaggcttatgaggtcctgaaggagccaggccttgtgatggagtaggtgacacaggcctggttgtcctgtcagcagaagggaaagcaggggctgggctgagaggaggacacggagggctctgctgaggttccttcctgggttccaccaacagggacagggagtcacttgccttccagttctgtgctgggatggcgggacagcacttggcttgcttggccagctgcgtcatgagtttgatttggtttttttttttttgcagctgcttcatatgctctgctccagcccctccccaacagctggtagcttatggtttcttcaagaggaaagtagactttatgctgtacatttgagctgtagagctaagattcgcttactggtgagctgtgaaaccttgttgctttttcccagagtctgatggcagtgactgtgatcaagggaatcttcaccgccacaagtgcaggcagcaggtgtggttcaggtccccccccaccccactgtgctcctttgaagccaacgtgcctccctcgcctccatactggagggacgacgcaggggagaacagagaagtgcttggccctaggattgaggcacttgtttcctagcccgctgggttagggctggtgcaagcgaggcaatgttgaggatgctttaagcactaccagccgaatccgggaactctgttaacagttgtccaaccagcagaatgaggctaactgtataaagcatgggacccaggatgaggataaggaaaggacagcggctttccctgggcagtacaatggcttgaaggcaaaaagggataaagtgacagccgactgtgactctggtgaggaggggtgagcagggaggttgattctctgatgttaactaagtggcaaagtctcaaccgtgctcagccctccccctcccagggaagagaaacaaagattcaaagtaagcatgatactagtgggtttaccagtgtttcttccaaggagacatatattttttaataaacgatagttgcaatgaactgtggctcagagaccttcttaaagtagttgagaagggagggcgtgggcaaagcagtgggaagaacatcccaaacttttgggggccagagggctctctccttagtgatgatcagctagccgagctgggccgtcctggggatcggtacagctccctggggtggtgacaggccctttgtgaaagttgtgtgcttggtcttccaccccagccccagacactgcttcaaatagcaccaaccagatgggagtccacatctgtggtggcaaaatgctgacattttcccaagaggtacacaaggtgggagaggcctgctgtagcagaggtgtgtgttagagaaagcaggggcctgatttagtagcagagaactgggtgagaaaaatggccagagaaagtgacctgccagctaccagtgtttccgaaaatgagggtgggatgggcccatttgcagagcaggacagcagtcatccccatagccctctgaggaggggagggatgcttagagcaggcagttctgtcagttctgacgtggcaggtgccattgcaacttgtgcggaggagtcttaggaagtgctgtcataattcataaggtcaagagcaacatctggatgaatgagccacctgaaatgtgtgtgggctgagccacaggaagggtgagtcctcttgcttgtggtgctttatggtgtgcaggttgcttgctttcccacattctctcatttgcttgaaggcagcctaacaaaagggagtccccaaagagctccatgagagcttaagaaaattcatctcctgaggacaaagagaacaaagatctgtcctgtggtcacactgttgaggctctgtcttcacagctgatgttctcctagtggaggtacagctgaagaacattcagccccagcacgagaagatacagagcaacttggaaaccccaaagggagacacacccttaacactgccgtgctgtgctgtgccgtgtcctgaaggaggagagagccctatctcctcctggttttgttgctgacattgcagctgatcatgccttgactccttcatctctaacagaggaagaactgtattatcaaaccttatggtctacccatgaataaataaaatatttgttcaagcac

SEQ ID NO: 68 - DNA, 4397 bp, Homo sapiens
  ref <308>: DATABASE ACCESSION NUMBER: AB033073
  ref <309>: DATABASE ENTRY DATE: 2001-06-18
gagcgagagtgtgtcgagtgagtgtgcgtctgtgtgtcccggcgagggtgcgcgctcggcgccgggagcgcggccagccgagtccggaggcatcgggaggtcgagagccgccgggaccccagctctgcgttcactgccccgtccggagctggacttcggggccggggccggggccgtgcgccggggacaggcagggccgggtcgcgggccgcgcgtcccccaggccggagatctgcgagtgaagagggacaagggaaaagaaacaaagccacagacgcaacttgagactcccgcatcccaaaagaagcaccagatcagcaaaaaaagaagatgggccccccgagcctcgtgctgtgcttgctgtccgcaactgtgttctccctgctgggtggaagctcggccttcctgtcgcaccaccgcctgaaaggcaggtttcagagggaccgcaggaacatccgccccaacatcatcctggtgctgacggacgaccaggatgtggagctgggttccatgcaggtgatgaacaagacccggcgcatcatggagcagggcgggacgcacttcatcaacgccttcgtgaccacacccatgtgctgcccctcacgctcctccatcctcaccggcaagtacgtccacaaccacaacacctacaccaacaatgagaactgctcctcgccctcctggcaggcacagcacgagagccgcacctttgccgtgtacctcaatagcactggctaccggacagctttcttcgggaagtatcttaatgaatacaacggctcctacgtgccacccggctggaaggagtgggtcggactccttaaaaactcccgcttttataactacacgctgtgtcggaacggggtgaaagagaagcacggctccgactactccaaggattacctcacagacctcatcaccaatgacagcgtgagcttcttccgcacgtccaagaagatgtacccgcacaggccagtcctcatggtcatcagccatgcagccccccacggccctgaggattcagccccacaatattcacgcctcttcccaaacgcatctcagcacatcacgccgagctacaactacgcgcccaacccggacaaacactggatcatgcgctacacggggcccatgaagcccatccacatggaattcaccaacatgctccagcggaagcgcttgcagaccctcatgtcggtggacgactccatggagacgatttacaacatgctggttgagacgggcgagctggacaacacgtacatcgtatacaccgccgaccacggttaccacatcggccagtttggcctggtgaaagggaaatccatgccatatgagtttgacatcagggtcccgttctacgtgaggggccccaacgtggaagccggctgtctgaatccccacatcgtcctcaacattgacctggcccccaccatcctggacattgcaggcctggacatacctgcggatatggacgggaaatccatcctcaagctgctggacacggagcggccggtgaatcggtttcacttgaaaaagaagatgagggtctggcgggactccttcttggtggagagaggcaagctgctacacaagagagacaatgacaaggtggacgcccaggaggagaactttctgcccaagtaccagcgtgtgaaggacctgtgtcagcgtgctgagtaccagacggcgtgtgagcagctgggacagaagtggcagtgtgtggaggacgccacggggaagctgaagctgcataagtgcaagggccccatgcggctgggcggcagcagagccctctccaacctcgtgcccaagtactacgggcagggcagcgaggcctgcacctgtgacagcggggactacaagctcagcctggccggacgccggaaaaaactcttcaagaagaagtacaaggccagctatgtccgcagtcgctccatccgctcagtggccatcgaggtggacggcagggtgtaccacgtaggcctgggtgatgccgcccagccccgaaacctcaccaagcggcactggccaggggcccctgaggaccaagatgacaaggatggtggggacttcagtggcactggaggccttcccgactactcagccgccaaccccattaaagtgacacatcggtgctacatcctagagaacgacacagtccagtgtgacctggacctgtacaagtccctgcaggcctggaaagaccacaagctgcacatcgaccacgagattgaaaccctgcagaacaaaattaagaacctgagggaagtccgaggtcacctgaagaaaaagcggccagaagaatgtgactgtcacaaaatcagctaccacacccagcacaaaggccgcctcaagcacagaggctccagtctgcatcctttcaggaagggcctgcaagagaaggacaaggtgtggctgttgcgggagcagaagcgcaagaagaaactccgcaagctgctcaagcgcctgcagaacaacgacacgtgcagcatgccaggcctcacgtgcttcacccacgacaaccagcactggcagacggcgcctttctggacactggggcctttctgtgcctgcaccagcgccaacaataacacgtactggtgcatgaggaccatcaatgagactcacaatttcctcttctgtgaatttgcaactggcttcctagagtactttgatctcaacacagacccctaccagctgatgaatgcagtgaacacactggacagggatgtcctcaaccagctacacgtacagctcatggagctgaggagctgcaagggttacaagcagtgtaacccccggactcgaaacatggacctgggacttaaagatggaggaagctatgagcaatacaggcagtttcagcgtcgaaagtggccagaaatgaagagaccttcttccaaatcactgggacaactgtgggaaggctgggaaggttaagaaacaacagaggtggacctccaaaaacatagaggcatcacctgactgcacaggcaatgaaaaaccatgtgggtgatttccagcagacctgtgctattggccaggaggcctgagaaagcaagcacgcactctcagtcaacatgacagattctggaggataaccagcaggagcagagataacttcaggaagtccatttttgcccctgcttttgctttggattatacctcaccagctgcacaaaatgcattttttcgtatcaaaaagtcaccactaaccctcccccagaagctcacaaaggaaaacggagagagcgagcgagagagatttccttggaaatttctcccaagggcgaaagtcattggaatttttaaatcataggggaaaagcagtcctgttctaaatcctcttattcttttggtttgtcacaaagaaggaactaagaagcaggacagaggcaacgtggagaggctgaaaacagtgcagagacgtttgacaatgagtcagtagcacaaaagagatgacatttacctagcactataaaccctggttgcctctgaagaaactgccttcattgtatatatgtgactatttacatgtaatcaacatgggaacttttaggggaacctaataagaaatcccaattttcaggagtggtggtgtcaataaacgctctgtggccagtgtaaaagaaaatccctcgcagttgtggacatttctgttcctgtccagataccatttctcctagtatttctttgttatgtcccagaactgatgttttttttttaaggtactgaaaagaaatgaagttgatgtatgtcccaagttttgatgaaactgtatttgtaaaaaaaattttgtagtttaagtattgtcatacagtgttcaaaaccccagccaatgaccagcagttggtatgaagaacctttgacattttgtaaaaggccatttctttcttgggagttttttggtgtgtctgtttttttaaagtattcaagatactaccagtcaacatctttttggaagaaaatgccttgggtttagaagattttcttaaaaggggagtagatggttgtagattgactaaaaagtctaccatacttcaagggactacaggtaagtctcatagtataccagctttggtacttcattttttaaaaaagtattaatcaattgcaaagaaattcgccttggccaacccttctttgtgtatcaggtagtctaacctgatacaagtagttgacagatttcaactatcaatcaccagtccaacccatttctcatttaacagatgacggagataatccctaaaagcacccacatttgtttcaatgccccaaacaggccaaggctccctagcaactccctagtggcgttttttaacttctcagaaactgttaccattatttgaaataggcttccttaacctcctttacccttaacccaacagggattt

SEQ ID NO: 69 - DNA, 5484 bp, Homo sapiens
  ref <308>: DATABASE ACCESSION NUMBER: AB033092
  ref <309>: DATABASE ENTRY DATE: 2001-06-18
tggcgaggcgggaagcacccggaatcttcctggccctagagcctgcaggctccaggccggccccttgaatctcaccgcgaggaaggcaccctgctgcctgcacttatttgcatccaagagtttgcattgagactggcgcttgcctactagggcagccacaggggggttccccagggacagagattatgtctactttgagaattcctccagcaacccatacctaataagaaggatagaagaactcaacaagactgcaagtggcaacgtggaagcaaaagtagtatgcttttatagacgacgtgatatttccaacacacttataatgctcgcagataagcatgctaaagaaattgaggaagaatctgaaacaacagttgaggctgacttgaccgataagcagaaacatcagttgaaacatagggaactctttttgtcacgccagtatgaatctctgcccgcaacacatatcaggggaaagtgcagtgttgcccttctgaatgagacagaatcagtattgtcatatcttgataaggaggataccttcttctactcattggtctatgacccctcattgaaaacactattagctgacaaaggtgaaatcagagtgggacctagatatcaagcagacattccagaaatgctgttagaaggagaatcagatgagagggaacaatcaaaattggaagttaaagtttgggatccaaatagcccacttacggatcgacagattgaccagtttttagttgtagcacgtgctgttgggacattcgccagagccctggattgcagcagttctgtgaggcagcctagtttgcatatgagtgctgctgcagcttcccgagacatcaccttgtttcacgctatggatacattgtatagacacagctatgatttgagcagtgccattagtgtcttagtaccactcggaggacctgttttatgcagagatgaaatggaggaatggtcagcctctgaagctagcttatttgaagaggcactggaaaaatatggcaaagacttcaatgacatacggcaagattttcttccttggaaatcattgactagcatcattgaatattattacatgtggaaaactactgacagatatgtgcaacagaaacgtctaaaagcagcagaagctgagagtaaactgaaacaagtatatatcccaacctacaaaccaaatcccaaccaaatatccactagtaatgggaagcctggtgctgtgaatggagctgtggggaccacgttccagcctcagaatcctctcttagggagagcctgtgagagctgctatgctacacagtctcaccagtggtattcttggggcccacctaatatgcagtgtagattatgtgcaatttgttggctttattggaaaaaatatggaggcttgaaaatgcccacccagtcagaagaagagaagttatctcctagcccaactacagaggaccctcgtgttagaagtcacgtgtcccgccaggccatgcagggaatgccagtccgaaacactgggagtccaaagtctgcagtgaagacccgccaagctttcttccttcatactacatatttcacaaaatttgctcgtcaggtctgcaaaaataccctccggctgcggcaggcagcaagacggccgtttgttgctattaattatgctgccattagggcagaatatgcagacagacatgctgaactatctggaagtccactgaaaagcaaaagcactaggaagcctttggcatgtatcattgggtatttagagatccatcctgcaaagaaacctaatgtaattcgatctacaccaagcctgcaaaccccaactaccaagcggatgctaacaactccaaatcacacatctctgagcattctggggaaaagaaactacagtcatcacaatggtctggatgaactcacgtgctgtgtgtcagactgagctttccctgattcattctacaatccaagacttgctgcactgtcctgctgatgttcacagccgtgcctgggaagaaggcagccccactcccagtacatttcagtgggagacctctgcgtgcatccatggagacgcaatggggcggggaaggaactgtgggagtgcacgttccaaatcctgtgtctccacgtgtggatcagcagcacctcgctttcttgtcagagacctcgctgttacggagcgagacctgctgagaattgaggggctgagggaacccctccacctcctcccttctgcagcgccctgcgccccacccagcaacagcggccacttggcagtggggctgctgcaagctcagagccgctgccaccctgcatgtgtccgctcagctcggtcttatgctgtatagttactaaatatgtacaggagggccatggcatctttctgaatggatttttcttaagaaatgcgccagtgtttatgaggttcaaggtatttccctgtccttgctgttaccgtcactcagctttttctcgataggcttcatccttgtttttttgaaatgggggaatttgctgtttaccctctgcattcctatatgtgaccctccctcctactcctccaaggaacagaattaccgaggttctgacaaaagataagcctgtaaactcatcatctgtgttttgtggttggagagaaactggtgttctgcccggctctgcttggtcacagacagctccagcaagagcagttgttaaaagtgccaagcgtgtgtatcactgtgacaagccgtttgcttactgccctgttcccttgcagccaaaccagctgatgaagaactgctgccaggtgggtcctacagcaggtcacaaatgacctagtttcattttaagcagacagactctgtttggcctagaggtgtggagtgagagaactgtgtttgtgggtatgagtctgtgtggccaaccccatgacccccacccctccagcccaacatcttgtgagcacatgtgacctaggccccgggggacctgcctgctcctttggcttgggctcttcgtgtttcccacctgccctcggcacgagcccttggtggcatcacagttggccactcagctgtgctgagtagctgtgctacttgtgctggcagctgcaaggataggaatagctcagcgcccgatgagctccctgagcagatgtgaggctggcaactcccctgccctctgtttgcaggcacagggtcacagtcccaagaaagacaactggagtctgatctcccagccatctctggggttactaggaggcagctggatggcagatacgagaggcccaaatagccaagctgttgcaagacagagtggctacaattgaattgacaccctgggaagcacgaggtaacttggtaaggataatgatgctgtagatgtctgtgtcctcggaggctgagctccgcttggcagagagagcgtgctgtgtgaggtggagggcggttttgcagacatctcagcttcttttctgaggaggagttggttctcatcttaggcttctgcaagggcgagcatgggatgtctccaccaccacccactcttggagctgtgctgggtcttggcttggggcgctgagggtggggcctgtgtcagaagcatttggtgagaggggtggaggtggcaggcaggggttctcctcagggttcccactgaggggtcccttcagcaaagacctgggaggaggtgccgcatcacgtggatgtttcttccctaaagaaaaagacacaggaaagctgtctgtctgtaccctgctctggatttattgtcgtacttggacccagaaggggaaatgattccctcaccctttcactttctctctgaacccctactaagtggtgactgcagattctggaaacaattagctgcccgtgactcagctgccagcttcattttctctgccttttgggagaggccctctcacccaggcccaagagatttggagacaggagtcaggccaggtctgaagcaggagaagggaggcccctcctatctacccagttgacatttggctttgggaaaagcgcagcttgttcgagccacgtgtgccaagcaggcttttccttcctcttgtaagtaaagctcgtggttctgtagtccagtcatcctaggagggtgatgttgactgagacttcacgctctccctttgtctctggaaactgccccctcgttctgacagaatcccccaggcaatggaggaagggtgccgaggcgcctctagtctgtgcctttgccgttggaagcatttggtgctgagagggtttcccagccacccgctccctttctggggccatggtgtccctgctgtgtgtcagtggcatgtcactgtggttcagtgagcacatgggtggacgtgcagagactgtctgcgcagcccccagcagacatgcccctggggtgaggacacaggctctgcaggctatctccccctctggctcagtcatcgcctgcccacccttcacttcttaaaggtgcgcaagagaggagggccgactggagggtgtcgccggaaggtttcagcctgcccttcacaattccccttgtgcacagcccagttttccatctctcagggcccacccaggaaaatggatttcaagtgggggttttcatccagagatttgtttaacacaaaacaagaaaagctgagaggcaaaacaggggagtgaggggcaacccagaggtggggaacaacaacagcaagccgcccccatcctgagactggctgggcaccaggggaggacgcgtcaccagagcctggggccaaggccactgggggacctgccacactgtggacctgtctggtgggggctggagcctcgagaagccatgattcttgtcagaaacatttccccaggcagagagagggggccccagcctctcccctcctcttggcctccagagtcctgcaggtgcctcacagtagtgaaacccagttggaagcagctgccctgggagcctgggacaggcgacccaccgggtcagtcccctgccactcagagcagagcagggggctgagggcaagcaggtggggctgtgcgtggcctcagtgcactcggtgtcatgtctgagcctggtgtttatgccccactgctgtcctaagtccctggcgaggggaggtggaggagctgccccgtgggtgtttggagattctgttttactctgcctagagaggaaacggctttggggagggagggggaagcctttattctttactgttgtccctgttttcctttgggggaatttactcagttagcagcccctcctcaccattccccccaggaaggccatgtcccagttttctgtccacccctcctgttcctctgcactatgtctctgattttccctgccagggaagctaacccagagcacgcacctgtgctcatgagtgtttccgcaggataattcgttctgagcatgataccacagtgtggattgtctgtctgtaaggagatgccatctactaaccaatttgtattgtgtttccaataaattcctggaaatttt

SEQ ID NO: 70 - DNA, 2374 bp, Homo sapiens
  ref <308>: DATABASE ACCESSION NUMBER: AB033111
  ref <309>: DATABASE ENTRY DATE: 2001-06-18
gcgcctccgcccgcgcgcctcccggcctcgcccgagggtgcctgggcaggcgaggaccccaggttcagcagctggacatggagaaccaacgctcatcacctctgtcgttccccagtgttccacaagaagaaaccttacgtcaggcccctgctggactcccccgagaaactctgttccaatcccgcgttcttcctcccaaagaaattccttctttgtctcccaccattccccgtcaaggctccctgccccaaacttccagtgctcccaagcaagagacttctggccggatgccacatgtgctccagaagggaccctcactcctgtgttctgccgcttctgagcaagagacttctctccagggccccctggcttcccaggaagggacccagtatccacccccagctgctgctgaacaagaagtctcccttctctcccactccccccaccaccaggaagcccccgttcactcccctgaagctcctgagaaagaccccctgaccctttccccaacagttcccgagactgacatggacccgctgctccagagcccggtttcccaaaaggacacccctttccagatctcttctgcagtccagaaggaacagccgctccccacggcagagatcacccgcttggctgtgtgggctgccgtccaagcagtggagaggaagctggaggcccaggccatgaggctactgaccctggaaggcaggacggggacaaatgaaaagaagatagccgactgcgagaagacagccgtggagttcgcgaaccatctggagagcaagtgggtcgtgttggggaccctgctgcaggagtatgggctgctgcagaggcggctggagaacatggagaacctgctgaaaaacagaaatttctggatcctgcggctgccccccggcagcaatggagaagttcccaaggtccctgtcacatttgatgatgttgctgtgcacttctcggagcaggagtggggaaacctgtctgagtggcagaaggagctctacaagaacgtgatgaggggcaactacgagtccctggtttccatggactatgcaatttccaaaccagacctcatgtcacagatggagcgcggggagcggcccaccatgcaggagcaggaagactctgaggagggcgaaacgccgacagatcccagtgctgcgcacgatgggatcgtgattaagatcgaggtacagaccaacgacgagggctcagaaagtttggagacacctgagcccctgatgggacaggtggaagagcacggcttccaggactcagagctgggtgacccctgtggggaacagccagacctggacatgcaggagccagagaacacgctggaggagtccacggaaggctccagcgagttcagcgaactgaagcagatgctggtgcagcagaggaactgcacggaggggatcgtgatcaagacagaggaacaagacgaggaggaagaagaggaggaggaggatgagctgccgcagcacttgcaatcccttgggcagctgtccgggagatatgaggccagtatgtaccagaccccgctgcccggggagatgtcccccgagggcgaggagagccccccgcccctgcagctaggaaaccccgcagtgaaaaggctggcgccctccgtgcacggtgagcggcacctgagcgagaaccgcggggcctcgagccagcagcagcggaaccggcgcggcgagcggcccttcacatgcatggagtgcggcaagagcttccgcctgaagatcaacctcatcatccaccagcgcaaccacatcaaggaggggccctacgagtgcgccgaatgcgagatcagcttccggcacaagcaacagctcacgctgcaccagcgcatccaccgcgtgcgcggaggctgcgtctcacccgaacgcgggcccacgttcaaccccaagcacgcgctcaagccgcgtcccaagtcacccagctctggtagcggcggcggtggccctaagccctacaagtgccccgagtgcgacagcagcttcagccacaagtccagcctgaccaaacaccagatcacgcacacgggtgagcggccctacacgtgccccgagtgcaagaagagcttccgcctgcacatcagcttggtgatccatcagcgcgtgcacgcgggcaagcatgaggtctccttcatctgcagcctgtgcggcaagagcttcagccgcccctcgcacctgctgcgccaccagcggactcacacaggcgagcggcccttcaagtgccccgagtgcgagaagagcttcagcgagaagtccaagctcaccaaccactgccgcgtgcactcgcgcgagcggccgccaccgcggtggagctccagcttttgttccctttagtgagggttaattgc

SEQ ID NO: 71 - DNA, 4955 bp, Homo sapiens
  ref <308>: DATABASE ACCESSION NUMBER: AB036063
  ref <309>: DATABASE ENTRY DATE: 2001-06-18
ggctggccgaagttaggcggagccccgaggcgggggaggcggggccgggccggcgcagggagagtcactcaatggacaggcgagaaagcaggaccggcgcggcggggcggggccggccgagtccctagagctgggggcggggcggacccagcggaccagcggaccacctgggtgctgtcgtagttggaggtggcctgaggagctcagttccctcagcgcccgtagcttcggcggagtctgcgcgatgggcgacccggaaaggccggaagcggccgggctggatcaggatgagagatcatcttcagacaccaacgaaagtgaaataaagtcaaatgaagagccactcctaagaaagagttctcgccggtttgtcatctttccaatccagtaccctgatatttggaaaatgtataaacaggcacaggcttccttctggacagcagaagaggtcgacttatcaaaggatctccctcactggaacaagcttaaagcagatgagaagtacttcatctctcacatcttagccttttttgcagccagtgatggaattgtaaatgaaaatttggtggagcgctttagtcaggaggtgcaggttccagaggctcgctgtttctatggctttcaaattctcatcgagaatgttcactcagagatgtacagtttgctgatagacacttacatcagagatcccaagaaaagggaatttttatttaatgcaattgaaaccatgccctatgttaagaaaaaagcagattgggccttgcgatggatagcagatagaaaatctacttttggggaaagagtggtggcctttgctgctgtagaaggagttttcttctcaggatcttttgctgctatattctggctaaagaagagaggtcttatgccaggactcactttttccaatgaactcatcagcagagatgaaggacttcactgtgactttgcttgcctgatgttccaatacttagtaaataagccttcagaagaaagggtcagggagatcattgttgatgctgtcaaaattgagcaggagtttttaacagaagccttgccagttggcctcattggaatgaattgcattttgatgaaacagtacattgagtttgtagctgacagattacttgtggaacttggattctcaaaggtttttcaggcagaaaatccttttgattttatggaaaacatttctttagaaggaaaaacaaatttctttgagaaacgagtttcagagtatcagcgttttgcagttatggcagaaaccacagataacgtcttcaccttggatgcagatttttaaaaaacctctcgttttaaaactctataaacttgtcattggtaaatagtagtctattttcctctgcttaaaaaaaattttaagtatatcctttaaaggactgggggtttgctcaaaaggaaatccaaaacctattctaaacaatttgcatttatataattttcctgtttaacaacaagagtgtgacctaaatgcttttgtcttgtcactgaaataaaagatggcattatgtggttaagagcatggggcgaggggtcagacatgagtctaaggttctgcccttactccagtgtgtgacccttggcaagtcagttaatcttggtaaacctcggtgtacttatctttaaaatgggagtaatagtaggtcctaaattcatagagtggatattaggattaggatgcaaaaataaatgcttaaccaacactactactgttagcaccactactaattatcattcattgataatattaattgcaatgatgttgtaataaaatactctcatttccttaaaataattgtgattctaggtcctaggatctagaattagatctttgtatttttaatgcttaggggaagaatataagtatctccttaaaaagaacataattctcattcacgcaagaataagttctttgaattccttagtatgtagtgaagaaaatttagttgttagttgctttgggaagcctacttatggagtggaaaccaggaggttatcatggtagttgaccttgtaagaaaaatgattcttcttcagaaattaaaaacataactattgccagatttagctctggaatgtttagaatcaggctagaatagcattttccaaagaatattctaagagctattagctcctctagatattttgttgggggaaaaaggggattctgtggtcagatgagtttgggaaatgctgaacacttcattcttctttagcaagtacagtcagtacatcaaagactgagcagttcagtggtacataaatttatctcgccctgcatattcccaacatacttaacacagatgttttttacctgttaacatctcacccagctagtgttcctcagaacaaagattggaaaaagctggccgagaaccatttatacatagaggaagggcttacggactgagaaagggagaacatggtagggattattgaatcatttcaaatttataccaagcctgaatagtgtaccagcaattgacttaggctgtgtttctttatggttttaaaactcttgagctgttataagagatagttcttttaatgtgactatgcaacatgatagccaatggtgagggaaaaggaggtttctctagaagagtctgatgaaaggccgggaaccaaggtttttgagaagtctgcccctatttatttttagtaagtatcaagaggtagcctgagcctagttagagttagacctgtctttggatgaagaagtcttaatactgaaatactgaatttttaatacattattatttggtattctgtataccccttcaagcagttgtttcccattcccaacaaactgtactttatacaattctggatgctaaaacttagagattttctctttgcataaattttggctccattctttccataacaatctaatcaaaactgggagttctcaagtgaatgcaaaaggagcaggccataactttatttgttagagacactgtcagaaacttgagatcttttggcctatgataataccattaatttttgcattgcttcagtttgccaagtgtttttacatcatctcatttgatctcaaaacagcttgacagagcaactgttattgaaatattacagatggaaagaatgaggctcagggaagttaaatgacttggccaagatctgctcatcgtcactgtctgtacagtatttttttttagaggttgtaatgtctcagatttagtcctttaccatctatgttgatttgcttttgtctatttcctcattaattgaatatactttaaatatatatattaaagtatcaaaatatagagagacatttgaactgtattcaggtaatatgtttaaagatatttatatattgccatacaaaaacttaacatttaaaactgataatatctgtaatgacatcagaatgaaagaaaaaaaattgtacagtgtatattcctttgttttgaatccaaatctttttcataggtaatgacagatgccttaatgtgaagcttatttataatagcaataaacctaactggatttggatgaagaagtcttaatactgacatactggatttttaatgcactggtttgttatttggtattctatctctttttccaggcctccaggttgcacatttatttattatgttcaatactttggttcttagttcttaaagaatcaagaagttgtgtaatcttttaaaaatattatcttgcagataaagaaaaaaattaagagtgtgtttacaactgttttctcttttttacagtacatgtatttaaatcattgctataataaagttaagttcattaggaatataaaaacttgcagttctatgatagattgcatttattaaaaatgtttcattgtatcacatagaaatatggccaggaaggacttgagaagacagtttgatccattgcttttagacaggactgggttttgctgtccaattatatacaataatagtttttcttacaactaagctggccccagccttgtcttgatattaatacatgaaatttttataattgtctcattgtctcatttagaaacatccatatttttctgctttttctattgccattttttatttgtgcatgaattgattattgagaaaatgtagcagtttgcatatttaaaaattaatcattttgcattttacatttaaatatgctaacatcgctgtcatagaattcccaaatttcatttgtagatactgaactaagggctaatgtcaggagctgatttttaatgataaagctgcagatgggctaaataaaagccaaattaatcctacaatcaggtattatgtttttaaaccaagttgagtgaattggtagtggacttgggaaatcttccccagcagaatctggatgaatggcacagaattgaaatctctttgtttcccaccatttccctttaagtgctctgctcctttgtaaaaagttaaagatttgaaagagaatctcatattcccgaggcattaggaagaaaggatttaatcccttcaatttggggcttaatcttgtttaaaaaaatgtaagtgaagatggaaggctggagagaatgattgctttttgtacagttaaataaggtcacaatattcttacatactttgttttacaactgtgttttcattttttcaaatgtctggccatttagcaaagttatttactatttactgtgtacatagaaaggtttattatgtgtggtgtatctaaatttttttttgctgaaatacattatggtcaatcaagccaagcctgcatgtacagaatttgtttttttttcaaataaattagttgttttcttatttttttggcttagtatgttgaaataaactatggtatcttcatcattttgtacatttcctttttgaggaaggtttctttataagtgcaagggctaccctaataaaggaatgtatatacttacaaaaaaaaaaaaaaaaaaaaaa

SEQ ID NO: 72 - DNA, 6043 bp, Homo sapiens
  ref <308>: DATABASE ACCESSION NUMBER: AB037720
  ref <309>: DATABASE ENTRY DATE: 2001-06-18
gacggggtttcaccatgttggtcaggctggtctcaaactcctgacctcaagccatccgcccgcctcggcctcccaaagggctgggattacaggcgtgagccagcgctcccggccctgacctcattttttttttttctatttttaaaatagggattctagttctgttgcctgggctggagtgccgtggcgccatctcggctcaccgcaatctctgccttccggattcaagctattctcttgcctctgcctccggagggactgggactacaggcgcgcgccaccatgcccggctaatttttgtatttttagtagagacggggtttcaccatgttggccaggctggtctcgaactcctgacctcaggtgatccacctgcctcggccttccgaagtgctgggattacaggcatgagccactgcgcccggccctgacctcattatttctacccaccccctcccccaccactaccaccatcttcatctccagcctcagagatgcaaactcctggaccgcctgcccctttcctcagataaaccaaggtcgtaagttcaggctccgcctccccgcagggcctccccaaggtcacccgcttctttcctcgctcagctccttggtggcgttgtccgcgtgcccctccacagcggggccggcgctctaggctgcagcgggccgttcacacagcctcatcatctcgctggtttccggtgctcggcggctactctagccctcagccgggccctgggactctatcccctaaggccggttctctatggtcgacatcgcccctttgtcccgaatttcctccgggaggacgctctggtgggatccaagcacttcccccgctgcgtctgtggtcgcttttaggtgcaactggagaaggcactgaagccctacgagattcacaccgtcttcggtctcctggggtcggcgccgagtgggaggatggcggaagtaagtatgaaggtgcccttccctcccgccgctgttctctatggtctcttccttcagcgacgggaaagggggtcctgacgcctgcgcggaaccgggctgggcgctcgtcgcgtagtgggtgggggcgcagggagcgggagccgccgccgccgccgccgccgccggagctaacctcggggaccgagatgcaggtgggaccggaaccggaacccccctcttcaagtaccttttccctctccgcgacccggccctggcgcccgagaggattcctgggtgggggtgggcgtggagggccgggggctggagaggcactcggccccggagagtgcagcagacagggctggtcccgaggtggatgcggccccggaaaatgggcggctggggggtgtccagggagtagggtcggatcggagtatatggaccaccgggcccggagggtccgagccgagagcggagcctgcaccctccacctcccgcccttcgggaaatatcagaactgagccaggaggcaggtgcaccgggaaaatgtgtctgagtcctgcttggcagaagagaaactgagtcaccagcttaggagtcgcagggtcagcgggcctgaagggggctgggtctgtctgcggtgcggaggattgggtgggcctgtgtgagccgaggtggccgctggctggagattggtttgcacttcttggctgggttcccccgtgctccatgactcctgcatctcctgattgtttctcgttggtttggagttgtccctgcggttggagccatctgagcttgtagggtcgaggcccaggaggaaggggagggttcaccgacttacagcctggctgtaggtttgaacaggagtctgaggtcgctgagggtttggggaggctttcctgagctgctctggccccagtcctggggctgtcaccttccagtattgcgtggcgggaggagcgctaacaagagccaagggttgtaaattccacacccagctctgccactttctagttgtaagaccttgagagggctcctcctttctctaatttctattttagaaaattggaacaataatattcttctcccacatgaagatagtaacaatggcagtcgttcagcggatgcttactttgcgttcagcgctgacataccccattccatgtaattctctcaacatttcgaggggagggatcattagctttgtttaacagatagaaaaacggaggctcagagaggacgtggaatttgttcaagataacatcgctcataaggtggctggactgggtgctcataaggtggtttgagccctggtctgactcaagtccatggccttaaccagaaggctaacctgcctttagggcatactccccagtgggagaagaggaaggtgaaaaatcctagggccccagctctccctgtgatgttttgtttacgtgaggccagcaaagacttgacctgagccaacccagtttctcctctggggcccctgcggcctctggccccagactgaagggataccaaagaagtgggctgtagctatttcacatctccttcacgcagtgcgtgggtgctggactctggggtcagctttcaagacaattactgttttggtccatcatgcatccatcctcattaatgaatcggccccctccaaagagttggaccctaagatgcgtgaggcaggctctctaaggtctagaatcccagctcctctctagccccctgcgagctggggcggtgaggtgctatggctgaggctggcccagccgggccctggggacagggactatgaagtggggaaaacagtagacttggagttctgaaacttttctgagcttcggtttcctcatctgttcgagaggtctttgaaacctctcagggaaaggtaagataaccaagtgggagcctctagaatggctcatgggaagtgtgacatgaatattggaggatccgatgtagagggggggtgatctggaaaagttcccttttttagggggaaggtgctccaaagccctctactgctggatccaaagctaaggaaagtgggggcaaatgtggcaggctcggggcaggttagacgctggggagccagttggctggggcctgcagggtgccaggatctgggagagggaagggaggtgttgggctcccttccccattgctctctgcggagtctgaagtagggtcggacgtctctggctgggggtgggatgcagcctccggtgcgccctcagcagtgaccctcgtgtgtgcctctctcttcctttcgcagctgctgccgcccacccctcgtcttctggctgcctccctctttgtgccccacaggctccccctctccacctcctggggcccatcatgaatggtgccccttccccagaggacggggcctccccctcgtctcccccgctgcccccacccccgccccctagttggcgggagttctgtgagtcccacgcccgggctgcggctctggactttgcccgccgttttcgcctctacctggcctcccacccccaatatgcggggcccggggccgaggctgccttctcccgccgttttgctgagctcttcctgcagcactttgaagccgaggtggcccgggcctctggctccctgtcgccacccatcctggctcccctgagccctggtgcggagatttcgccacatgacctgtcccttgagagctgcagggtgggtgggcccctggctgtgctgggcccttctcgatcatctgaggacctggccggccccctcccttcctcagtctcttcctcctctacaacctcctccaagccgaagctcaagaagcgcttttccctgcgttcagtgggtcgctctgtccgaggctcagtccgtggcatcctgcagtggcgggggaccgttgaccctccctcctccgctgggcccctggagacctcgtcaggccccccagtcttaggtggaaacagcaactccaactcctctggcggggctgggaccgttggtaggggactggtcagtgatggaacgtcccctggggaaagatggactcaccgttttgagaggctgagactcagtcggggagggggcgccttgaaggatggagcagggatggtgcagagggaagagctgctgagtttcatgggggctgaggaggcagcccctgacccagccggagtgggccggggaggaggggtggctgggcctccttcagggggaggagggcagcctcagtggcagaagtgtcgcctgctgcttcgaagtgaaggagaaggaggaggaggaagtcgcctggagttctttgtaccacccaaggcctctcggccccgactcagcatcccctgctcttctatcacagacgtccggacaaccacagccctggagatgcctgaccgggagaacacgtttgtggttaaggtggaaggtccatccgagtatatcatggagacagtggatgcccagcatgtgaaggcctgggtgtctgacatccaagaatgcctgagcccaggaccctgccctgctaccagtccccgccccatgaccctccctctggcccctgggacctcattccttacaagggagaacacagacagcctggagctgtcctgcctgaatcactcggagagtctacccagccaggacctgctgcttggacccagcgagagcaatgaccgcctgtcgcagggggcatatgggggcctctcagaccgcccctcggcatccatctcccccagctctgcctccattgccgcctcccattttgactcgatggaactgcttcccccagagttgcccccccgcatccccattgaagagggacccccaacagggacagttcatcccctctcagccccctaccctcccttggacactccggaaacagccacagggtccttcctgttccagggggagccagagggcggtgagggggaccagcccctctcagggtatccttggttccacgggatgctctctcggctcaaggctgcacagttggtgctgactggcggcactggctcccacggtgtcttcctggtgcgccagagtgagacaaggcggggtgaatacgtcctcaccttcaacttccagggcaaggccaagcacctgcgtttgtcgctgaacgaggagggtcagtgccgggtccagcacctgtggttccagtccattttcgatatgctcgagcacttccgggtgcaccccatccctttggagtcgggaggctccagtgatgttgtccttgtcagctatgtcccatcctcccagcgacagcagggccgggagcaggctgggagccatgcgggggtgtgcgagggagatggatgccaccccgatgcctcctgcaccctcatgcccttcggagcgagtgactgtgtaaccgaccacctcccatgacccaccccagccccctgaacccccttcatggacagatcccccacagcctggggcagaagaggcgtcgagggcgccagaagtggcggcagcagcagccgcagcagccaaagagaggcaagagaaagagaaagcgggcggtggaggggtcccggaagagctggtccccgtggttgagctggtccccgtggttgaattggaagaggccatagccccaggctcagaggcccagggcgctgggtctggtggggacgcgggggtgcccccaatggtgcagctgcagcagtcaccactagggggtgatggagaggaagggggccaccccagggccattaacaaccagtactccttcgtgtgagccaaccccacccgctccaccctttttaaaccccccagccctgctcgtgagattgggctgggtagggacagaggaggccgaaatccctcccccatgcttcctgacccttgttggccaagggcatctttgatggtacaagcagaggctcgggagaggctcccgtcacacactacaggtcccctccccagggcaggggatttgggctccatgagctccttgaggggctcttctggtcagccccaccctgggggccatttccccattaactacccccagcccgaggcagggtgagggggaagggctgtcagttacattaaggtggttgttgttgttgttttaaacaaaatggagaagcataaataaataaaaaggtttatctcg

SEQ ID NO: 73 - DNA, 5058 bp, Homo sapiens
  ref <308>: DATABASE ACCESSION NUMBER: AB037742
  ref <309>: DATABASE ENTRY DATE: 2001-06-18
ctcagatcctgacggtgcagcagcccgcagcctcagccagggagtcccagccgctttcaatggaggagaagcccggccagccacagcctcagcaccatcacagccaccaccatccgcaccatcaccctcagcagcagcagcagcagccgcaccaccaccaccattattatttctacaaccacagccacaaccaccaccaccaccatcatcaccagcagcctcaccaatacctgcagcatggagccgagggcagccccaaggcccagccaaagccgctgaaacatgagcagaaacacaccctccagcagcaccaggaaacgccgaagaagaaaacaggctatggtgaactaaacggtaatgctggagaaagagaaatatctttaaagaacctgagttctgatgaagccaccaaccctatttccagggtcctcaatggcaaccagcaagttgtagacactagcctgaagcagactgtaaaggccaacacctttgggaaagcaggaattaaaaccaagaatttcattcagaaaaacagtatggacaaaaagaatgggaagtcttatgaaaataaatctggagagaatcagtctgtagataagtctgatactataccaattccaaatggtgtggtaacaaataattctggttatattactaatggttatatgggtaaaggagcagataatgatggtagtggatctgagagcggatatacaactcctaaaaaaaggaaagctaggcgcaatagtgccaagggttgtgaaaaccttaatatagtgcaggacaaaataatgcaacaagagaccagtgtcccaaccttaaaacagggacttgaaactttcaagcctgactatagtgaacaaaagggaaatcgagtagatggttcgaagcccatttggaagtatgaaactgggcctggaggaacaagtcgaggaaaacctgctgtgggtgatatgcttcggaaaagctcagatagtaaacctggtgtgagcagcaaaaagtttgatgatcggcccaaaggaaagcatgcttcagctgttgcctccaaagaggactcgtggaccctatttaaaccacccccagtttttccagtggacaatagcagtgctaaaatagttcctaaaataagttatgcaagcaaagttaaggaaaacctcaacaaaactatacagaactcttctgtgtcaccaacttcatcttcatcatcttcatcatctaccggggaaactcagacccaatcatcaagtcgcttatcccaggtccctatgtcagcgctgaaatctgttacttctgccaacttttctaatgggcctgttttagcagggactgatggaaatgtttatcctccagggggtcagccactgctaactactgctgctaatactctaacacctatctcttctgggacagattcagttctccaggacatgagtctaacttcagcagctgttgaacaaattaagactagcctttttatctatccttcaaatatgcaaactatgctgttgagcacagcacaagtggatctgccctctcagacagatcagcaaaacctgggggatatcttccagaatcagtggggtttatcatttataaatgagcccagtgctggccctgagactgttactgggaagtcatcagagcataaagtgatggaggtgacatttcaaggagaatatcctgctactttggtttcacagggtgctgaaataattccctcaggaactgagcatcctgtgtttcccaaggcttacgagctggagaaacggactagtcctcaagttctgggtagcattctaaaatctgggactactagtgagagtggagccttatccttggaacccagtcatataggtgacctgcagaaagcagacaccagtagtcaaggtgctttagtgtttctctcaaaggactacgagatagaaagtcaaaatcctctggcctctcctacgaacactttgttaggctctgccaaagaacagagataccagagaggcctagaaaggaatgatagctggggttcttttgacctgagggctgctattgtatatcacactaaagaaatggaatctatttggaatttgcagaagcaagatcccaaaaggataatcacttacaatgaagccatggatagtccagatcaatgaaggaccagactgcctattcgtaacctttctgcagcattagagccatcgttcatgggggacacaaggcttttatgctcctagatcttcaacgcagcagaggaaccataagtagaatcacaggataatatatacaaatatatatatatacatatatatatatatagttatttaaaaaaggcaactgaaagtaattagacttcttaaggaatcaaatttatttcaagagactacacatggttatttaatctccggtactgaataggttttttttcttctgttagtttttgtttttaagtgtgaatgcaagtgattaatgaatacagacttaacaagtgtggttctaaagttcctgctgtcatcaacttgggcaacaaatgacccactggaaaggcaaatccacttaaaagatctctgtatcttgttctgtgactgaagtgatacactaatcacggggaacccagaatgattcaacattttccccccactcctcccttgatctttttggttttactttaattaagccctgcgagaatgctggataaatgccttgaagttagcagggtgtatttttttagcgaatatgatttgcatgtcttgccaggagttaagcggcctctggggtgttggggaaatactttatttctttccatttattttttgtggggcggggataggggagggcattgaagttctacaattctggaatagttagttgatggtacatagttaacttggcttcggttacatattggactttaacaactgaagaatctatgcgtgtcatttaaagaaaagttgcagaacaagcaattggcttagatatacaatctggaaaaatattcctgtgcccatattttaatgtaattgtataactgggagcaaaaatatattctgcttttcaactgtaggtgctccagacttgctctccgtcactaacactaaatgtgctgttttccttgtttttcatcaaacatttaagacaaacttagacctttctgtaaattatcttttaatttctcagcaaaatctaaaaggggaagaaaaaagtccatgaaaactaaaacttttcatgtttttagccagtgagaagataataaaccctgactgtagaaggtgtgttttcatgcaaactatacttctgagcttgttagcttctaattatatcttaataaatatattttattactagagcaagatgggtttttaaggaaaataatgtgaaattctggaaattttctttggggcagagaagagcattagccctgtcttatcattacattgccatcctgttgcactgcagcttgtgtatagcatgctaaaataaatttttgtgtgtgtgtgcagaaattaagggtccaattgagattgggtgatgttagtaacataataacaagttgtctggcctgacacagcatcacatcacacacacagaaattagtatatccatgtatgtcaaatacaggttaaaatatcagggcatttatataaagagttgtagtcttctgataaaagtagactggatcccctggggtatttggggagaaagtaactactttggctctacccctagaaatgtccagttttgagtgactgtagtatggatgggttttcttgttttgttgattatttgaggcttttaaaacaagtagttcatgaaagaagctgttggactcaacatagagtagagtaactatctttttagtctggatttctgccctgcttagattttaaaagtataagcatggattgccaattccacttgatgtaaacaaaacttttttttatacataatatatatatatatatataaaataacttattgtatcagtccaggttcagaaacttgtggtaggccagttccagatagtttcatttcacctgtaaactgtatcactttgactgatattgtaattttcaaatgtataatatgtttacagatgtgccctgcatttagtctgccttgttcctattttgatttttgttgagtctcctgcctgcttgccaaaagctaggatgcttcaggcccatgtacaattgaaagcagaggcatccttgagctttaaagcattgaacaaactggaaaatgcaacataccacataactgaagtgaaaaaagtctgtgtttttgtgtttttttaaataaaaattttcaaaaagttaaaaaaaaagacatataaggttgattaaagggaaaaaaggctccagtttgttttacaggttttaaagttctgctgtgtgttcaattgccttgtgtaaccacttgtcgccttagggccagattcccctctctagtccccttttttaaatgtccattttgcttgcctggaattttaaagttcttccgtctcacaactcacaagaaactttctgggtttgtgacatacagaggttgaattgagtatatatttgaaaaggaaaaaacaaaaaacaaacccagaccccacctgaattgggctttttaacttagaagcaacacttgattaaacatctttagaaagctattgcttttctaatttccttccatatccctcaggcctcagtgttcagagaagccaaaaagaatgtatcacttctctgtctgtccaaaggtttttgagagtctcacttctaaatgaaacaatgcaacatttcactttgatttctccactgaaatttccttgattatatggttagaggtatgtagttaggaatgtctgttaactttctgagaaccctagtgccccatcatattaactgtcagtattttgggggcattaggttaatagacttaattgcctaggtacaagcaggactttgggacaaatctctttgtgctgtttggtaacacttaactctatttgttgcaatctttctccttaggtcctcacacaattccttacagagcacttattaaaaaaaaatcttaagagtt

SEQ ID NO: 74 - DNA, 4832 bp, Homo sapiens
  ref <308>: DATABASE ACCESSION NUMBER: AB037743
  ref <309>: DATABASE ENTRY DATE: 2001-06-18
ggagccgaccagtttctccttggaccaagatgactgatggaaaactctccacctctacaaatggcgtagccttcatgggtattctggatggtcgaccaggaaacccccttcagaacctgcaacacgtcaatctcaaggcgccccgactcgtctccgcgcctgagtacgggcccaagctgaaactcagggctttagaagaccggcacagcctccagtccgtggactcggggattcctaccctggagatcgggaacccggagcctgtaccctgcagcgcggtccacgtgaggaggaagcagtccgactccgacctcatccccgagcgggccttccagagcgcctgcgcgctgccatcctgtgcgccaccagctcctagcagcaccgagcgggaacagagcgtgcgcaaatcctccacgtttcccaggacaggctatgactcggtaaagctctatagcccgacctccaaagccctgacccgcagcgatgatgtctccgtctgcagcgtgtccagtcttgggacagagctgtccaccacgctgtccgtcagcaatgaggacatcttggaccttgtggtcacgagcagctccagtgccattgtgaccctggagaatgacgatgacccacagtttaccaacgtcaccttgagctctatcaaggaaacccgtggcttacaccagcaggactgtgttcatgaagctgaggaggggagtaaattgaaaatattggggccatttagtaacttctttgcaaggaacttgcttgctagaaaacaaagtgcaaggcttgacaaacacaatgacttgggatggaagttatttgggaaagcgccactccgagagaatgcccagaaggattcaaagagaatacagaaggaatatgaagacaaggctggaagacctagcaagccaccctctccaaagcagaatgtgaggaagaatcttgactttgaaccactttccaccaccgcactcatcctcgaggacagaccagcaaatctcccagcaaaaccagctgaagaagctcagaagcacagacagcagtatgaagaaatggtggttcaggccaaaaagcgagagctgaaagaagcccagcgaaggaagaagcagctggaagaaagatgcagagtcgaggaaagcattggaaacgctgtgctcacctggaataatgagatcttacctaactgggaaacaatgtggtgctctagaaaagttcgagatttatggtggcagggaatccctccaagtgtgagaggcaaagtctggagcttagccattggcaacgagttaaatatcacccacgagctctttgacatctgtcttgcccgagccaaggagaggtggcggtcccttagcacaggaggctctgaagtggagaacgaagatgctggtttttcagcagcagacagagaagccagtctggagcttattaaactggacatttctagaacatttcctaatctctgcattttccagcaaggtggtccatatcatgacatgttgcacagtattttgggcgcttatacttgttaccggccagatgtgggttatgtccagggcatgtccttcatagcagcagtgttgatcttgaacttagatactgcagatgcctttattgccttttctaaccttctgaataaaccctgtcaaatggcgttttttagagtggaccatggccttatgttgacttattttgctgcatttgaagtattctttgaagaaaatttgccgaaattatttgcgcatttcaagaagaacaacctaactccagatatctacctaattgattggatctttaccttatatagtaaatctctgcccctcgacctggcctgtcgtatctgggacgtgttctgtcgcgatggggaagagttcctgttccgcacggccctgggcatcctgaagctgttcgaggacatcctgaccaagatggacttcattcacatggcccagttcctgacccggctgcccgaggacctgcccgccgaggagctgtttgcctccatcgccacgatccagatgcagagccgaaacaagaagtgggctcaggtactgactgcattgcagaaagacagccgggaaatggagaagggaagtccgtccctccgacactgaggctgcagcgggaattcgcactcggcaccaatcagagccccatgccgcggcccctctgttgtttcagactgacacccgggcagccgagaagaacagacgctctttaagtttgattcctaacactggagttggccttaaacaaaacaaacacaaaaacttttaaagaattaaaccaaggcttagccttaagcagctcagtggaaggatgagctgctgcggaccacagccagccactgcatctgctgcacagttgaacgatgggcagtggctcacccccactcctttatttcagcaaaagctaattaaattgtaatgtttctatgtcaactactgggaagtatgttacagtcttagccaggatgcatgagagatgttatttgggagacttgagatgctttggctgatatttacatgttttcgataagaaagggatcgctgattgagttattgagatagtttttccagagctggaggtcacgtttctaaaactcacctacgaaagatagcattaaaggaacaggggctctctgaggatggccactgatgtgtgtttgtggatacctgggcatcgacccagcctgcaggtgagctctgggccatgttgccttgacacagtcacagtgtagaggatgcaggtgcacacgtgggctccagtgggactgcgctctgggagactgctccctggcatcggtcctgcggaggtggaaagttcgagaggaggagctatttgcgaggaagccctgtggcaatagagataggcttaaaagcggagagaacacagagtggaatcagccccctgtaagtaaaagggtagagaaagagatgtgtggctgggccctctcccacctgcctgttcagtggaggccagggcagcagcccagaacagcacatgtgggggaggtggccccttgtgccagcagtggctcctctctgcctttgagccctgcacagctggacccatcctaagtgccagtgagtccctcacacatttgactttagaacgtgtgcttcatgacccgttgtacagacggaggagcgagcaacacacgtctaacagcctagacaatctcgtcagatgctcatactggaccatcagcctccccattttagctgactttcccagggtcgttggcaaattttttgttctgtcttttccttgactaattgtagaactttgtgtgaggactttggttatccaaaatcacagaaatgaaccgttttgcagctgcgcagtctaaagggcaggccagtgtctggaagcagggcccacgtggcggtccgctggcaggctggtcctggggagcattctgcggacccggtcacgggcttggttagtcatgcgtacatgtgtgccttggggtgctctgcactccacggcccttctcagccacacttcccaccccagggggtgcccccaggctgatctcatttctgatgttgagggctgtttggctctgtctgtatagcttgtaacaggagccttgggctaggggctggggaaggaaagccgagctggcattcgttctctggactttttatgcctgccatacccgctaatgctcctcgaggtgcaggagcaggttgctgagccagtggctgccccgtgccctccttcccagcactatcatgtgtcacgtttcccggactctgcccctacatctcagctgaatctccagggaggctgcagagcatcgtggagaccactttctgcctcggcctttaaatgctgactcacctcctctcggaggaggcgtcctgtcttcacgggggggtcccggtggcctccagacgtagccatttcctgacatcaagatgttgaatgtaatctggtctgagctgggcctgtgggaggggccgcctgaggcctgtgcgctgttgtcctcgcagatgtacttatttttgttcatgttacgggcgttccgttccttaaagatgtatatattttcttactgtacataaagatgttccttaagtcgtacagaaggtggcgcggcaaagggcctcgtgcagtgtgttcagattgcccctggggatcttctgtgtcttcagcgcccagccctgcgtgttcctggtgaagcagtttcacatcagtctctccagatagcactacgatgtattccgcttctgaacaggatcccatgccagtgtggaacaccttcccaatcttagttcagaagtggcttgtatgacctgttcaggggtcacatgaggtctcgccagtttcctgggtcctcttcagaggccagaaagttctaagttctgagtccccggccagggtcccttaacacctcggcacagaggctgttggcaagtgtagaggctgcctctgtgtgtggtttaagtaaactggaaatgagacattgacgtgctgctcctccagaggtctgcacactccacttcacatgccgttgactctcacagtctaagacttcagggccgggacctttgtccagcctgcacagtagagtgaggctgcctctcccgccaggcattgggatcccatttagaaacggcattcacttcagaaggtactttttaactgctcagtttttgactattttaaatagtttgctgaaaactcctgataacacttgctacatatcatgttttaattgcttgtacagttaacctttaattttatttagtaaagtgtatcaaagtaggacttttttgaattgtaaataggtggttttattaaataaaagtcaatgtaaaattgtt

SEQ ID NO: 75 - DNA, 5567 bp, Homo sapiens
  ref <308>: DATABASE ACCESSION NUMBER: AB037745
  ref <309>: DATABASE ENTRY DATE: 2001-06-18
atggtggaacacgctgcccacaaacatggaaacgaccgttctcagtgggatcaacttcgagtacaagggcatgacaggctgggaggtggctggtgatcacatttacacagctgctggagcctcagacaatgacttcatgattctcactctggttgtgccaggatttagacctccgcagtcggtgatggcagacacagagaataaagaggtggccagaatcacatttgtctttgagaccctctgttctgtgaactgtgagctctacttcatggtgggtgtgaattctaggaccaacactcctgtggagacgtggaaaggttccaaaggcaaacagtcctatacctacatcattgaggagaacactaccacgagcttcacctgggccttccagaggaccacttttcatgaggcaagcaggaagtacaccaatgacgttgccaagatctactccatcaatgtcaccaatgttatgaatggcgtggcctcctactgccgtccctgtgccctagaagcctctgatgtgggctcctcctgcacctcttgtcctgctggttactatattgaccgagattcaggaacctgccactcctgcccccctaacacaattctgaaagcccaccagccttatggtgtccaggcctgtgtgccctgtggtccagggaccaagaacaacaagatccactctctgtgctacaatgattgcaccttctcacgcaacactccaaccaggactttcaactacaacttctccgctttggcaaacaccgtcactcttgctggagggccaagcttcacttccaaagggttgaaatacttccatcactttaccctcagtctctgtggaaaccagggtaggaaaatgtctgtgtgcaccgacaatgtcactgacctccggattcctgagggtgagtcagggttctccaaatctatcacagcctacgtctgccaggcagtcatcatccccccagaggtgacaggctacaaggccggggtttcctcacagcctgtcagccttgctgatcgacttattggggtgacaacagatatgactctggatggaatcacctccccagctgaacttttccacctggagtccttgggaataccggacgtgatcttcttttataggtccaatgatgtgacccagtcctgcagttctgggagatcaaccaccatccgcgtcaggtgcagtccacagaaaactgtccctggaagtttgctgctgccaggaacgtgctcagatgggacctgtgatggctgcaacttccacttcctgtgggagagcgcggctgcttgcccgctctgctcagtggctgactaccatgctatcgtcagcagctgtgtggctgggatccagaagactacttacgtgtggcgagaacccaagctatgctctggtggcatttctctgcctgagcagagagtcaccatctgcaaaaccatagatttctggctgaaagtgggcatctctgcaggcacctgtactgccatcctgctcaccgtcttgacctgctacttttggaaaaagaatcaaaaactagagtacaagtactccaagctggtgatgaatgctactctcaaggactgtgacctgccagcagctgacagctgcgccatcatggaaggcgaggatgtagaggacgacctcatctttaccagcaagaagtcactctttgggaagatcaaatcatttacctccaagcagccagctcctgtcaccatctctctttcagaggactcctgatggatttgactcagtgccgctgaagacatcctcaggaggcccagacatggacctgtgagaggcactgcctgcctcacctgcctcctcaccttgcatagcacctttgcaagcctgcggcgatttgggtgccagcatcctgcaacacccactgctggaaatctcttcattgtggccttatcagatgtttgaatttcagatctttttttatagagtacccaaaccctcctttctgcttgcctcaaacctgccaaatatacccacactttgtttgtaaattatgcccttgcttgtatcttgtttcccaaaatggcccatccgccagagccatagcttcgtctgctcataattcttatagctttggaatgaaaatatttctatcttcttaagtatagaaactatttcctctgtcctctaacttaagggcagaaacagctgggagttttcctcgcatgccctcagctcatgatctcttcaggagagaggctgggtgaggagggtgtcggggttccctggtggataatcttcatagcagcctggatccatttcccctggataaccagctcaaagggagtgaaaatggtagtctgagggcaaggggagcaaggcctgggtaagaaaagccttgaaaagcataaaaagaggccgggcgcggtggctcacgcctgtaatcccagcactttgggaggccgaggcgggcagatcatgaggtcgggagattgagaccatcctggctaacacggtgaagccccgtctctactggaaatacaaaaaattagccgggcgtggtggcgggtgcctgtggtcccagctactcgggaggctgaggcgggagaatagcgtgggcctggaaggcggagcttgcagtgagccgagatcgcgccactgcactccatccagcctgggtgacagagtgagactctgcctcaaaaaaaaaaaaaaaaaagaaaagcacaaagagaggcaacaaggaatgtttttgtttttgagacaggctctcactctgtcacctaggctggagtgcagtggcgtaatcactgttcagtgcagcctcaagctcttgggctcaggctatcctcccatctcagcctctcaagtagctgggactacgagtgtgcaccaccaggctcactaatttttgtgttttttgtagacacggggtttcaccgtgttgcccaggctggtctccaactcctgggctcaagtgatctgtccgcctcggcctcccaaactgctgggattacaggcataagccactgcactcagccttttatttgttttttaaaccacgtagctcattgccttctcttaagtaaatgatagatattctcactgaagccaaaggaataagttcatcaagaaaatgcccaaagccctggtggatacatcctccctatcttttttttaaaccttccactatcactctatgacactgaaaagaaccaggtaagccccaaacccagatgttccagccttatcctctattgggtttacccacagacatagcaaaccctgtcagtgaggaaaattccccatccttgagtgcccccgtcctagaagtttgggccatattatggaacaggggtctcttatttgaaaagagcacaaggaggccaagattttaatggggcactttaggggatacagcccacaatggcatgggcctgaggtggccgtgatgtctgcttctaagcttaacgcatctgctcaggcacagaataaacgtctaggctggccaaaaaaggaactgaatcccaggcccatacgccagcaccagaatcaaaccagtcttcaaggaaggaaggctaggagagtttaacaagattttcactgggcccagcatggtggctcacacctgtaatcccaaggcagaatggtggcttgagctcaggagttcaagaccagcctgggcaacacagtgagaccctgtctctaaaaaatttaaaaataaacaaggtgttcaccaagctgggatacttctcactattaagcccctatctttctctttttttcattctcaattgctttgtgtgataaaaaactaaagagacttctggtccaatttctggcaacatcccttctgaaaggtgagtagagtgggtgtcttctatgcccattttccccaattttacacaaactattatcaatgaacttttaagtacctagaatgggtaaaaccagagcaagactttaaattaccttcttctttcttctactggcagttctgcctccatcactatcaggctagggtgaccttcccttggtcaagccccaattgcccatgatttgtgcctgtgccctttctccagtgaccatttggtgaccagatggtagatatagaaaggggatggcatttgcaagtgactagtctgccacaaaatgctcatctgattagccactgctgccctggcaatggctttgtaagagtcaatgagaactagagccaggctgtggtccctggccatcaacagtgttggtgacggcagggagtccctttggtttaataaatccagtttttctttgggtatccaaattctcccctccttttgtaggagtcaggctctcagaacctgtgtccatgttggaacttcccccagtgtggatgcagatacgcagctcctgagctccagcctaaagtcttctgtagcctcagcaatacttgggcacctgctgtctcactgaatagctttcttttgtgacaaaggccacagacagcccttagactattccggaaacagtaggaaaaattacatatgtctttgacttctttattctgactccactgattttagccataatactttaaggagctactttttactaccccttaccgtgctgacttctgcaggtctgccctgtgacctgtcaggaactcctgagttacgctactggggtcacctgttgctcccctagcaagttaggcatgtcatatatttttaacagctttattgagatataattcacatattatacaattcacctttaaaacatacgattcaatggttttcagcaaactcacagagttgtccgcccacttgagagcaaacacatgttcaattttcttttcctttttttttttgagacagagtcagctttgtcgcccaggctggagtgcagtgccatgatcttggctcactgcagcctccccatcctgggttcaagtgatccttctgcttcagcctccccagtagctgggattacaggcatgcgccaccacgcctagctaatttttgtgtttttagtagagatggggtttcaccgtgttggccaggctggtctcaaactcctggactcaagtgatccacccacctcggcctcccaaagtgctgggattgcaggtgtgagccaccgtgcctggcctacgtgttcaattttctatgaacaaaggctttagtccttgacccagggctaaagtggtctgtccaagctgttgttggtagagggagtatgataaaatgtttaaatctcatttggttaccttgagtcctggaacacgcagtaactgtcatgctatagtcatcatctgtatttggctgggaatacaaatgaagattgtggtgtattcaagcagtagggtttttgcttttgtttttgttttagtgccaacaaaacttttttttgtctgactacattaaagataagactgactatatttatacaacagaaactttgtaatagattttttcagctttgtgaaatcgaattttttttcatcagggctggttggatttcctttttaccctgtaatccaagcgttaatagtttgttagaagatgggttattgcatgtcacttttttttttttgtaaaataaaaacataccttac

SEQ ID NO: 76 - DNA, 5123 bp, Homo sapiens
  ref <308>: DATABASE ACCESSION NUMBER: AB037756
  ref <309>: DATABASE ENTRY DATE: 2001-06-18
atttccatcaaccatgatgaaagtctgctgcctgagtccttagagagcatgatgtatggtaagaaggtgctcagccaagaaccaagctcttttcaggagagcccaagtaccaatactgaatctagaaaagatgttattaccatctcaataagcaaagatgggaactgccagtctggtggccctgaggcagaaatagcttctggccctacttttatgggtagcttagaagcaggaggagtagctcaagcaaacatcaaaaatggaaaacatttgttgatgtctatttcaaaggaaggggagctctgctgcagtgaggcaggacagagacctgaaaacattggccagctggaagccaagtgtttagcttccccttccttgaatccaggaaatgaaagtgggtttgtagatatgtgcagtcttagtgtctgtgactccaaaagaaacctgtcatcagatcagcaattaattgatttattggaaaacaaaagcttagaaagtaaattgattttgagtcagaaccacagtgatgaggaggaagaagaggaggaaaacgaggaggaaaacttagccatggcagtaggcatgggggaaaggccagaggtattgcatctcacggagcccactactaacatctcaagggaaaagaaccaaggcttccaagatgaaaccaagaaaggaagcttagaggtggcaaaccagactcctgggctacagagggctttccccgctccagcagcctgtcagtgccactgcaaacacatggagaggtggatgcatggcctcgagaatgatgaatttgaaatcgagaaacccaaggcttatatcccagatctgttcaaaagtaaaaccaatactatcgccatggagggtgaacccactgctattccatcacagccgtttaaagtgaagcatgagcttttaaaagaaccttggaaagaaagtgcagaggggcaaaacgttttccccacatatcctcttgaaggaagtgagctcaaatcagaagacatggattttgagaataaagatgattatgatagagacggaaactgccatagtcaagattatccagggaagtactctgaagaggagagcaagagctcaacatcgggcatcacaggagacattggggatgagctacaggaggctcgagctcccactattgctcagctgctacaggagaaaactctctattccttctctgagtggccaaaggaccgcgtgataattaaccgcctagataatatctgccacgtggtgttaaaggggaagtggccctctagccagcagtatgagccctcaggcacactgcccaccccggtattaaccagcagtgctggttctcgaaccagcctctcagagccggaagcagcagaacacagcttcagcaacggcgcagcattggcggcccagatccacaaggagagcttcttagctccagtattcacaaaggatgaacaaaagcacaggcgtccctatgagtttgaggtggagagggatgcaaaggctcggggcctggagcagttctctgccacccacgggcacacccctatcatcctcaatggctggcatggggagtcagctatggacctctcctgctcatcagaggggtccccaggagccacatcccctttcccagtgagcgccagcacccctaagattggggctatcagttcacttcagggagcccttggcatggacttgtctgggattctgcaagctggcctgatccatcctgtgactggacagattgtcaatggaagcctcagaagagatgatgcagccacgaggaggcggagagggaggcggaaacatgttgaaggagggatggacctcatctttttgaaggagcagacacttcaggcgggaatcttggaagtccatgaagacccagggcaggccaccttgagcaccacacaccctgaggggccagggcctgccacctcggctcctgagccagctacggcagccagcagccaagccgagaaatccattcccagcaagagtctgcttgactggctaaggcagcaggctgactactccttagaagttcctggctttggggcaaatttttcagacaaaccaaagcagaggaggccacgctgtaaagaacctggaaaattagatgtcagctccctgagcggggaagagagagttcctgccatccccaaggagccaggactgagggggtttcttccagaaaacaagttcaatcacactctggctgagcctattcttcgagatacgggcccccgcaggagggggaggcggcctcggagcgaactcctgaaggctccttccattgtggcagactctccctctggaatggggccactgttcatgaatggactgattgctgggatggacctggtaggacttcagaacatgagaaatatgccaggcatccccctcaccgggctggtggggtttccagctggctttgccacgatgccaacaggtgaagaggtcaaaagtaccctgagcatgctgcccatgatgctgccaggcatggctgctgtgccccagatgtttggtgttgggggactcctcagtccacccatggcaaccacctgcacttccactgctccggcgtctctatcaagcacaacgaaaagtggtacggcagtgactgaaaagactgcggaagacaagccgagtagccatgatgtgaaaacagacactttagctgaggacaagcctggtccaggtccattttctgatcagtctgaacctgcaataactactagtagtcctgtggcttttaacccatttctcatcccaggagtatctcctggactcatttacccatccatgttcctctcccctggtatgggcatggctctgccagccatgcagcaggccagacactcggaaatagtaggtctggagagccagaagaggaagaagaagaagacaaagggggacaaccccaactcccacccagagcctgctcccagctgtgaaagggagcccagcggtgatgagaactgtgccgaacccagtgcccctttgcccgcagagagagaacatggggcacaggctggggagggggcactcaaagactccaacaacgacaccaattagaacttttttcatttaagaaattattgtgacttgtaagtttcttatcccataaaggtttgttacttccctcacttcacctccataagaacctgtgtttccataagtaagattacgtacctgatttcctgtctgagaactatggtaacagatgttaatagttgcagggtctcaccacttcattagataagtgttgtctacctagtctaggaggcacagaattctcattctgttatccagttcattccagcaatcatagttaatacagtacttggtgacacgccctacccccttctcttccaagtttcccactcacttgaggaggaaaaatggcaaaagaaagctgtctagggttttaccattgaagggtggaagaacagagacaaagaggagctctttttctgtgagctgggttgcacaggaagaatgtcacagggaaccaaaaagcacagaaaaaggaagtgctggtgcatatttttgagttaaaatatttccctattttatcatgattactaagtgagtagtatagacagaagtatataactaatggttgaaaatacatatattcatttctttataaaaaacaaaaaccttaccggtagtaatataatttcccccttggtggtttttcagacacctgcagcaagaagaaatactgactgactaggcattattttctatacatccctctcaccagtgaaaagattcctcttgctgcgagaaagctttacccaccatgagttattgctgtcgacgggggtggggcaaggacccgcgctccgtagagctacacgctgcttcacaagcacacggccagcgctctgctctcacctggttcgcttacagatttctctagccattaatttgcctctctgtgtttaaagagcaccaggaccgaatggattttcacttcaggctttccttcaccaagaataaggttctttctggagcctgcaagaagacagttgcccaacactttgacacttgctagtaggtcctttgatcaagagtgtctgaggctgtcaaatgtgtgccaccctttataatacagctatgaaaagttacttctccattaatttctccattctgtttatatcttacagttggacccaaattccaaattatcagttaatcgaaactacattgcaagtcaacattattttctcttcttcctcagcttctccatgtttaggaactgagaaagaacctgcctaagcagcacttccccatgtcctttcaccttcatgttaacgtcccttctgatggtctcactcttcacaggtagttcacactctgagacttgaagtaagctcatggttcagtactctgggggcgcagggctgcgcaggacccttggaaatgttgcaagtgttactagtaccagtttcactttttgttgtcacaatttactgtattttttactttttctgttacagttttgctaatttatcagaaggtccaaaagtctgacataactatttcattttgcattatttatttatgatgcttttttcattgtcttttatacatttgggattataaattatgtaaatgttaaaatgagcatctcaaagaagtctgttaaatcatgactgaaaaaaatcaatcagatgtatcttcaaaaagtggagtcccagttttatgaatcagagatataaaccagaaattctataactgatcatagaagaagaatccagtaattgaacaaatcctatttaatgacatccttgtagcatagatggtctataatgctgaccacagatttcttagaaatgctgctctctctatttaactaacattttgttcagttttgcctccagtggaagcagaaagggttttttcagctgttaaatcctaaaaatcaatataatttatttatgtaagaaaaataactcaatcaatatatttttgaaccttttaagtactaattttctttttatcacgtagaaaaaaaaatgtatttgccctaaatccttaaaatacaaatgctataaaaattcctgtatcttgaaagccttactgcaaatgagtattatagacatccc

SEQ ID NO: 77 - DNA, 4135 bp, Homo sapiens
  ref <308>: DATABASE ACCESSION NUMBER: AB037765
  ref <309>: DATABASE ENTRY DATE: 2001-06-18
tttttacatgccaacagtaaactctttaccagaactgagtcctcagaaatattttagtacattgcaaccaggaaaagcctctttagcttatttttgtcaagctgattccccaagaacatctgtatttcttgaagaactgaatgaggctgttagacctctgcaggactatggaatttcagttgccaaggttaattgtgtcaaagaagaaatatcaagatactgtggaaaagaaaaggatttgatgaaagcatatttattcaagggcaacatattgctcagagaattccctactgacaccttgtttgatgtgaatgccattgtcgcccatgttctctttgctcttctttttagtgaagtgaaatatattaccaacctggaagaccttcagaacatagaaaatgctctgaaaggaaaagcaaatattatattctcatatgtaagagccattggaataccagagcacagagcagtcatggaagccggttttgtgtatgggactacataccaatttgtcttaaccacagaaattgcccttttggaaagtattggctctgaggatgtggaatatgcacatctctacttttttcattgtaaactagtcttggacttgacccagcaatgtagaagaacactaatggaacagccattgactacactgaacattcacctgtttattaagacaatgaaagcacctctgttgactgaagttgctgaagatcctcaacaagtttcaactgtccatctccaactgggcttaccactggtttttattgttagccaacaggctacttatgaagctgatagaagaactgcagaatgggttgcttggcgtcttctgggaaaagcaggagttctactcttgttaagggactctttggaagtgaacattcctcaagatgctaatgtggtcttcaaaagagcagaagagggagttccagtggaatttttggtattacatgatgttgatttaataatatctcatgtggaaaataatatgcacattgaggaaatacaagaagatgaagacaatgacatggaaggtccagatatagatgttcaggatgatgaagtggcagaaactgttttcagagataggaagagaaaattacctttggaacttacagtggaactaacagaagaaacatttaatgcaacagtgatggcttctgacagcatagtactcttctatgctggttggcaagcagtatccatggcatttttgcaatcctatattgatgtggcagttaaactgaaaggcacatctactatgcttcttactagaataaactgtgcagattggtctgatgtatgtactaagcaaaatgttactgaatttcctatcataaagatgtacaagaaaggcgagaacccagtatcttatgctggaatgttaggaaccaaagatctcctaaaatttatccagctcaacaggatttcatatccagtgaatataacatcgatccaagaagcagaagaatatttaagtggggaattatataaagacctcatcttgtattctagtgtgtcagtattgggactatttagtccaaccatgaaaacagcaaaagaagattttagtgaagcaggaaactacctaaaaggatatgttatcactggaatttattctgaagaagatgttttgctactgtcaaccaaatatgctgcaagtcttccagccctgctgcttgccagacacacagaaggcaaaatagagagcatcccactagctagcacacatgcacaagacatagttcaaataataacagatgcactactggaaatgtttccggaaatcactgtggaaaatcttcccagttatttcagacttcagaaaccattattgattttgttcagtgatggcactgtaaatcctcaatataaaaaagcaatattgacactggtaaagcagaaatacttggattcatttactccatgctggttaaatctaaagaatactccagtggggagaggaatcttgcgggcatattttgatcctctgcctccccttcctcttcttgttttggtgaatctgcattcaggtggccaagtatttgcatttccttcagaccaggctataattgaagaaaaccttgtattgtggctgaagaaattagaagcaggactagaaaatcatatcacaattttacctgctcaagaatggaaacctcctcttccagcttatgattttctaagtatgatagatgccgcaacatctcaacgtggcactaggaaagttcccaagtgtatgaaagaaacagatgtgcaggagaatgataaggaacaacatgaagataaatcggcagtcagaaaagaaccgattgaaactctgagaataaagcattggaatagaagtaattggtttaaagaagcagaaaaatcatttagacgtgataaagagttaggatgctcaaaagtgaactaattttatagggctgtggtttccaaaatttttttggcatgatagacttaatttatttccttaaagaataatattaaatcatttcaagtttgcagactagtgccatccaatagaattataatataagtcacatattttatttaaaattttctagtaactacattaaacaaagtaaaagtgagcagggcaaaataattttgatattacttttcacccagtagtatacccaaaatagcgaaatatagaaattattaatgagatattttacatccttttttgtaccaagtcttctaaatgcagtacatattttatacttactgcatttcttacttccgagtagccatatttcaagtgttcattgccacatgtggcctgtgactactgtattggacagttcagtactagacaaaaactagcataattaacttagttctagccatgatttctatttggattaaaattaaactctaatcacagttaactccacagtgcattcatgcagctgacagttatatttgttttattggagtcatgatattaaaatcagcgtttgtcaacctcaggggatatttagcaattgtcgggagacatttttgatgtcatgactagggcagttattgacatttagtgagtagaggccatggatcctgctaaataacctgcattggacagcgccccacaacaaagaattatcctgcccgaaatggtagtcgtgccaaggctgagtaaccttgtgttaaaagtaacctgtggcagactaggtttccagaatttcctggttctgctcacgtatcatgtttgaaaaaattttggctattaaagatatgtattagatggtcttatcctgattattacctggatacaacttgatcttttctaatattttcagaaagtgatgggataaccctagaagaggactcagaatgatatttatattttaagtgagtcttaaaacctcctcttatttctacaagttatatggctaaatttcagattgaacagggattcagcattctgccatctcctcatggaaagagaggctccctcatctgaagcgtctctgaaatctacccttgcaagcttcagacaaatcagttgatctccctgagccacacggcctcattctgtgagggagggaaagattagccaaagagttaattttcattccaaatcacttagctgttagactgatctgtttgtagcagttgtttgtctcatttttgctctgtgcattttttgagacatttgttgagaatattctatttggtgctctactgtatttttctttttaatatctacttgatatcttgttctttaaattttcttcacatatggtttgcctgatacaactgatttttataactgaaatttaaggaatctaacagctaaaactcagtaagtgcatctatttccttataacatagacccgttgctactctcagcaccctctcctcaattttttttcctgtagcatgtgatgcctgattaaactcattttcatttgcttttatttctaatatgggaacaatgagagtgaactctaaatataggttgtagtaataaaacatcattagcctaattattagaaaatgctaattaagtaccagcacatagaaacatgaaattgcttagtcattgtacctttgtcagcaattttgacagtcattaatgtttgtcataattttaaataaagtgtctgggtttcagaataccttc

SEQ ID NO: 78 - DNA, 4022 bp, Homo sapiens
  ref <308>: DATABASE ACCESSION NUMBER: AB037778
  ref <309>: DATABASE ENTRY DATE: 2001-06-18
gcagcgtcaagtcagagtacacggacccctggggttattacattgactacacgggcatgcaggaagatccggggaacccggcagggggctgttcaaccagcagtggggtgcccactgggaacgggccagtccgccatgtccaagaagggtccagagccacaatgccccaagtgcccggtggttcagtcaaaccaaagatcatgtcaccagagaagtcacacagagtcatttctccatccagtgggtattccagccagtcgaatacacccacagcactcacccctgtgcctgtgtttttaaaatcagtgtcaccagcaaacgggaaggggaagcccaagcccaaggtaccagaaaggaagtcctctctgatatcttcagtatccatttcctcatcgtccacttctctttcttctagtacttctactgaaggaagtggcactatgaagaagctggatccagccgtgggctctcccccggctcctcctcctcctcctgttccctctcctccattcccttgtcctgcagacaggtctcctttccttcctcccccacctcctgtcacagattgctcccagggctctcctctgcctcactctcctgtgttcccccctccgccgccagaagctctcattcctttctgctccccacctgattggtgcctttctcctccccgccctgcactgagccccattcttccagattcacctgtgtccttgccattgcccccacctctcttaccttcctcggaacccccacctgccccacctcttgaccccaaattcatgaaagacaccaggccgcctttcacaaattctggccagccagaatcctcccggggatccttgaggccgccttctaccaaggaggagaccagcaggccccccatgcccctgataaccacggaagcattgcagatggtgcagttgaggcccgtgagaaagaactcaggcgctgaggcggcacagttgtctgaacgaacagctcaggaacaacgaactccagttgctccacagtaccacttaaagccatctgctttcctgaaatcccgaaatagcacaaatgaaatggagagtgaaagccagcctgcctctgtgacaagctcgcttccgacgcctgccaagagctcgagtcagggtgaccatggcagtgcggctgagcgtggtggccctgtgagccgcagccctggagctccaagcgctggggaggcagaggctcggcccagccccagcaccaccccactcccagactcttcacccagcaggaagccaccccccatttccaagaagcccaaactgttcctggtggtaccacctccgcagaaagattttgcagtggagcccgcagagaacgtgagcgaagccctccgagctgtgcccagccccacgacgggagaggagggctctgtgcacagcagggaggcaaaagagagttctgcagcccaagctggctctcatgccacgcaccctggcacctcggttcttgagggaggagctgcaggatccatgtctcccagcagagtggaagccaatgtccccatggttcagcctgatgtctcaccagcccccaagcaggaggagccagccgagaacagtgcggatactgggggcgatggggagagctgcctatctcaacaggacggagcagctggggtgccggagaccaacgcagccggttcatcctcagaggcctgtgacttcctcaaggaagacgggaatgatgaggtaatgacccccagtcgacccaggaccacagaagacctttttgcagctattcacagatccaaaaggaaagtcctcggccgtagagattcagatgatgaccactcccgaaaccattctccctccccgcccgtgacacccaccggcgctgccccaagcctggcctctccaaagcaagtggggtcgattcagagaagcatccgaaagagcagcaccagcagtgacaacttcaaagctctgctgctgaaaaagggcagtcgttcagacaccagcgcccgcatgtctgcagcagagatgctcaagaacacagaccctagattccagaggtcgaggtcagagccttccccagatgcccccgagagcccgtcaagctgctccccaagcaagaacagaagggcgcaggaggagtgggccaagaacgaaggcttgatgcctcggagtctgtccttttccggccccaggtacggccgcagccgaacgccgccttctgccgccagcagcaggtacagcatgcggaaccggatccagagcagccccatgaccgtcatctcggagggagaaggggaagccgtggagcctgtggacagcatagcccgcggggctctgggcgctgcggagggatgttccctggacggactggcgagggaggagatggacgagggcggcctgctctgtggggaggggcctgccgcctccctgcagccccaggcccccggccctgtggatgggacagccagtgcagagggcagagagccctccccacagtgtggcggttctctgagcgaggagagttagggccaagaacgtaactctcccaggtgacacggggggagacgagcaatgcagcactctaggaagcctgctaggcgcccttccctggctcacccggggagcccactctgcttctgtgctgtgggccctggggttgccagccctgcagtgtgagtgaacggttatttaggactcacctggcacttgccctgtggcttaagaacaagtagaagcttaaacttctgaaagtgcttcccggggaagattttttttttttttttttttttttgctaaatgctgggtgtgtatgtgtgcattttccacactttttaatttttaaaaaatacacatatacacaaacaacatgtacagaaatagaagaaagcaagccagacttaagcttggtagagtaacggagtcctctggtctaggcggtaattgctttcagagaattacgtttatagaaatcagcgagttttgtaagaaaggagaagatgttacttcaagaaagaggcagtagagttgctggttcttaatgcacagaacacacagatatatgcacacgtgtgctgctgaggtgaggcaggtctggtgagcacggagaggctgggaaggggctaagtgactaattggttcaggtacttttttctgggggaggtagactttgcttcttttttgtaaaaatgacaaacgtagaagtggcaatgctgtaacctggtgcctgctgctgtgcagccacatacacacaattgtagcctgatttttagaagtgtgggtaattttttaatgaatttcctccttgagtagcagctgaggtcattgacaactgaagtgatggtgtggacatagagagaggggaagggttggaaaggagtaagtgatacactgctggaatttgtttcctgcctatgaaataaaattatttttcagaattaaatttgaaaacttgcactacagaactatgggtggagcttttccttttacaacagtttttttttttttttttttaaccagagtttaaacttccattaggcaatttcctgtcacttgaaatgtcaacatttgctaacttttggatatccttttggttacaccaaagaaaaagttatggctattttttttttccttgaactgcctacagtatcatgtcctaattcagaaagatttatcaaaatctattatatattatcttactttgaagaaaatgctgaatagctcttgttagtcaaataaactgataaaaattggtagggcctggctatcaattagccctgggaaatgaatttttagattaaaaaggtttttttgcatcatttggtttgtgcatttttatatttgtttataaataattgagttgctaattacttctaatcttctccaatcagattttcaacaattttagacatgggacacacgtgtgtgaagtctttattttaatgtaataatctcattacccccacccttactcccttaacttccatgtacttagactcctttatttgttaaataaactagagtattgtcttcttcatt

SEQ ID NO: 79 - DNA, 3863 bp, Homo sapiens
  ref <308>: DATABASE ACCESSION NUMBER: AB037791
  ref <309>: DATABASE ENTRY DATE: 2001-06-18
gcggttgccgcaggaaggctagccagagggtaattacacagcattttgaaagcgaagcagaagccgtagaatcagcggcgagcctgttgaaagaacccacaggtgcatttcacagcactctgggcgaaaattggatgtgaaaatgaagccagaccgagatactctggatgaatattttgaatatgatgcagaggagttcttggtctctttggccttgctgataacagaaggacgaacacctgaatgttctgtaaaaggtcgaacagaaagctttcattgccctccagcacagtcttgttacccagtaactaccaaacatgaatgtagtgacaagctggcccagtgccgccaagccagacgaactaggtctgaggtcacattgttgtggaagaataaccttccaatcatggtggaaatgatgctactaccagactgctgctacagcgatgatgggcccaccacagagggaattgatctaaatgatcctgcgattaagcaagatgcattattattagaaagatggatcttggagccagttcctcgacagaatggtgaccgatttattgaagagaagacgcttctgttggctgtccgctcatttgtgtttttttctcagttaagtgcatggctgagtgtttctcatggtgctattccacgaaatattctctacagaatcagtgctgctgatgtagacctacagtggaatttttcacagactccaattgagcatgtgtttcctgttcccaatgtttctcacaatgttgccttgaaagtcagtgttcagtccttgcccagacaatctaattatccagttttgacgtgcagtattcacactaatattggcctttatgagaaaagaattcaacaacataaacttaaaactcatcagcaccataacccaaatgaagcagaacaatgtggtacaaacagttcacagcgtctgtgtagcaaacaaacttggaccatggcacctgaaagtgtgttacatgcaaaaagtggcccaagtccagaatatactgcagctgtcaaaaatatcaaactatatccaggcactggcagtaaatctgaccatgggacatctcaagccaatattctaggctttagtggtataggtgatataaaatcacaagaaacatcagtgagaactttaaaatcattttcaatggttgattccagtatctctaaccgccagagtttctggcagtcagctggtgagactaaccctttaataggctctttaattcaggagcggcaagaaatcattgcaagaattgctcaacatttgattcattgtgatccaagcacttcacatgtttctggacgtccatttaatactcaagagtctagttcactccattcaaaacttttccgggtttcacaagaaaatgagaacgtgggaaaaggtaaagaagctttctccatgacttttggtagtccagagtttagttccccagaagacaccaatgaggggaaaattcgactaaaaccagaaactcctcgaagtgaaacttgtatttctaatgacttttattctcatatgcctgttggagagactaatcctttgataggctctttactccaggagcggcaagatgttattgcaaggattgctcagcacttggagcacattgatccaacagcatcacatatcccccggcagtcattcaacatgcatgactccagttcggttgcatctaaagtgtttaggagttcatatgaagacaaaaatttgttgaagaaaaataaggatgagtcctcagtttccatttctcacacaaaatgttccttgttaggagacatcagtgatgggaaaaacttaatacctaataaatgttttacttcttttaaaaataatagtaaagaaaagtgttctttgaaacatcaaacaagaaatcagtgtcagaacaatcctagtgaaatcatccaaagtacgtatcaggagacacagaacaaaagttctagtttatcaacttcctcaattttgtctcagcacaaagaaaataacttagatttgacaagcagattcaaggagcaagaaatgagcaatggaattgataaacagtattcaaattgcaccactattgacaaacagatttgtacaaataagtataaggaaaaaataataaatgagaactataatccaaaattctttggcaatcttcagtctgatgattccaaaaaaaatgactcaaaaataaaagttactgtgttggaaatgtctgaatatttgaacaaatatgaaagcatgtcctcaaataaagactcaaaaaggcctaagacatgtgagcaaaatactcaacttaatagcatagagaattatctcaataaagataatgaaggtttcaaatgtaaaaagtcagaccaattaaaaaatgaacaagataagcaagaagatccaactaatgaaaaatcccaaaactattctcagagaagaagtataaaagactgtttgtctacatgtgagcaaccaaaaaatacagaggtattgaggactacactgaaacattcaaatgtgtggcgaaaacataattttcattccttggatggaacttcaaccagagcctttcatcctcaaactggattgcctcttctttcaagccctgttcctcaaagaaaaacacaatcaggttgctttgatctggattcttcattactacatctgaaaagcttctcatctagaagtcctcgaccatgtttaaacattgaagatgatccagatattcatgaaaaaccatttttgagttctagtgctccacctataacaagtcttagtctcctaggaaattttgaggaatctgtcttgaactatcgtttcgatcctctcggcattgttgatggttttactgccgaggtaggggcaagtggtgctttctgccccacacatttgactcttccagttgaagtgtcattctacagtgtttcagatgacaatgctccctctccttatatgggtgtgattactttagagtcccttggtaaaaggggttatcgagtacctccttcaggaacaatacaagtgaccttatttaatcctaataagactgtggtgaagatgtttgttgtgatatatgatttacgagatatgccagccaatcatcagacattcctacgacaaagaactttttctgtacctgttaaacaagaagtgaagagaagtgttaataaagagaacatccgacacacagaagaacggttattacgctacctcatacatctgaggttccagagttctaaatctggaaagatctacctccatagagacgtacggctcctgttctctagaaagtcaatggaggttgatagcggtgctgcatatgaactcaaatcttacactgaatcaccaacaaaccctcagttttcaccaagatgttgataaggagtgatgatttaaagtatttactcagtacccaagtttgcaagtaaaaattagcatagaatggagtgtaccaaattaacaatcaggagagtggattctctcctgttatcctggaccagtttttatgaaaggattcctgaaatgaaatccatatattccatgtagactggaaaaactcatgtcctaatcctttttgtactgttgaaaccacttcattggacatgttgcaatagcaaaacccccagttagattagtgtttacacattttctcagttatttaatatttaatgttttccttaatactcaagtgatgtttgtctctagtgttctaatgtagcacaaatcctatgtaaaatcatactatgtatttttgacattaatgttgaaatcaaatatatgcacaagtctttaattttgtgtaatgtgttaagtgctgttcatttaagttattgaaaatgagaataaaatgttgagcttctttaaaagt

SEQ ID NO: 80 - DNA, 3771 bp, Homo sapiens
  ref <308>: DATABASE ACCESSION NUMBER: AB037793
  ref <309>: DATABASE ENTRY DATE: 2001-06-18
cagtctgctgagtctaggctgttttcctcagcactgactgcatggcagctgtgtgctcagcccgcacaggcaggctgtgttgtggggtccagaggggctgatacatgtaaagttgatggaatatcctgctcaatggtgaatacgacctaagtgttagctgctgttatctcctttaatccatacaagaaccctctgagggaggtattatccccattttacagaggaagaaactgaggcccagagcggggaagtggcttgctctgggtcacacagcaaggacttgctggagccaaagcttctggcccaggggcagtgcccttccaggcagaagcagctgaaagccttgttctggcattgcagcccagtgtggaggggcgagacttggggtgctgagagggcctggctcccttcttggtgggctgggagcctcagtgtctggcaggtggctgtgctgggcttgtgcatttcccagccatgtctggttcagcccacagaccccggggctgccctttgcaggtgtgagtcaatgtgggaacccaggacattacggatagcccctgggctgccctcaccccagcattttgggtgtcccttgtccctgtgtcactgtcactcccctcaccaggatgattgactgggtgtcctggcccctggggaagaatattgacaagtggatcattgcactgctgaagggcctggctgctgttaagaagttcagcatcttgatcgaggtttcgctcaccaaaattgagaaggttttctctaagctgctgtaccccatcgtccggggagctgccttgtctgtgctcaagtacatgctcctgaccttccagcactcccacgaagccttccacctgctcctccctcacatcccccccatggtggcctctctggtcaaggaggactcgaactcggggaccagctgcctggagcagctggcggagctggtccactgcatggtgttccggttcccgggcttcccggatctgtatgagcctgtcatggaggccatcaaggacctccatgttcccaatgaggaccgcatcaagcagctgctggggcaggatgcctggacttcgcagaagagcgagctggcgggtttctatccccggctcatggccaagtcagacacgggcaagattggtctcatcaacctgggcaacacatgctatgtcaacagcatccttcaggccttattcatggcgtctgacttcagacattgtgtgctccgcttgactgagaacaactcacagcccctgatgaccaagctgcagtggctctttggcttcctagaacacagccagcggcctgccatttccccagagaacttcctctccgcatcctggacgccctggttcagccctggcacccagcaggactgctcggagtatctgaagtacctgctggatcggctgcacgaagaggagaaaacgggcacaaggatctgccagaaactcaagcagtccagctcgccctctccgcccgaggagcccccggccccaagttcaacctctgtggaaaaaatgtttggaggcaagatagtgactcggatctgctgtctctgctgcctcaacgtctcctcccgggaggaggccttcacggacctctctctcgccttccctcctcctgagcgctgtcgccgccgccgcctgggctctgtgatgcgccccacagaagacatcacagcccgggagttgcccccaccaaccagtgcacaggggccaggcagggtgggtcctcggaggcaaaggaaacactgcatcacagaggacaccccccccaccagcctgtacatcgaaggcctggactccaaggaagctggtgggcagagcagtcaggaggaaaggatagagagggaggaagaagggaaggaggagagaacggagaaggaagaagtgggggaggaggaggaaagcaccagaggggaaggagagagggagaaagaggaggaggtggaagaggaagaagagaaggtggagaaggagacagaaaaggaggctgagcaggaaaaggaagaagacagcctgggagcggggacccacccggatgctgccatcccctccggggagcggacatgtggctctgagggctcccgctccgtcctggacctggttaactacttcctgtcccccgagaagctgacagcagaaaaccgctactactgcgagtcgtgtgcctccctgcaggatgccgagaaggtggtggagctgagccaagggccgtgctacctcatcctcacactgctgcgcttctctttcgacctgcgcaccatgcggcgccgcaagatcctggatgacgtctccatccccctgctgctccgcctgccactggctggtggccgtggccaggcctatgacctctgcagtgtggtggtgcactctggagtgtcttcggagagtggtcactactactgctatgcccgtgagggcgctgcccgccctgccgcttctctgggaactgccgataggccagagcccgagaaccagtggtacctgttcaatgacactcgggtgtccttctcttccttcgaatctgtcagcaacgtcacctccttcttccctaaggacacagcctatgtgctgttttaccggcagcggcccagggaggggcccgaggctgagttgggctcttctagagtccggacagagcccaccctgcacaaggacttgatggaagccatttccaaagacaacatcctttacctacaggagcaggagaaggaggcccggagcagggcggcctacatctctgcactccccacatctccgcactgggggaggggctttgatgaagacaaggatgaggatgaaggctctccagggggctgcaatcctgcaggtggcaatggtggtgacttccacagactggtcttctaatgtgaacctgctgccaacctgaccccttccctccaggagccaggtagggcctgagggaagctgtggaggcaggccctaccaagaggaaggatggtacagctcatggcaccttagtcctcagcctgatgaagggtacacagagattctctcagatatggaagtaagacctaagtccctttcattggggatcagtcccattaaaactttacacccaagtgtcctggttaacttgaagcagccgagatgggcacacacgggtctttgcctccccctccttccctagcaggctccccatgcgggaagatctgatgatgttcaggaaacaggctagacctcagctccaatgttttgacatcaagtactattttccttccgactgctgtacggtataaagcacagcaggatccaagccttgcacaaaggggtggggggggcagtgtctcctctggctgtcctgtttgtttgtttctcatatgggggtggggggtacctgcactgtctgtacctttctgagaagaacagagaccgagacctgcccccttaccaagcgccactgcatggtttgggggggggggggcggggggctagcttctcacagcaggaggcctttgcccccacagcccctccacgcctgcctcagggcctgagaagccaccacttgtatcccccttgtggttagagtcctgattttactgcaaaggtgttcatgttccttgtgaagtgtgggctcttaggaagcctgtgggctcctctgagcagttggcctttgtagctgcaacagcagccacctgcaggttgggtgaagtgccctgacactgctgtagcccccttctaacttctaaccgaagacaagacagacacccatgttcataaataaataaaagtaagcctaagc

SEQ ID NO: 81 - DNA, 4052 bp, Homo sapiens
  ref <308>: DATABASE ACCESSION NUMBER: AB037802
  ref <309>: DATABASE ENTRY DATE: 2001-06-18
ggccaccgcggcaacctcacccgcgctgaagcggctggatctgcgcgaccctgcggctcttttcgagacgcatggagcggaggagatccgcgggctggagcgccaggttcgggccgagatcgagcacaagaaggaggagctgcggcagatggtgggcgaacggtaccgcgacctgatcgaggcggccgacaccatcggccagatgcgccgctgcgccgtggggctagtggacgccgtgaaggccaccgaccagtactgcgcccgcctccgccaggccggctcggccgcgccccggccaccgcgggcccagcagccacagcagccatcccaggagaagttctacagcatggctgcccagatcaagctactcttagaaattccggagaagatctggagctcgatggaagcctctcagtgtctccacgccacacagctctacctgctctgctgccacctccacagcctgctccagctggattcttctagttcccgatacagtcccgtcctctcccggtttcctatactcatccggcaggtggcagccgccagccacttccggtcaactattctgcatgaaagcaagatgttgctcaaatgccaaggtgtgtctgaccaagctgtggccgaggccctgtgctctataatgctcttagaagagagttctcctcgccaagccctcacagacttcctgctggccagaaaggcaactattcagaaacttctcaaccagccacaccatggtgctggtatcaaggctcagatttgctcattagtggagttgctggccaccactctgaagcaagctcatgcccttttctacactttgccagaaggactgctgccagatccagccctgccatgtggcttgctcttctctactctggagaccatcacaggccagcatcctgccggaaagggcactggtgtcctgcaggaagagatgaaactctgcagctggtttaaacacctgccagcatccatcgtcgagttccagccaacactccgaacccttgcacatcccatcagtcaggaatacctgaaagacacgctgcagaaatggatccacatgtgtaatgaagacattaaaaatgggatcaccaacctgctcatgtacgtgaagagcatgaagggtctcgcgggaatcccggacgccatgtgggagttacttaccaatgagtccaccaatcacagctgggatgtgctatgtcggcggcttctggagaagccgctcttgttctgggaagatatgatgcagcaactgttccttgaccgattacagactctgacaaaagaaggctttgactccatctccagtagctccaaggagctcttggtttcagctttgcaggaacttgaaagcagcaccagcaactccccttcaaataagcacatccactttgagtacaacatgtcgctcttcctctggtctgagagtcctaatgacctgccttccgatgcggcctgggtcagcgtggcaaaccggggtcagtttgccagtagcggcctctccatgaaagcacaagccatcagcccttgtgtacagaacttctgttctgccctggattctaagctgaaggttaaactagatgacctcctggcttacctcccctctgatgactcatcactgcccaaggacgtttctcccacacaggccaagagttctgcctttgacagatacgcagatgcggggaccgtgcaggagatgctgcggactcagtccgtggcatgcatcaagcacatcgtggactgcatccgggcagagctacagagcattgaagagggtgtgcaagggcaacaggatgccctcaacagtgccaagctgcactcagttcttttcatggccagactctgccagtccctgggagagctgtgcccccatctgaagcagtgcatcctgggaaaatcagagagctcagagaaaccagcaagggagtttagggctctgagaaaacagggaaaggtgaaaactcaggaaatcattcctacacaggccaagtggcaagaggttaaagaagtactcctccagcagagcgtgatgggctaccaggtctggagcagtgcagttgtgaaagttttgattcatggattcacccagtcattacttctagatgatgctggctcagttctggccacagccaccagctgggatgagctagaaattcaggaggaggcagagtctggcagcagtgtcacatccaagatccgactccctgcacagccgtcctggtatgtacagtccttcctgtttagtttatgccaggaaattaatcgggttggaggccatgccttgccaaaggtgacattacaggagatgctgaaaagctgtatggttcaagtagtagctgcctatgagaaactctccgaagaaaaacagattaagaaagaaggtgcatttccagtcacccagaaccgggcgctgcagctgctttatgatctgcgttacctcaacattgttctgacagccaagggtgacgaggtgaagagtggccggagcaagccagactccagaattgagaaagtgactgaccacctggaagccctcattgatccatttgacctggacgttttcacgccacacctcaacagcaaccttcatcgcctggtgcagcgaacttctgttctgtttggattggtgactggtacagagaatcagctcgccccccggagcagtacgttcaactcccaagaaccccataacatcctgccactggcatccagtcagatcaggtttggacttctcccactgagcatgacaagcactcgaaaggctaaatcaaccagaaacatcgaaacaaaagctcaggttggtgccaagagcaagaggctcatccgtggatgggtccccacctcccaccgagccacccatgatcagctcccttttaaataactgattaagaactgaatgacaaaatgcactaatgctgcttttaatggcggcgcaatagagaagtacaaggttttactagcttgagctactagaaggtgtaaaagatgcccgctgacactaccaagtagcctcttaatagaaatgtagaaaatatacaggacagggtggagatgagctcttgaatttagtagggtgaaagagttaactgccaacccggcactatcattgtacttgtttggagaaaatctgttttgttctggtgatgatggttttatcttcccttttagttgggtgggaagtaacagaaaatttgtttccccaaaagtttgacattttcttgttaatacacgtttcatttcagtacgatgccaactgttaagcctgcaggaatcctcctgggtatttctgaattgtgctgtgtgcatgtgtgtttgaaagctcaaacagcttgtcttcttacagcatcgagttgtttgctttattgttagacacaatattagcagtgtatcctttccgtattccctaccatcgaacccattaagatctaaaatccttgtcaagtatctggctttaaaagttgggagatggtagtttaaaaaaaaaaaaaagctcttgcaaaaaccatccagtccctaagcatgggctatgttgcagcctcttccagaacagtttccactgcagtgatctttcagttctgcccacattaggttagcaggctgtggagagaagtgcctgtgtctacccttttcccaagacagtcctcatttccaaattctagttttgtcacaaaggctcatgctgttccgtgtcctcttcaaatctggaccgacagcaaagtcctctgactagagccatcgtgcttctcagctccgcttgtgtgtgccgtgtggactccgagtggcgtcgcgcggagggcgagtgggcaggagggctcaggccaactctaaggcacttttctctacatccaatggcaggttgtccccccggcacgctccacagctggtgacccgacagttcctggctccttgttcagacagcttgtcagtgaagaagacaacacgtctgcaccttcattattcaaacttggctggctctctagtatgactaagtaacatggcaacacatctgtctctccctaaataaatactaccacattatttcttct

SEQ ID NO: 82 - DNA, 4193 bp, Homo sapiens
  ref <308>: DATABASE ACCESSION NUMBER: AB037806
  ref <309>: DATABASE ENTRY DATE: 2001-06-18
agcagcgctcatggcgaagaggcttaaggccacaaaaccgtgggacagcaggaggaagagaagccaggtatctccactccagctgccctgcctcagactcctcagtttcgcacgtgaggatcgtcttgcaggcactgactggagatggaatcctaaagcataggtgaagcggaaatcctccttcagggagagcccactgaggaagccagcggctagcacgaggcaggacaggatacctccctcttcgcccacggcggcctctctgtcatagtagccaccgttctgccactcatgcagctttctaagacacctctcggttccccagcgctttcagtggggcggccggccactcccgagggttgcaagaggaggcccggggtgctgagccagcctcgctgcccccgcgtagaaagccggcccgccggcgagagccagcctaaggcgcggacaaccaacgaggtgtcaggctcggcaggggattgcttctgtctggggcccggccgaggttgcgttcgtgcctcgcgcgcacacgctccgcgttcactcagccaatccggtgctactcgcgcgcccaggagcgatccgcggtcctactcaggctgggccggctccttcccgctcccaatactcagcacccgagctctcactcctcccctcactctccacgagttccacgcctaggggtgtagctccgcccttgtccccgagtccgcccccgcaacctccagagcgtgtgctatcctttcctctcagtcctgccatctagctgccttgggtctcgcgctccgcagagcgttccgacactctccggcctcgttctgccgcctccgcgcgctctccccgtgcggccaccgcgccccccaagcttgcctccttcttgccggacttggggccgcgcgccctgactccttcccctcccgcggacccgcgcactcccggcgcggcctctcccccacgcaggccaccgtgcactctgtggcctccccctccttccccgctctcctcgcgcttctctggctccctagctgtcgcgctctcctcggcgagcgcgctcccggcccgcgcgctccgggctccggtttctcccggctcctgtcagtgcggtgactgcgctgggaaacatggcgaccgagggaatgatccttactaaccacgaccatcaaatccgtgtcggagtccttacagtgagtgatagttgcttcaggaatcttgcagaagaccgcagtgggataaatctcaaagatctcgtacaagatccttctttgttgggtgggactatatcagcatacaagatagtaccagatgaaatagaagaaatcaaggaaaccctgatagattggtgtgatgaaaaggaacttaatttgatattaacaactggaggaacaggatttgcaccacgagatgtcactccagaggccacaaaagaagtaatagaacgggaagcaccagggatggccctggcaatgctgatgggatcacttaatgttacacctctgggcatgctctctaggcctgtatgtggaatcagagggaaaacgctcataattaacctgccaggtagcaagaaaggatctcaggaatgctttcaattcatactgccagctctacctcatgccattgaccttttacgtgatgccattgtaaaagtaaaggaggtgcatgatgaacttgaagatttgccttccccacctccccctctttcccctcctcctactaccagcccccataaacagacagaagacaaaggagttcaatgtgaggaagaggaagaagagaagaaagacagtggtgttgcttcaacagaagatagttcctcatcacatataactgcagcagccattgctgccaagattccagactccatcatttctcgtggtgttcaggtgctcccacgagacacagcctccctcagcactactccttcagaatcgcctcgtgctcaggctacatctcgcctctctacagcttcctgcccaacaccaaaagtccagtccaggtgcagcagcaaggagaacattctcagagccagtcacagtgctgtcgatatcaccaaggtggctagaagacatcgcatgtctccttttcctctgacatctatggacaaagcctttatcacagtcctggagatgactccggtgcttgggacagaaatcatcaattaccgagatggaatggggcgagtccttgctcaagatgtatatgcaaaagacaatttaccccccttcccagcatcagtaaaagatggctatgctgtccgagctgctgatggcccaggagatcgtttcatcattggggaatcccaagctggtgaacagccaactcagacagtaatgccaggacaagtcatgcgggttacaacaggtgctccaataccctgcggtgctgatgcagtagtacaagtggaagataccgaacttatcagggaatcagatgatggcactgaagaacttgaagtgcgaattctggtgcaagctcggccaggccaagatatcagacccatcggccatgacattaaaagaggggaatgtgttttggccaaaggaacccacatgggcccctcagagattggtcttctggcaactgtaggtgtcacagaggttgaagttaataagtttccagtggttgcagtcatgtcaacagggaatgagctgctaaatcctgaagatgacctcttaccagggaagattcgagacagcaatcgttcaactcttctagcaacaattcaggaacatggttaccccacgatcaacttgggtattgtaggagacaacccagatgacttactcaatgccttgaatgagggtatcagtcgtgctgatgtcatcatcacatcagggggtgtatccatgggggaaaaggactatctcaagcaggtgctggacattgatcttcatgctcagatccattttggcagggtttttatgaaaccaggcttgccaacaacatttgcaactttggatattgatggtgtaagaaaaataatctttgcactacctgggaatcctgtatcggctgtggtcacctgcaatctctttgttgtgcctgcactgaggaaaatgcagggcatcttggatcctcggccaaccatcatcaaagcaaggttatcatgtgatgtaaaacttgatcctcgtccagaataccatcggtgtatactaacttggcatcaccaagaaccactaccttgggcacagagtacaggtaatcaaatgagcagccgtctgatgagcatgcgcagtgccaatggattgttgatgctacctccaaagacagaacagtacgtggagctccacaaaggcgaggtggtggatgtcatggtcattggacggctatgatggtcaccagcaggagaaagctttgatgcatgtccacatatcattgactgtatcctgtaatatgcaacggcacagctagttttcccgatttggataaaagttgatctgtatagtcaacatcttgaactatatttcaaatgaatttaaatatcttttaaagaaaaaaacacctaaaaataaatcttaacagaaaattctgttctgattatatcaaggcaaatttttcctttcttgcaaattgctttgtgtgttcaatgctaggtctgatagcgatagcttttagtagacagcggtaggtgcctgcagaacttgtgtttttctcatctttaaaatacaactacttatgctcttaaatcaaggctgtctgcttatttatactagcgtaggcaacacttggatttcccttcttagtatgcttcataactgctttacagagagcttttgcttgttctttctcatgtatctcgtgtttatgtgcacagtgccaaaagaagactgactgggtggaggctctgccttgcctcaagaaccatcccctgcagagcatccagggaggtttctcgccccaatagcctcacggcacagtactcttgggcagtaactggacaccttttatttgaagaaacaaactgaagaaaaaatgcttccttaagtgctgacagcctttttaaccaatacatttaaaattgtacagaacaaaaaaataaaatcaaagactgatcttgtacagatattagtgttaccagcattcatgtggaaatcaagagcaaagacaaaataatgttaaacaattctgtaccataacattttctgtaatgatactgaaacttaatgaataaaaaaattccttgatcattattt

SEQ ID NO: 83 - DNA, 4220 bp, Homo sapiens
  ref <308>: DATABASE ACCESSION NUMBER: AB037809
  ref <309>: DATABASE ENTRY DATE: 2001-06-18
cacagcggacctacaggcgctcagagaagcccaccttccccctctctgtcccgagaaggcttagagtggtacctgcttgctcaagcaacctgctgcctccacccagagcagccgctcctctcctccctcccttccggaagatgctgaggatgacagcttttagcctgactcttacatttctttggcagagcagttagaggccagactgtcctgtgaaggcttctccttccttcttcctctgctcaggagaaaacttacaaacttttaaatgtaagaggcagatgagctgggaacctggaagtgggttgcatctgactctgaaagttcctccctctcgctggcattacctcatgctgccacaaagtgaacggatcactggggaaggcagagtctccccggcactgctgggaccctcccttgaagagcccccatgtcctgtaggcagagccttgtagtctgtccgcttggttactgactcgggctgtctgaccagcccctcttctgtgccttgtctgaggtccttgtccatctctgtgattgggcagcttctctctctggattgggtcacgtgaagcgggaaactgaagccattactctccaaaccctgtttcatcttcccaagcatgtcggaaagctggcaacagccgccacagacgcagccgcagcagccacagccaccgcagcctcagcaccatgcagagccaccgccagccctggcagagcacacgctgcctccgggcacggcggagaaccccctgggctgtgctgtctatggcatcctcctgcagccagaccccggcctgcagcccccacaacacgcacccctgcaggcagcaggagagccaggccccaaatgtggcgtgtgtggtcacgacctggcgcacctgtccagtccgcatgagcaccagtgtctggcgggccatgaccgctcattccagtgcacacagtgtctcaagatcttccaccaggccactgacctgctggagcaccagtgcgtgcaggctgagcagaagcccttcgtctgtggggtctgcaagatgggcttctcactactcacctcactggcacagcaccacagctcccacagtggcctggtgaagtgttccatctgtgaaaagacctacaagccagctgaggcagcggagccagccaccacagccgccccgtcgcttcccgcagcacccgcgccttccactgtcacccctgctgaacaggccgacaagccctacagctgccccatctgccaaaagcccttcaagcacctgtcggagctctctcggcatgagcggatccacaccggtgagaagccctacaagtgcacgctgtgtgacaaaagcttcagccagtcgtcgcacctggtgcaccacaagcgcacgcacagctccgagcggccctacaagtgcgcagtctgcgagaagaccttcaagcaccgctctcacctggtgcgccacatgtacgcgcactcgggcgagcaccacctgttccgctgcaacgtgtgcgagttgcatttcaaggagtcgtcggagctgctgcagcacccgtgcacgccaagtggggagcggcccttccgctgcggcgagtgccagaaggccttcaagcggccctcggacctgcggcagcatgagcgcacacacagcgccgagcggcccttcaagtgcgacctgtgccccatgggcttcaagcagcagtacgcactgatgcgccaccggcgcacacacaagaccgaggagcccttcaaatgcggcctatgtgagaagggctttgggcagcccagccacctgctctaccaccagcacgtgcacaccctcgagactctcttcaagtgccccgtgtgccagaaaggctttgaccaatctgccgagctgctgcggcacaagtgcctgcccggcgcggccgagcggcccttcaagtgccctgtgtgcaacaaggcctacaagcgcgcgtcggccctgcagaagcaccagctggcccactgtgcggcggcagagaagcccctgcgctgcacgctttgcgaacgccgcttcttctcctcttccgagttcgtgcagcaccgctgcgatccggcccgcgagaagccactcaagtgcccagactgcgagaaacgcttcaagtacgcgtcagacctgcagcggcaccggcgggtacacacaggcgagaaaccctacaagtgccccaactgcgacaaggccttcaagcagcgggagcatctcaacaagcaccagggcgtgcacgcccgcgagcagcagttcaagtgtgtatggtgcggggagcgcttcctagacgtggccttgttgcaggagcacagcgcgcagcacagtgccgccgccgcggcagcggagggcgcctaccaggtagccgcctgcctgccctgactctgcggctgtggcccctgccagcctgacctgagtcggcgccgtgggcccagcaggcctcgcgcagcctagctcctcacagctgccttgcaccaagggccccacccagctcggtgttctgagacctcgggagtgaggacgcaggggtatgaggcagggagagggtgtgccgctcgtactcctggcaccagcgggcagtgcgggcggccagattgctgtggcccatccggattccacaaacctctttcccatgacaagattcactttcttgagagccatcagcaccccccttatttccggggcactggagccaggctggaagtcaagtggcttctccctgccctaaggagggtgtgatgccagcccagccttcccatatctttcaagctagcagccacataggttaggaaagcggaggctcatggtggggctggggccccagaggtgggctaggtgtaaggcatcagttgccgtgtgggggagaaggccagctttaagacgtaggcctggggactgggagggcagagggtgagtcacagccctctccgtctgctctagccaggggcgacgtgtccccaggtttctggcaggggagatgtgcagggtgggtcttggggctgggtctgcctggagaccagtgggcccagggggaagggggaagctgagaagttcgtgtgacaccctcagccaagggacagtgccatccttggggacaggaggaaaagcagcctgtctctgctaagggcaaatcctccggttttggaagcgcccctcccacctttgtagtgcagttcctaggtgtggtggggaatgtgccgtgctctcagcagacagaactgctggtgtgaaaggcagggattgtcagcccacctgaggctgggaggaagcaggaccaggcctaggatctccccagcagatgcaaacaagtgtcctcccctgaattgtgtgaaccaaagcgtcaggggcttggggcacagccccagtcagctcaacccagtcctgcttcagagccaagactaggccagggtggggacccccccagtaccctccctacatcaatgtggctgctggcctggaccccaggggtctggtacagccaagatgttctggacaacatccagctacttcaaaggccagagtgtcctttgggtcctcctagagtccccctaggtctctggctgcccatgaggctcatgaagcagagggtatcccagtcatagggagcagaaagagcaagtgggttaaggaagcctgtgggggacctggtggatggagttgaccaacatcgctgggtggctacggccctccttaggaagcccagaaggacctttattattaaaataatcattttgaaccctgctctatcccctgccctcttccagccccacccctccctggtcttgaaagaagactaatcagtgggcacaccaagggccctgaggggcagggagatgccaccatgcttctctgtcaccgtaagaaggctgaccagccacgcccacctcctctgtctgactgagttccttcctgtggccacagggaggggctggtccttccccttggtgctggctctctgtcacaatgcctcaaaagacatggaacccaggcctacaaccgtcccaactgctaattcttttcctttcattttgctttctgaaagcagtttgttatactattcataacattgtagagtttaatttcatgtcattttggatcttatataaaaatgtgaggatttggatttttaaaaagaatgactccattttaggtagccacttttgatgttaatatatagtgagtccaatgtatgctttagaagtaaagacattgaccgtcacagaccactgc

SEQ ID NO: 84 - DNA, 5480 bp, Homo sapiens
  ref <308>: DATABASE ACCESSION NUMBER: AB037836
  ref <309>: DATABASE ENTRY DATE: 2001-06-18
gtttacacccggagccgcagtctcagcatgaacttgggaatgttttcttaaaattcaaggacaagttctgcgtgtacgaggagtattgcagcaaccatgagaaagccctgaggctgctggtggagctgaacaagatccctaccgtgcgcgccttccttttgagctgcatgcttctgggaggccggaagaccacggacatccctttggaaggctacctgttgtctccgatccagaggatctgcaagtacccgctcctccttaaggagctggccaagaggactcccggcaagcacccagaccaccccgcggtccagagtgccctgcaggccatgaagaccgtttgctccaacatcaatgagaccaagcggcagatggagaagctggaagccctggagcagctgcagtcccacatcgaaggctgggagggttccaacctcacagacatctgcactcagctcctcctgcaagggactttgttaaagatctctgcgggcaacatccaggaaagggccttcttcctcttcgacaaccttctcgtctactgcaagcggaaatccagggtcaccgggagcaagaagtccaccaagaggaccaaatccatcaacggctccctctacatcttcaggggtcgaatcaacactgaagtcatggaggtggagaatgtggaagatgggacagcggattaccatagcaatggctataccgtcaccaacggctggaagatccacaacacggccaagaataagtggtttgtctgcatggccaagacggcagaggagaagcagaagtggctggatgccatcatccgcgagcgggagcagcgcgagagcctgaagctgggcatggagcgtgatgcctacgtcatgattgcggagaagggggagaagctgtaccacatgatgatgaacaagaaggtgaacctcatcaaggaccgccggagaaagctgagcactgtccccaagtgctttcttggcaatgagttcgttgcctggctcctagaaattggtgaaatcagcaagacggaagaaggagtcaacttgggccaagccctgttggagaatggcatcatccaccatgtttccgacaagcaccagttcaagaatgagcaggtgatgtatcgcttccgctacgacgatggcacctacaaggcccgaagtgagctggaggacatcatgtccaagggtgtgaggctttactgccgtcttcacagcctctacaccccggtgatcaaagaccgtgattaccacctgaagacctacaagtcagtgcttcccgggagcaagctggtggactggctgctggctcagggagactgccagactcgggaggaggcagtggcgctcggcgtgggtctgtgcaacaatggcttcatgcaccacgtgctggagaagagcgagttcagggatgagtcccagtacttccgctttcatgctgacgaggagatggaggggaccagcagcaagaacaaacagcttcgcaacgacttcaagctggtggagaacattctggccaagcgcctgctgatcctgccccaggaggaggactatggctttgacatcgaggagaagaacaaggctgtggtggtgaagtccgtccagaggggctcgctggctgaggtggctggcctgcaggtggggaggaagatctactccatcaatgaggacctggtgttcctgcggccgttttcagaggtggagtccatcctcaaccagtccttctgctcccgccgccctctgcgcctcctggtggccacgaaggccaaagagatcatcaaaatccccgaccagccggacacactgtgcttccagattcgtggagctgccccaccgtacgtctatgctgtggggagaggctctgaggccatggctgcagggctctgtgctggtcagtgcattctgaaggtcaatggcagcaacgtgatgaacgatggtgcccctgaggtcctggagcacttccaggcattccggagtcggcgcgaagaggccctgggcctgtaccagtggatctaccacacccatgaggatgcccaggaagcacgagccagtcaggaggcctccactgaggaccccagtggcgagcaggcccaggaggaagaccaggctgattcagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaagatcctcgaggcctttgctgccaatgacagcgtcttcgtggagaactgcaggcggctcatggccctgagcagcgccatcgtgaccatgccccactttgagttccgcaacatctgtgacaccaagctggagagcattggccagaggattgcctgctaccaggagtttgcagcccaactgaagagcagggtcagcccacccttcaaacaagcccccctggagccccacccgctgtgtggcctggacttctgccccaccaattgccacatcaacctcatggaagtgtcctaccccaagaccaccccctcagtgggcaggtccttcagcatccgctttggacgcaaaccctccctcatcggccttgacccggagcaaggccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggctgctgtccaccatcacagagcccacctcgggtgggtcctgcgacacatccttggctgaggaggcctcctccctgcccctggtcagtgaagagagcgagatggacaggagtgaccatgggggcatcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaacattcagagatatgtggaagatgggaagaaccagctgctcctggccttgctgaagtgcacagacacggagctgcagctgcgcagagacgcgatcttctgccaggccctggtggccgccgtgtgcaccttctccgagcagctgctggcggccctgggctaccgctacaacaacaatggcgagtacgaggagagcagccgcgacgccagccgcaagtggctggagcaggtggcggccacgggcgtcctgctgcactgccagtccctgctctcgccagccacagtgaaggaggaacggaccatgctggaggacatctgggtgacgctgtcagagctggacaatgtcaccttctcctttaagcagctggacgagaactatgtggccaacaccaacgtcttctaccacattgagggcagccggcaggcgctgaaggtcatcttctacctcgacagctaccacttctccaagctgccctcccgcctggagggtggggccagcctgaggctgcacacagcgctgttcacgaaagtgctggagaacgtggaggggctgccttctccaggcagccaggccgcggaggatttgcagcaggacatcaacgcgcagtccctggagaaagttcagcagtattaccgcaaactcagggcattttacctggagcggtctaacctgcccacggatgccagcaccacggcggtaaagatagaccagctgatccgccccatcaatgccctggatgagctctgccgcctcatgaagtcctttgtccacccaaagcctggtgctgctgggagtgtgggcgccggcctcatccccatctcctcggagctctgctaccgcctgggggcctgccagatggtcatgtgtggcacaggcatgcagaggagcaccctgagcgtgtccctggagcaggcggccatcttggcacggagccacgggttgctgcccaagtgcatcatgcaggccacggacatcatgcggaagcagggcccaagggtggagattctggccaaaaacctgcgagtcaaggaccagatgccccagggtgctccgcgcctctaccgcctctgccagccgccggtggatggggacctctgaacacccaaatgccccacgctgggccgcggcctctggagctgggatttgggaggacacagcaggcagcgctggccttctccagggatggcccaaggcttccgcagccgcccgttccgggacctgcccagcgtcctccctgcctccttccgggacaagcctggccaccctcgctgtgatgacgagctggctgattggccctgggccggcccattcttcacacgcctgccagaagctggaggggtgctggagacccatagagctgatgggagcagctggtgcctggccttcggctcctgcgtccccagaacccaagggaacgtcatggaggccacatggggccacccggctccctcgggatggctccgcctgcacttttgaaaccccggtttccttcaacgtccacattccaggtgaccacacgtgtctcctcctcctcatcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtattgacaactgttcccgcttctactaaaaaaaaaagagcacaaaagaaaaactaaattattgaaaaatt

SEQ ID NO: 85 - DNA, 5390 bp, Homo sapiens
  ref <308>: DATABASE ACCESSION NUMBER: AB037844
  ref <309>: DATABASE ENTRY DATE: 2001-06-18
gccgcggaggcggatgggcgcggctccctcccccactcaggcctcttcacggggcggggggccgggtcccccagcccccacccgcgccgtgtccagctcctcgcgtgctcgcggcggagccctgagcgcactgggtccgagtcctgcgcgccccctcaccacctcccccgcacctgctcctcctcctcggtcccgcccagcgcgccagcagcccgatccccagtgctgggagaagagagggggcgcaggcggcgacacaaagggtggagcggcgggaccgggacccgggaggctgcgcggcatggacgccgagtaccctgcctttgagcccccgctctgcagcgagctcaagcacctgtgccggcggctgcgggaagcgtaccgcgagctcaaggaggacctcacgcccttcaaggatgaccgctactacaggctggcgcccatgcggctctacacgctctccaagcgccactttgtcctcgtgtttgtcgtcttcttcatctgctttggcctgaccatcttcgttgggatcagaggacctaaagtgatccagacttctgcggctaatttttcactaaataatagcaaaaagctaaagccaattcaaatactttcaaatccactgtctacatacaatcagcaactatggctgacatgtgttgttgagttggatcaatcaaaagaaacttctattaagacaagctttcccatgactgttaaagtcgatggtgtagctcaagatggaaccacgatgtacattcataacaaagttcacaaccggacaaggaccctcacatgtgcagggaaatgtgcggagattattgtggctcaccttggctacctgaactacactcagtatacagtgatagtgggatttgaacacctgaagctccccatcaagggaatgaacttcacatggaagacttataaccctgccttctcccggttggaaatctggttccggtttttctttgtggtgctcaccttcatcgtcacttgcctgtttgcgcattccctccggaaattttccatgagagactggggcatcgagcagaagtggatgtctgttctcctgcctctgctgctactttacaatgatccgttcttccccctctccttcctggtcaacagctggctcccagggatgctggatgacctctttcagtccatgttcctgtgcgccctgctgctcttctggctgtgcgtgtaccacgggattcgtgtccagggagaaagaaagtgtttaactttctatttgcctaaattcttcattgttggactattgtggttggcttctgttacgctaggaatatggcaaacagttaacgaattacatgatccaatgtaccagtatcgagttgataccggaaattttcagggaatgaaggtcttcttcatggtggtggcagcggtgtacattctgtacctcttgttcttgatagtgcgggcgtgttccgagctacgtcacatgccttatgtggatctcaggttgaaatttttgactgcattgactttcgtagtacttgtcattagcatcgccatcctttatttgagatttggggcgcaagtactacaagacaattttgtagcagagctgtcaactcactaccagaattcagccgagttcttatctttctatggcctgttgaacttctatctctacaccttggcctttgtatattctccatcgaagaatgccctctatgagtcccagctgaaagacaatcctgccttctccatgctgaatgactcggatgatgatgtgatttatgggagtgactatgaggaaatgccgctgcagaacggccaggccatccgggccaagtacaaggaggagtcagatagtgactgagccccggccagcccagcgaggcgacaagatgcctggatgctttccccggtgaccgtctgctgaccttcccctgttatattcagatttttcttacaagcagagatttcctgttcatttgtttacatatttttttaaaggaaaaccaaaactgagggtaaatttaaatgtttagccaaatttattgtcatggtggctacgagaagaggcattgataacaagtttcaacagccaaatccttttttacagagatttcagatgagcgtgttttcagtgatgaggaaatttcacgtttttagtacagtgaattatgtacttttttttcctgtaatcattcactgattccaagttcacgggcagcctgtgactaggtcctcagcgtgacagcatcaccctctttcttcccttttccatggtactgttttttgaccctttaaactcaaagggaagccttatctgtggctgcttcagggcagtccttcctcgttgagtggccagtgccctgggtaaccaggtggctgaagtgattggtcagttatgtggactgcattttgtgcagtgtgtgagttatgactcatcgggaatgggagatgctggggttccaacccttcacgtcaccaaaggggaagtaatagtgtggagttctgaggagggtttgataagttgaataaggaaaggctaagataatttacaggttaccaactcatgtggggaaggtcttactgccatggtgcttttcaggggcctgtgtgtacacacatgattaaatggatttgcctgtgggaggtatgggcaggagaggaacccttaccattccagtaaatagcagtttctgcaattctgttgaatatgaaatgccatagagctttatttatttatgtaagtaaaagctaaatgaggggccaggtgcagtggctcacatctgtaatctcaacactttgggaggccaaggtgggaggatcacttgagcccaggagtttgagaccagcctgggcaacacagggagaccccgtctctataaaacatttagaaagttggctgggcatgctggggcatgcccatagtcccagctactcaggaggctgaggtgggaggattgcttgagccctggaggtcaaggctgcagtgagccatgattgcaccactgcactccagcctgggtgtcagagcgagaacccgtgtcataaataaataaagctacatgaaagattgatagaatattttagattatttattggccaaaagtttttaaaactcatatttggaagcaaaatgaaaagcaagtaaaatgttttaaatggttcatggaaaacgtatttgggtagaaggcaactcgtgcttccggaaggggttccctgtcctccatgtgtccacatggcggtcaggtagggacgacctgttctgtaaagtccttggcactgctgaatctgtggcatcatagaaggccctggagctttcccgttcctttcagtcagggactccatatagagtctcatgtggacgtctcccgtgctttcctcttgacctctacagtcacacttctgttaacatctggtaactgtgggcaacctgactgatgccgtcttggcaattgaggtccagaagatgatagttccgcaacgcaagcagtacctactttttttcttcatctatgcattgactctcagattaccatgcagagcttcacgttatcatccacgttaagtagtgctaggtgtaggaccttagagatgttcatgagaaactatttgttatgactttcctttgtatctttccttttaatttaaactttaatgataatgtacttttaatatggattctattcacatttgttttaaaaaccttgtaaatatgaatgtttaagacaacttactgcaagggtaattcaagtttacatgatttttaaatttgcaatgatgttttttttattctgtgtattgaaaaaaattttctgttaccaaattttacaacttctaataagactactataactttatgtaaactgatgaagatgtgctgattaacatattctgtgatatggtttacaacttttaatcataattgtccatgattttggaatgctgttatttatcagtaaatgtaaaatatttgaggcatttagccatacacacactagaactttttaaaactttgtcctatagtgtaattataaactgatgactattatcttcatacattgagtcttcatgcatcaatgaaatgaaaaatataggattatttatttactttttgtaactaagtgggaaataagaaaaaaagaaagtacttaaggggaaaatcgttcttactaagtcatgtattttcaacttgtcttccctgttatatcataaataccgacatactacataccccatgtaaaattttgcttaaactctctagcacttggcatgtagaatatgtaccataggtatcaggttaaaacactaaagtctgccagaaacttttgacagtagcaagaaaattgttgaagaaaaaataaattatttactgagggtagttatgttaaagttttgcgaacttaaagggctgactttagttccttcatggtaatggcttgagtaacatcatctttgggattttttaaatactggtccagtctaggagaacctggaagatgaccagaggtatttcagtttccctagggagagcttcgttatccatgtggatgataagtctgcttgatttattattaaatcattacagcagtgaagtggtgccattttctctctcttaagccccatttgaaaggctagagaaggggatatatatactatgttcaaggtttgtaaggttgttaatgtacataattgcagattgcaataaaagcttagatacattttgtaaacccaacccactaaatgagcaggttacaagacaaatgtcaccagcctcaagtattttatgaactatttactgagggtagttatgttaaatagattataatgtggtaaattatttcctgaatcctttatcacaggaaaaacacagaccctcataaaagggataattaaaacggatgtgtctgaacatttagtgaagatgagacttaaaacatgaaagtgtatttgtgtattttgagggttttagaaaccggttaccttagaggttagacttttgaagaaaaaaaaaaaaagatacagatcttttcccctggccaaagggaagttgtattagtctgtgacatcttgtgatgctgtttatcttggtttgacattggagatacgctagtaactgtgataccatactataaaacagaagaattttctgctactaaaaactgcctttttacaaaatgactgtaaatatttgtaaaataaaataacactaaactttaagcccaaaaggagagatagagccatgtgttcagttgtggacctgtccgtggggcacagtgccaccccatcacagtgttgctgtcatcaggcaaaagtgaatgtttgtttatggcaaattcgtcttttgcgaatggcttaattctgacactacctttctgggaaatgttaataaatttttaatattc

SEQ ID NO: 86 - DNA, 4655 bp, Homo sapiens
  ref <308>: DATABASE ACCESSION NUMBER: AB037845
  ref <309>: DATABASE ENTRY DATE: 2001-06-18
cccgatcagcaagtggagactgggaaatccccctctttatctggagcctctgccaagcctgcccctcagtcgagtgaaaacgctggtacttcagatttagaactacctgtcagtcaaaggagtcaagatttaagtttacaagaggctgaaactgagcaatcagatactttagataataaagaagctgtcatcctaagggaaaaacctccatctggacgccagacaccgcagcctttaaggcatcagtcttacatcttggcagtaaatgaccaggagaccgggtcagacactacctgctggctgcccaatgatgcacgtcgagaggtccacataaaaagaatggaggaaagaaaagcctcgagtaccagtccgcctggcgattctttggcttccatcccatttatagatgaaccaactagccctagcattgatcatgatattgcacatatccctgcctctgctgttatatcagcctctacctctcaggtcccctccatagcaacagttcctccttgcctcacaacttcagctccattaattcgccgtcagctctcacatgaccacgaatctgttggccctcctagcctggatgctcagcccaactcaaagacagaaagatcaaaatcatatgatgagggtctggatgattacagagaagatgcaaaattgtcctttaagcacgtatctagtctgaagggaatcaagatcgcagacagccaaaagtcatcagaagactctgggtccagaaaagattcttcctcagaggtcttcagtgatgctgccaaggaagggtggcttcatttccgaccccttgtcaccgataagggcaagcgagttggtggaagtattcggccatggaaacagatgtatgttgtccttcggggtcattcactttacctgtacaaagataaaagagagcagacgactccgtctgaggaagagcagcccatcagtgttaatgcttgcttgatagacatctcttacagtgagaccaagaggaaaaatgtgtttcgactcaccacgtccgactgtgaatgcctgtttcaggctgaagacagagatgatatgctagcttggatcaagacgatccaggagagcagcaacctaaacgaagaggacactggagtcactaacagggatctaattagtcgaagaataaaagaatacaacaatctgatgagcaaagcagaacagttgccaaaaacacctcgccagagtctcagcatcaggcaaactttgcttggtgctaaatcagagccaaagactcaaagcccacactctccgaaggaagagtcggaaaggaaacttctcagtaaagatgataccagtcccccaaaagacaaaggcacatggagaaaaggcattccaagtatcatgagaaagacatttgagaaaaagccaactgctacaggaactttcggcgtccgactagatgactgcccaccagctcatactaatcggtatattccattaatagttgacatatgttgcaaattagttgaagaaagaggtcttgaatatacaggtatttatagagttcctggaaataatgcagccatctcaagtatgcaagaagaactcaacaagggaatggctgatattgatatacaagatgataaatggcgagatttgaatgtgataagcagtttactaaaatccttcttcagaaaactccctgagcctctcttcacaaatgataaatatgctgattttattgaagccaatcgtaaagaagatcctctagatcgtctgaaaacattaaaaagactaattcacgatttgcctgaacatcattatgaaacacttaagttcctttcagctcatctgaagacagtggcagaaaattcagaaaaaaataagatggaaccaagaaacctagcaatagtgtttggtcccacccttgttcgaacatcagaagacaacatgacccacatggtcacccacatgcctgaccagtacaagattgtagaaacgctcatccagcaccatgactggtttttcacagaagaaggtgctgaagagcctcttacaacagtgcaggaggaaagcacagtagactcccagccagtgccaaacatagatcatttactcaccaacattggaaggacaggagtctccccaggagatgtatcagattcagctactagtgactcaacaaaatctaagggttcttggggatctggaaaggatcagtatagcagggaactgcttgtgtcctccatctttgcagctgctagtcgcaagaggaagaagccgaaagaaaaagcacagcctagcagctcagaagatgaactggacaatgtattttttaagaaagaaaatgtggaacagtgtcacaatgatactaaagaggagtccaaaaaagaaagtgagacactgggcagaaaacagaagatcatcattgccaaagaaaacagcactaggaaagaccccagcacgacaaaagatgaaaagatatcactaggaaaagagagcacgccttctgaagaaccctcaccaccacacaactcaaaacacaacaagtcaccaactctcagctgtcgctttgccatcctgaaagagagccccaggtcacttctggcacagaagtcctcccaccttgaagagacaggctctgactctggcactttgctcagcacgtcttcccaggcctccctggcaaggttttccatgaagaaatcaaccagtccagaaacgaaacatagcgagtttttggccaacgtcagcaccatcacctcagattattccaccacatcgtctgctacatacttgactagcctggactccagtcgactgagccctgaggtgcaatccgtggcagagagcaagggggacgaggcagatgacgagagaagcgaactcatcagtgaagggcggcctgtggaaaccgacagcgagagcgagtttcccgtgttccccacagccttgacttcagagaggcttttccgaggaaaactgcaagaagtgactaagagcagccggagaaattctgaaggaagtgaattaagttgcaccgagggaagtttaacatcaagtttagatagccggagacagctcttcagttcccataaactcatcgaatgtgatactctttccaggaaaaaatcagctagattcaagtcagatagtggaagtctaggagatgccaagaatgagaaagaagcaccttcgttaactaaagtgtttgatgttatgaaaaaaggaaagtcaactgggagtttactgacacccaccagaggcgaatccgaaaaacaggaacccacatggaaaacgaaaatagcagatcggttaaaactgagacccagagcccctgcggatgacatgtttggagtagggaatcacaaagtgaatgccgagactgctaaaaggaaaagcatccggcgcagacatacactaggagggcacagagatgctaccgaaatcagcgttttgaatttttggaaagtgcatgagcagagcggggagagagaatctgaactttcagctgtaaaccggttaaaaccaaaatgctcagcccaggacctttccatctcagactggctggccagggaacgcctacgcaccagtacctctgaccttagcagaggagaaatcggagatccccagacagagaacccaagcacacgagaaatagccacgaccgacacacctttgtctcttcattgcaacacaggcagttcttccagcaccttggcttcaacaaacaggccccttctttccataccaccacagtcacctgaccaaataaacggagaaagcttccagaacgtgagcaaaaatgctagttctgcagcgaatgcccaacctcataaactgtctgaaaccccaggcactaaagcagagtttcatccctgtctttaaactgggggtatgtccactctagcaagtaaaaaaactactgttacacgttccagtaactctgtcaatattttcttgtatcagaattgttattatgcagccttcatttgggctggtttcatcattttgcactgtgaaatagctttacagtgcattactacagccagaagaacatatatatatatatatatttaaaaatatatcggatagttgtatacaaatgagcaaggtatttgttgcaacttactacatagcatatacccaaaatcactgaagaaaatcgctggcatcagtgtgcagcaaatttgttcttttggtttcatcactaacaaaagtgcctcatcataaaaatacagttggtttttagggtgccatattgttaaaattagataacttacttacattgaataaacgaatgcgttttattggtaacagatatcattacatttaccagttttaacacaggtggatacagaacttccattctttagtcattccaggtggatctgagttttatattcaaacttttaatacagtttttgagttttgtgtgacttgaatttttaatctttctgtaaaatacgtaacttaaatgaacatattaaatgtgtatcttttcttcagataccagatttgatataatgttgtaacataggtgtgtagatagtggatcctggatggaactggcttctttatcgagaagaatataattctgcatgaggacttaatgaatccaaacctgtgtcatgcctgtgtgcatacccaattaaacactggaaataaaaattgttttggtg

SEQ ID NO: 87 - DNA, 5145 bp, Homo sapiens
  ref <308>: DATABASE ACCESSION NUMBER: AB037848
  ref <309>: DATABASE ENTRY DATE: 2001-06-18
ggcggcgggagagctgctggctcgcccggatcccgggagctgcctggaggcgggcccggcccggggaaggtgagcggctgcgggacccagcccctcgccgggagcgggcaccatggtgctgtcggtgcctgtgatcgcgctgggcgccacgctgggcacagccaccagcatcctcgcgttgtgcggggtcacctgcctgtgtcggcacatgcaccccaagaaggggctgctgccgcgggaccaggaccccgacctggagaaggcgaagcccagcttgctcgggtctgcacaacagttcaatgttaaaaagtccacggaacctgttcagccccgtgccctcctcaagttcccagacatctatggacccaggccagctgtgacggctccagaggtcatcaactatgcagactattcactgaggtctacggaggagcccactgcacctgccagcccccaacccccgaatgacagtcgcctcaagaggcaggtcacagaggagctgttcatcctccctcagaatggtgtggtggaggatgtctgtgtcatggagacctggaacccagagaaggctgccagttggaaccaggcccccaaactccactactgcctggactatgactgtcagaaggcagaattgtttgtgactcgcctggaagctgtgaccagcaaccacgacggaggctgtgactgctacgtccaagggagtgtggccaataggaccggctctgtggaggctcagacagccctaaagaagcggcagctgcacaccacctgggaggagggcctggtgctccccctggcggaggaggagctccccacagccaccctgacgctgaccttgaggacctgcgaccgcttctcccgtcacagcgtggccggggagctccgcctgggcctggacgggacatctgtgcctctaggggctgcccagtggggcgagctgaagacttcagcgaaggagccatctgcaggagctggagaggtcctactatccatcagctacctcccggctgccaaccgcctcctggtggtgctgattaaagccaagaacctccactctaaccagtccaaggagctcctggggaaggatgtctctgtcaaggtgaccttgaagcaccaggctcggaagctgaagaagaagcagactaaacgagctaagcacaagatcaaccccgtgtggaacgagatgatcatgtttgagctgcctgacgacctgctgcaggcctccagtgtggagctggaagtgctgggccaggacgattcagggcagagctgtgcgcttggccactgcagcctgggcctgcacacctcgggctctgagcgcagccactgggaggagatgctcaaaaaccctcgccggcagattgccatgtggcaccagctgcacctgtaaccagctgcccagctgcctcccttcttggacagccctgacccgtcctctgcaacctcctttctgtgcccctttcctcattctgacacccagaagacagtgacagatgtgtttgcaaggctgggatggctctctcatcatactcttgtttcttagaaataagcaagacagagcaggaaatggaatatgcgggtcacactgaggaatgcattttgctcatctgtgttattgaaggaggtgcttattaaatacagttcctatgcctgttttataggtggggttaggccagatgcagagaaagctaaatgtgggaatcatggatgcaaagaagaatttggctttttgaaaaacaagcatttcaaaaatgatgaaggaagtgaaagtatcctggatcaactcctagagttagagattgcccaggtggaaagaaaccttagccagcgttcaatcaagctcaccatgcagggcagtcacccggcagttctcaaactttagcatgtgaagagtcaccagcagattcctgggctcgcctggagacattcctagtcggtattcctggtcgaagcccaggagccttcctttttaacaagctgatgtagagggtggagcactgtatgtggagaaattccttctacaatattccacacaggtttttggccacagtccttgatggagtcccaaaaccatggtgcagccagttccaatgctggacacctcaaccatcagggtgaaatctggggcctcagctttttaatttaattattttaattcttaatactttaatttgtgcatttcataagccccctgctcttggactgaattttgtgctttttattgaagaattttattgtttttatcttaaaatcagtttctattatccttggggagaccatccctaacaaagtacaggtgggatctcctgtgagtcattggctgggttctgattgctagatgtcacacccaccagcatcaccaaagtgactctgagatagaccggtcccttctcagcgttccagtcacttcaggaggaatttagttattgacttagtctatgacatctggctacatgtaggtagagaagaaagacaattttaaaaaggaaatcaggtcttttgcaactgtgcctccctctgtctgttttcacttgaatgggtaaataaccagcagctaggttttgaattcctaccttgttattctaaacagatgtccacattgttaattaaatctaaattatgagccttgctgagtggatacggtacttacacctgaaccaggattcctgggttctgttgttgacattgcccttcagcacctgtttggccagctgtataagataggactaatgactaggaagcctaccccaatgaatgatatactagatgaaatagtgttcaaaacctgtaggcactctctggctaaaaacaaactctgaggccaccagcagatcatctttaagctaagttactatttttcacctttttttttagacggagttttgctctttgttgcccaggctggagtgcagtggcacgatctcggctcactgcaacctccgcctcccaagttcaagcgattctcctgtctcagcctcctgggtagctgggattacaggtgcccaccaacatgcctggctaatttttgtacttttagtagagatggggtttcaccatgttggccaggctggtcttcaactccagatctcaggtgatctaccctcctcggcctcccaaagtactgggattacaggcctgagccaccgcgcccggcctatttttcactttaatttggcagctgagaatgcccaaaaagtgccagaagcatcgtggcatttccagaaccatggattctgcctttggacccctctctattaatattaaaactctgggccttcagatgtcaccctaatccactgccctaagacagaatttctggacaagatgggtaagggcttcattccttcaacaagtcaagtcatacttggcctctccctgagaatctgagcaggagccttataacctgtggtcattattttttctttctgtacagaaatagaaaagcattagaaataacttctaaccatcctctgaaaaaacagaaaaaatatcgaatccctctttcatgagaagtcttttggataattggaaaccttcatcactgaggttggccagcccctgccaagtgttgtgtaggcaaagcacttgttagtggcttcctatgaaatgttttagagatctcttcaccatactggtttcttctctttggttggtgtgggtaaaagaaaacaaaacatttcctataagctgaaagctgaccagcattctcttcttggtaacatctactactccaacctagaaaatttggattctagaccaaaaatcaggaaacatggctccttataaatctgtgcagctgccttatagtaccatcaaaggaatttcaggtgggctgggcggggccccgatcccagaattatcaactccacccatcatcatttggtcatgaagcatcctttcattcttcttcttcttttttttggggggggcggggcgggggagggatctcaaagttttagtcttccagaatccaaattaaaggttgcccctgatgggggccaggttccgccacagaacatcttagatgtcagccttgacctcacttagcagggattacagaaatgagatacattttgaaggagagttgtctgttatgttcactgtattctaagtgcctgggataaagctgtctcatgggtgctccatatatattcatatatatttgttgagtgaattaatgaattaagagtggctggcagagtaggcagaaaaagacactgcaaatggcataaaaattaaagtcctagctgagttctcaatggtaaaggcatcagatgtcttagcagtcaagctagaaattcatgacaatgagtattactatttgcctaatgacaactcattgctctccatgtaaatgtaatcaacagatgaagagaatataattgctctgcttttccactaaaactccatcttagtgaattttaaattatccagagatgtcaaactgccaaataaaaatatttcagtagtctttgcatcagcttaccttgtaccagaaacatttccaatttactatcaaattatagtaactgagcctgtgtgaagtatctcatcattttcgaaaggaacaccttgtgtgatgccagtgagcatttctaaaaagggtgtgaggtagaggtaaaaataaggtgagagaccatttcagaatgcactgttgctcaaaaaggtgatctggttctttcttcagagatttctacggggatagaaaatcgggagtctgccctcattaatctgtgactccacctcttgcatcaaatcaatatctatttgttgagcacttattgattaagaccttgcatatgtctgtccattttgatttgagatacaactttttgtgtgggttgaatgacaaatcactccaaacaaaactgggcacagagaatcagctaggagaccagttattcagggtccatttctcttggatgtaaaggagtcctgggtaaaatgtggctgtaacctaaaccaactagtccttgtgatttgtttctgccctctgtgtttcctgttgtcaaatgctaagtgtgtgttttgcagtcatgaactaaagcacaaaaagatgcatgagacattgtagtcatatgtctggtgtgacactttggagcaaaaaccttgcagtggtaaataaaaaatttccaacagggt

SEQ ID NO: 88 - DNA, 2782 bp, Homo sapiens
  ref <308>: DATABASE ACCESSION NUMBER: AB037863
  ref <309>: DATABASE ENTRY DATE: 2001-06-18
gcggccgcggcggggcggcgcgggaaccgggccccggggggagtcggccgggctgctgctgctgctgctccaggtgctgccgcccggggctacggcagggccgggacgccggggcacgcggggcgctggcggcggcggcgtctgctggcccggcgcggccccagcctttccccgggacgcgcggctgctgctgctcctgccgccgctgccgccactgtcgccgccgccgccgagctccgcgcccgcagcctccgcctcccggatggacgctctgccccgcagcgggctgaacctgaaggaggagccgctgctgcccgccggcctgggctcagtgcgctcctggatgcagggcgcgggcatcctggacgccagcaccgcggcgcagagtggcgtgggtctggcacgagcacattttgagaagcagcctccctccaacctcaggaaatccaacttcttccacttcgtgctggccatgtacgaccggcaggggcagcccgtggaggtggagcgcacagccttcatcgacttcgtggaaaaggaccgagagcccggggcggaaaagactaacaatgggatccattaccgcctccggctggtgtataacaatggactgcggacagagcaagacctctacgtgcgtctcatcgactccatgtccaaacaggccatcatctatgaggggcaggacaagaaccccgaaatgtgccgagtgctgctcacccatgagatcatgtgcagccggtgctgtgaccggaagagctgtggcaaccggaatgagacgccctcagaccccgtcatcattgacaggttcttcctcaagttcttcctcaaatgcaaccagaactgcctgaagaatgcggggaatcccagagacatgcgccgcttccaggtggtggtgtccacgacggtgagcgtggacggacacgtgctggccgtgtccgacaacatgtttgtgcacaacaactccaagcatggccgcagggcgcgccgcctggacccctccgaagctgccaccccctgcatcaaggccatcagccccggggagggctggaccacgggcggcgccaccgtcattgtcatcggcgacaacttcttcgacgggttgcaggtcgtgttcggaaacgtgctcgtgtggagcgagctcatcacgccccacgccatccgggtgcagacgcccccgcggcacatccccggggtggtggaggtgaccctctcctacaagtccaagcagttttgcaagggatgccccggccgctttgtctacacagctctgaacgagcccaccattgactacggattccagaggctacagaaagtcattcccagacaccccggagaccccgagaggctgcccaaggaagtgctgctgaagcgggcggccgacttggcagaagccctgtacggagtgcccggcagtaaccaggagctgctcctgaagcgcgcggcggacgtggccgaggctctgtacagcaccccccgcgcacccgggccgctcgcacccctggccccgagccacccacactccgccgtcgtgggcatcaacgccttcagcagcccgctggccatcgccgtcggggacgccaccccggggcccgagccgggctacgcgcgcagctgcagcagcgcgtccccccgcgggttcgcgcccagccccggctcgcagcagagcggctacggcggcggcctcggagctggcctgggcggctacggcgcgccgggcgtggccggcctcggcgtgcctgggtcccccagcttcctcaatggctccaccgccacctcgcccttcgccaaggagcgccttcgcccccgtgctgcgccccccaagctccccaccccaggcctgccccagagcccacggagaggggcttccagaccagtcttttgaggattctgacaagttccactctccagcccgggggcttcagggcctggcatactcctaattacggtctgcagctgttcccatggagcccggactggaggtccctctgggattcacagccacaccccggatggtggcacagacagatgcagggccagggccatgggcggacctcaacccgtgagctgaacggggagaggccttcaccccatgctcaagcctccccgctagcagccccacaggcttctctcgcctccctgtcttggggtagtcagaagccccagcactgtgcagatgctcttggcaggacagcatcgcagggaggtgctgggattctgggcctcactgtctgggtcttggttcctctgaaagagatggatcttgtgcagaccagggttgttgagtgaggggagcgtgggatggggaccgtgggaaagaggacagctcagggagaagtgacctggaaaggtcctgtttgcatctgacccatctcaactggcccagcatcccaacttctctgcagcgaaagggtggcgccccgcagcctcgggaggcctgcccaggctcccgtggagcttccaacagctgcttggccccgcagctgcccccacttcctttgagacctgcactctcatgcttgccgcatcatgcctccctgtgggggctttgggcatggaggaggcagaagagggggtgccaggcctcctgtatttggggtcttcccccagtggatgtctcatggactctggccccacacactcacaatgactctggctggccccacgcagcgggcccagccgccccccaggtggcctcacattctgctctgctaagtttggagaaaacagaacaataaaccagatgcaggtggtgcccgcccggcctctcacctgcctcctt

SEQ ID NO: 89 - DNA, 3239 bp, Homo sapiens
  ref <308>: DATABASE ACCESSION NUMBER: AB037864
  ref <309>: DATABASE ENTRY DATE: 2001-06-18
gggcggccgcaccgggcagcaaccccactcccactcggaggccccctgccctctcccccacttccccccggcccatggtgcgaggctgggagccgccgcccgggctggactgcgctatctctgaagggcacaaatcagaaggcaccatgcctcctaataaagaggccagcggtctcagtagttcaccagcggggctcatctgcctccctccaatctctgaggagctacagcttgtgtggacgcaagcagcccagaccagtgagctagacagcaatgaacacctgctcaaaaccttcagctactttccctatcccagcctagcagacattgcccttctctgcctacgttatgggttgcagatggagaaagtcaagacttggtttatggcccagcgcctccgctgtggtattagctggtcatctgaagaaatagaagagactcgagcccgagtagtctaccgtcgggaccaactccatttcaaatcccttctctcttttactcatcatgcgggacggcccccagaggaggtgcctcctcctccagtgccagctccagagcaagttggtattggaataggtcctccaactcttagcaagcctacccagacgaaaggattgaaggtagagcctgaggagccctctcagatgccaccactgccacagagtcaccagaaattaaaggagtccctgatgacacctggcagtggagcattcccctaccaatcagatttttggcaacatcttcaaagcagtggcctctcaaaggagcaggcaggcaggggtcccaaccagtcacatggcataggtactgcttcctggaaccactccacaaccgtcccccagccacaagctcgggataaacccccaccaattgcattaattgccagtagttgtaaggaggagtcagcatctagtgttactccctcttcttcctctacctcttcttctttccaggtactggctaatggagctactgccgcctctaaacccctccagccactaggctgtgtcccacagtcagtgtcacccagtgaacaggcattacccccacatctggaaccagcctggccccaagggctacggcataactcagtaccaggtagagttggccccacagagtacctttccccagatatgcaacgccagcgaaagaccaagcgcaaaaccaaagagcagctggctatccttaaatccttttttttacagtgccagtgggcacggcgtgaggattaccaaaagttagaacagatcactggtttacctcggcctgagatcattcagtggtttggtgacacacgctatgccttgaagcatgggcaactaaagtggtttcgggacaacgcagtacctggtgcccctagtttccaagacccagcaattcctacaccaccaccatcaacccgctccttgaacgaaagggctgagacaccacctctgccgatccctccacccccaccggatatacaacccttggagaggtactgggcagcccaccaacagctacgggaaactgatatccctcaattgagtcaggcatcaaggcttagcacccagcaggtgctggattggtttgactctcgattacctcagccagctgaggtggtagtttgtctagatgaagaagaggaagaggaggaggaagaactgccagaagatgatgaggaagaggaggaggaggaggaagatgatgatgatgatgatgatgatgtgatcatacaagactgagtggggagctgggggaggggaggtctgttactgaaagatgaaccaacttagtaactgtttaaacaaagaaaccacatttttaaaattaccttgtggcagagaactaaaaagctttgtgttcttcagggtgggtggcagggggatatagtgagggtggaccagggagaatgaccatagggcactaagtaaggctgggattggatcagcagaaatccaaccctctaaccttagggtagggagtgctaaggatctggggaaaccatgggctgggaagctgctcttgctctcctcgtgtctgctgtttttttcccttggtgtactatacagaggccagatgttggcaccacctctccaggaggattggaaaggaggagtaaaggattctgatttgattgatgattccagtgcatccccaatcccaccatcttacctggaatataaggctgccttgtaccccttttctgagcacaagtctgtgcgtaatgcaactgactctcttacttttttcttagtaactgatcatttcctagacaaccaagattctcaataagtcccagtctcatcacaaatattaatatttccttttcctcataccaacttgactatgtttcacccgcttcatgactaaatcacaggtggcagaatttttcagttcttttttttttttttgaggtggagtcttgctctgtcgcccaggctgtagtgcaatggcgcaatctcagctcactgcaagctccgcctcccaggttcatgccattctcctgcctcagcctcccgagtagctgggactacaggcacctgccaccacacccggctacttttttatatttttagtagagacgggtttcatcatgttagccaggatggtcttgatctcctgacctcatgatccgcccaccttggcctcccaaagtgctgggattataggcatgagccaccgtgcccggctattttcagttcttatgctgtgaccactttgccttgtagctttttctatctttccaaaatcctcactctgttcattgtttgtctcagggaaaatcttcccccaccgagcttgtaaaaaactttaataattgggtggagaataatttagaatggatatttattggaggtggtaattagggaagatgtccttttaaacagtagaattgtgttacaaaggggtgaaagagagggaatagtttctccttgttgaagggcagtgaaggtaggtttcaggtttggttttacaaacctgttaactacctcctgtccagcttgacagagactaatttttcatctttttgctgtcaatttgtttccagaaaagagacttttccctctcttgataggatctgtcttagggacagagggaccatcgtctttaagtgaattaattattgatgttttagaatggttttcatcagttgggatcagctatatggcaaataggtatcatcaatgagttaaccatctaaaaataaaagagtggaagccctaaaatgctagaataataataaaaaggccaaaaat

SEQ ID NO: 90 - DNA, 5536 bp, Homo sapiens
  ref <308>: DATABASE ACCESSION NUMBER: AB040881
  ref <309>: DATABASE ENTRY DATE: 2001-06-18
agcaaacaaactcttctagagatatttttggtaaccacagtgaataaaagattgactgttagtaactattttcatttactagactgccctgaactactcatctgtgagttgagtattttttttttaagtgaaagcatgtttattaagaaaataaaggaataggctgggtgcggtggctcacccctgtaatcccagcactttgggaggccaaggtgggtggatcacctgaagtcaggagttcaagaccagccgggccaacatggtgaaaccccgtctctaccaaaaatgcaaaaattaggtaggcgtggtggcaggtgcctgtagtcccagctactcgggaggctgaggcaggagaattacttgaacccaagaggtggaggttgcagtgagccgagatcgggcactccagcctgggcgacagagcaagattctgtctcaaaaaaaaaagaaacaaagaaagaaagtaaagcaataaagaatggctacttcataggcagagcagctgagtattttcttttcccagcaacttttatctcccgaatagaaattctttctaatcccacttactatttggaattctaaatccaacattgctttcccagagatccatgttatcaagatttgcttgtattagttaagagcgattgcttattatctatacagcccttgaaattacattgttgtgaagtcaggctgctgttttagggctaagtaaggttttctgaaaaagaggcaatggtgcaaagacagctggaaagacagagttaaacataccttttaaagtggatcaattttatgtaaccagagtatgatctttctgttttatgtgtttattggaagagttgtcacttaaagtgatattcctcaaatagctaaaaatgtcctgggttttctagatagaaaatatctctaagttgtacttattaaaatgtgacttggggaattttaaattatattcagtggaagtatatttgcccagctttatttttgttcgggtaatttatttctcaaaattttggaggtgaggtctttattgatttgtgtgtgtgaaaaacaagacaaaacacacccactatgaggatcctttaaaaaaaaagctttcttgttatccagataacacactttaatcgtacgacggaaatggatacatttaacatgacaaaaaatagcaaaatcctctgctcatggaaagatgatttccaaaccctcttgtcttacagaagaaaacatttggttgactaagaactgacatggtctgctcatagggattcttagcatttttaacatcatccctgtttgactgcttctttttctacattctcatcttctaacttttttctagggctgctctttttagtaaagctaaacaaaacctggcgtcctacagccttactaacctttgttaatccgcctgctcgtcacatctttgtatggcatctgtgctcactcatgggggaaagagattctggaagaagcaacagcaataaccaaggcaaatgtggggaagtgtctgcatgggttgttagcatgatgtgtggggcctaggttttacttcattttcttcgaatagtgaggtcgttaagtcacgccatttgaataattttgtatgaccatagggtgacatactcatccctgttgtcaattctcctaagaaatttggtggcaaatttcatcacttaagccagaaagtggaaatttggattagggatgccaaataagcaaatctttatattgatagaaatgtacataggcgtatgtcttaatagacttccacattattgaggggttttttttggttttgttttgttttttagtttttttggtcttatttttaaatttggttaaggcttttttgcttgctttttcttcgatttaattttccttttttacattttaattttggttattttggggccattttttgattttgtttttccaaaggacgcggattctgatagcggggacgattctgacaagaggtcgtgtgaagagagctggaaactgattacttctctgagagaaaagctacctcccagcaagttgcaaaccattgttaaaaaatgtggcctcccaagcagtgggaagaaacgtgaaccaattaaaatgtatcagataccccaaagaaggcgcttgagtaaagattccaagtgggtcacaatctcagatcttaaaattcaggctgtcaaagagatttgctatgaggttgctctcaatgacttcaggcacagtcggcaggagattgaagccctggccattgtcaagatgaaggagctttgtgccatgtatggcaagaaagaccccaatgagcgggactcctggagggcagtggccagggacgtctgggataccgtcggtgttggggatgagaagatcgaagacgtcatggccactgggaaaggcagcactgatgtagatgacctcaaggttcatatagacaagctggaagatattttgcaagaagtcaaaaagcaaaataacatgaaagacgaggagataaaagtcttaagaaataaaatgctcaaaatggaaaaagtcttgccactgatcggatctcaggaacagaaaagcccaggaagccacaaagcaaaggagcctgttggtgctggtgttagtagcacctctgagaataatgtaagtaaaggagacaatggagaacttgcaaaagaagaacgtgtttcccagctgatgaatggggatccagcttttagacgtggacgtctgcgctggatgaggcaagagcaaattcggtttaagaacttgcaacagcaggagataacaaagcagcttcgtcggcagaatgtacctcataggttcatccctcctgagaaccggaagccccgcttcccctttaagagcaaccctaaacacagaaactcttggagtcctgggacacatatcatcataacagaagatgaggttatagagcttaggattccaaaagacgatgaagcaaggaaagggaataaagaagagagccaagaaaaagggggtaaaggagcttttaaggatccccagtttccatggggctctcaaggaatgagaagtcaagatcacatccaagttagcaagcagcacattaataatcagcaacagccacctcaactacgttggagaagcaattctctcaataatggccagccgaaaagtacgcgctgccaggcatctgcctccgcggagtcattaaactcccacagtggtcaccccactgctgatgtacagactttccaggcaaagcgccatattcatcaacaccgtcagtcttactgtaattataacactggaggtcagttagagggcaatgcagccacttcctatcagaagcagactgacaaacccagccactgtagccagtttgtgacacctccgcggatgaggagacagttctcagcacccaatctcaaagctggtcgagaaaccacagtataaatcagttactggacaaacttgaaatcatggtggaagaaacagacagtgttagctcatgatttgatttggttctacctttggccttgagttcttattatttacattataaatattaactggttttatattgttaagacaaaacactggtaaaagtttcaacacctcccttttgcttgtataccataaatgggcagtttctgaaattttggataaagcatcaagaactcctttttctgaaacgttcctccttttttagtgcctaattaatatacttacttacacagacttgtcccatcttgatgtaagtttgttatgtttttataatgcctataaattaatctgacatccagaaagacctgcctcttagtttatgcagacattcaaaaggagaatttgataagcagaattaaatgtctgttattcataaatgttagaaattggtttaaaaataataacatgcaactgggtgggcacagctttggatttctcatccacgtctgttcccttctttaaatatgattagaattttcgtaagccaaaactaaaggtcttcaaacatatcttgcaatacatagctttgcatcttccacacaacttccacgtcttcttttattctgtattttacaaaaaactcatataatggttttttcttttgaatgtatcagaatatgtatgaaatttgtcatatcagaatctataaattggcactgtgtctgggattctgtttgtggtttgcattttgaagttcaatgtatcatttgacacacatgcacacaaagtgaactattcaccaaaatcatgccaacagaaataccaacaaaaaacttgtgtagcttgtaaggaggttatttggcttgagagggaagaggtgggacagacatgggggacaaagctacagcatatggctctgtggtgctgcttttttccaatagttgatgaaatagtgaaataaaagttaactttggttgggcttggaataaaggagatgatacataataaactattctttggttagcattagtaatgcttgtagacactcaaacaaggaaggcgaagtcctgatgatgatttattgtatcaatacctcattttatttggttgtggtctcagtttgcctcactggagaatccactaagaaagatggattttaatgggaagaaaagaattattttctacatcgttcctcatctcttgagtttgtcaaaaagttttctaagaggcagtgtgaagagccagagatgtccgaaattgcctgacttcatgttttggaagattcctaagtcacatgaaatcatctatcaaacacttgtcttccaaacggtgtgaaaaactacagccaagatagcagttagcattcaaggaagccttaaagattgtgattatgtttttttttcctttgcgtgtgggcactatgctttattagaacacattatttttaatcatagtattttttctttgcctctaagaaaatactttcttaatgctcagaaagttgcttccaattaatgtttttttccccttaaaaagagaagctttgagagatatttttgctttcatagctagaacagttgaagtcttcaactgaggttttatagcagattagacatgggtaaatgatgtctgtaatgggttgagttactgagatgacaatctcctgtgccatttggtttgaatgtacttgataggctgcttcaaatcagtcacttcaatgcattttgtgtaaacccagttgtccttttttattcctctttagacataaatgtgctaactattcctttctatacacaatttattttctaagattaaaaataataattgctaggtttggtggcacatgcgtacagccccagctacttaggaggctgaagcaggaggatccctagagcccaggagttctgggctgtggtacactatgccagttgggtgtaagtttggcatcaatatggtgatgtccctgaagcaggaaaccacaaacttgcatcaggacgggtgaacccagcccaggttggaaatggagcaggccaaaactcccaggctgatcagtaatgggatcttgcctatgaatagccagtgcactgcagccaggacaacagagtgagaacctgtcttt

SEQ ID NO: 91 - DNA, 4114 bp, Homo sapiens
  ref <308>: DATABASE ACCESSION NUMBER: AB040900
  ref <309>: DATABASE ENTRY DATE: 2001-06-18
gggatgaatggcagcacactgtggtctagtcttctccctgaggaggctcgagatatcacatgtttggagctgatgccaggaagcttggctgaaaccatctgccttgtgacagggacacacaagatgctcagcgcattcaatgcaacgtcagggaaagccatttggactttaaacccaaactacttgtccaacggtaccttggctgccccagttgtggtactgccagacttggatgaagacggtgttcgagaccttgtggttctggccattggggaattgcagccagatctgtgctttctgctggtgtctggccggaccggaaatccagtgggtcgacctgtgaagtacaacatcgttggagttgggaatctgattggtcctcaggtttacatcaccacaaatggggctgtctacatcctgtttggctttggaaatatacaagctgtcgcactgcgggacatttttgttcaggcccaaaatcgagacagctcaccaccttctctgcagatagaagagccagaatgggaaaagcgaagatccatcaacctgtctgagctcattgatgtttacagtgatggtgttgaactactccagatggtgaaggcaccagattccaactgcagcaaccttctgattacaaccagacaaagccttgtgctgcttcgggggcaaaatctgacaccttactgggcattgagacttcaaggcctgcgcagccagcctactcctggatatttcactgatgatcagacattagacttccttctgcagatacaggatggagttgggatgaaaaagatgatggttgtggatggtgactctggctccattgtttggagttaccgtgctccgtgtcacatgaaagaaacgccagccacctcagcagttacttcagaccagaagtctgtcttcctcttctgggccgaagggctgtcagctgcatctcccaattccgatatcatcctaggaactgagccgcccagccttcaccacctttacctcctgcatcctgcgttcccctccatccttctggatctggccaacaccaccggcacagtgacggcttcagaggttggaattaacgacctctggaaagatgccttttatgttaccaggacaacagggccaagctccgaaggccatccagcagccctggtggtcagcaagcttagtctacggtgggcactaatggagggccagatggctcagctacaggagtccacccccaaaattggccgtggggagctgcgaagatttctctctaggataaagtttgttgaagctccctacgagatctaatctgatggaatcttcagttgcagaagaagtgaacagagtggataccctctctactctcctgtcactgtaaaatcagttctatggagagaagacttcttcgtcctcatttaccacctccctgatggttgcaaaggcttgggaaggcatgttggagtctttgacggcagcatgatctatttggctggggcatcttacctaccttttcagtccctgcattaatcccctctaggaactctgcgtggaccgtttggaaatgtgaatctcttaagtatttaatttttttggtatgtctaatttatgaagtcttgctgggaaagccagtgaagtctatgactaggaaacattttgttgtacattgtgctgtgtgtgtgtatattttagtgttgtggtgaagttattttccaggtatgtcctaagcttcagggatccagtttcttgtccttctgaaatatatctggtttgtttggtcattttgagacttccagatgccctacctctgatgttgagggccacttatttctctccttattctttcccacctgtaccttggctacttccaaattgtagacagaatgagaaagatttatagtggaagactgagttagccatccaagcattttcatctctcttgttttatatcctatttccttagattttccatccatgtctattaagtgaccacaagaataactatattcctatcacaaggggagcaagaggatgtagtctcagtgacccatctctgaccaagtccacatgttgtgttatatgtggctctgatggttctgccagtcatgatcttttttctgtggcgacatcagaagtgtatgtttgcatgctgtcttcaacttagaggagaactggaagtcaggagcctttgatgtccttatcctgctgtatgtcttctctgcatctttttctatagggcaccctccttagctcccctcactctgttttctcttctattcagggatatgtttctggactttttcttctgctacttgagtccaggatgcaaccattttgtcctgcatctcttctttcctgtagagcctttgaagcattgtattttgggaaaattcttctgtaaatactataacttttataaatggttaagttatttagaattatctccagtgcttacttctcccttcttctgtataaatctgctacttcaattaagttctcctctaaacttttaggtcattgtttatatagcagaaaattcaatgttagcggatggaaaactgcttcttgaataaccttgataggtcatccctgagtgcacctcaggttctctctttacctgggcttgtatcttttttttttttttttttttttttgagacagagttttgctcttgtcgcccaggctggagtgcagtggcacaatctcggctcactgcaaccttcgcctcctgggttcaagcgattctccagccttagcctcccaagtagctgggactacaggtgcccgctaccatgcctggctaatttttttttttgtatttttagtagagacggggtttcaccatgttggccaggctggtcacgaactcctgacctcagataatccacctgcttctgcctcccaaagtgctgggattacaggcgtgagccaccatgcccggctgggcttgtatcttttagcttgtgttagtaaaaggattctagaaaattatgaagtccagattcaaagggatctctgttaattacccactgacaggcattatgacctaacaggaggttggtagcagtagatccaagcatgcatgttgcctggcctgtagattggccttatcaggtttctgggtgcctctgccttaagatcctgaaggcaaattttgtttcaacagtttggaagtcatctgtgggtccagcttgactttggaggaataagaagatacttctagagtatgggaatgattccagataatttctgggatttgaatctacttgagtttaagggcctgggacctaatttggtttagtatagaatttgaagaattaatttataggcagctgaatacccaaaacttgggtggtggtcctgtggtttggctgagctgtccgggcataacctggttctctgttatgttaaggctttctgggaagccagccactctgcgcaggagtgaaacatgaagttgttttctgaggacctgttttggtgggattgtttgggcagaggactgtgtttatgcagggcaaatcccagaaagataagaggaagctagagaaacttaatgtacctgaattcttcatggtgtatttgcaaactaacttaacatagattcttttgactatggtaagtttgaatctctccttgccaaacaacattataagtttagttttcttcttcctcttgcagccggtacggaaaggtgtaagtggtggctgaaaattgaggaagcttcatctgaccaatgtgggtgctggtttcttgtgaaatgtgtccctaagcctccttctccttgcaggcagccacccacccaggtgtctaagataggacatgctcctttctttctctaatcccatcctgaggttgccggcaaagccaatatgaccactactgagaaatagtaatgacttctacaaatgcaagggtcttaccctcctctttcccttaaacaccctcccttttccttagaccccgtttttgccatcccccaaatgtgtggtatggtgaaactaatcccctgaatgtgaattgctatccttattgccctattaaagaagagccagctggtatattgtcaggaagcactatttaaaatgtgaactgttatagagtaaataaataaatactctacagg

SEQ ID NO: 92 - DNA, 4755 bp, Homo sapiens
  ref <308>: DATABASE ACCESSION NUMBER: AB040914
  ref <309>: DATABASE ENTRY DATE: 2001-06-18
aagagatcttccaggctctcagagccctgggagggcgatttccaggaagaccacaatgccaacctctggaggaggctggagagagaaggcctaggccagagcctgtcaggcaactttggcaagaccaagtcagccttctcatctctccagaacattcctgagagtctgagaagacacagcagcctggagctaggccggggaacccaggagggttaccccgggggcaggcccacctgtgcagtcaacaccaaggcagaagaccctgggaggaaagccgctcctgacctcgggagccatctggaccggcaggtttcctacccgcggcccgaggggaggaccggtgcctcggcttctttcaacagcacagacccaagtcccgaagagccgcctgccccctcgcacccgcacacatccagtctgggccggagggggcccggcccaggcagcgcctcggctcttcagggctttcagtacgggaagccccactgctcggtgctggagaaggtctccaaattcgagcagcgagagcaagggagccagagaccgagtgtgggcggctctggttttggccataactataggccccacaggaccgtctcaacttccagtacttctgggaatgacttcgaggagacaaaagcacacattcgtttctctgagtcagctgaacccctaggcaacggggagcagcacttcaaaaacggggagctgaagttggaagaggcttcccggcagccctgcggtcagcagctgagcggaggagcgtcggacagcggccgtggcccccagaggccggacgctcggctcctccgtagccagagcaccttccagctctccagcgagccagagagggagcccgagtggcgggacaggcccggctcgcccgaatcgcccctgctggatgcccccttcagccgcgcctaccggaacagcatcaaggacgcacagtcccgtgtcttgggggccacctcctttcgacgtcgagacctggagctgggggcgcccgtggcgtcgaggtcctggcggccacggccttcctcggcccacgtggggctgcggagccccgaggcgtcggcctccgcctccccgcacacgccccgggagcggcacagcgtgacccctgctgagggcgacctggccaggcccgtgccccctgccgcccggagaggtgctcgccggcgcctgactcccgagcagaagaagcgctcctactcggagcccgagaagatgaacgaggtggggatcgtggaggaggccgaaccggcacccctgggcccgcagagaaatgggatgcgtttcccggagagcagcgtggccgaccggcgccgtctcttcgagcgcgatggcaaggcctgctccacgctcagcctgtcggggcccgagctgaagcagttccagcagagcgccctggcggactacatccagcgcaagaccggcaagcggcctacctccgccgccggctgcagcctccaggagcccgggccactgcgtgagcgcgcccagagtgcctacctccagcccggccccgcggcgctcgaaggctccggcctcgcctcggcctccagcttgagctcactgcgggagcccagcctgcagccccgcagggaggccacgctcctgccggccacagttgcagaaacccagcaggctccccgagatcgcagcagctccttcgccggtggccgccgcctcggggaacggcgacgcggggacctgcttagcggagcaaacggtggaacaaggggcacccagagaggggatgagacccccagggagccatcctcctggggggccagggccgggaagtccatgtcggccgaggacctgctggaacgctcggacgtccttgcgggccctgtccatgtgaggtccaggtcatctcccgccaccgcagacaagcgccaggatgtgcttttggggcaagacagtggctttggtcttgtgaaggatccatgttatttggctggtcctggatctaggtcactcagttgttcagaaagaggccaagaagagatgctgctgctcttccaccatctcacccctcgttggggtggttcaggctgcaaagccattggtgattcctccgttcctagtgaatgtcctggaaccctggaccatcagaggcaagccagtaggacaccctgccccaggccaccactggcaggaacgcaagggctggtcacagacaccagggctgcacccctgaccccaattggcacccctctgccttcagccattccctctggctactgctcacaggacggtcagacagggcgacagcctctcccgccctacacccctgccatgatgcacagaagcaatggtcacaccctgacccagcctcccggtccaagaggctgtgagggcgatggcccagagcatggggtagaagagggaacgaggaagagggtctcgctgcctcagtggccacctccttctcgagcaaagtgggcccacgcagccagagaggacagccttcctgaggaatcctcagcccctgattttgcaaacctgaagcactatcaaaaacagcagagtcttccaagtttatgcagcacttctgacccagacacacctcttggggccccgagcactccagggaggatctccctccgaatatctgagtctgtcctgcgggactccccgccacctcatgaggattatgaagacgaagtgtttgtgagggatccgcaccccaaggccacgtccagccccacatttgaacctcttcccccacccccacctcctccaccgagtcaggaaaccccggtgtatagcatggatgacttccctccacctcctccccacactgtatgtgaggcgcagctggacagtgaggatcccgaggggccacgccccagcttcaacaaactttctaaagtgacaattgcaagggaaaggcacatgcctggtgcagcccatgtggtaggtagtcagacactggcttccagactccaaacttctatcaagggttcagaggctgagtccacaccaccctccttcatgagcgttcacgcccaacttgctgggtctcttggtgggcagccagcacccatccagactcaaagcctcagccatgatccagtcagtggaactcagggtttagaaaagaaagtcagtcctgatcctcagaagagttcagaagacatcagaacagaggctttggccaaggaaattgtccaccaagacaaatctctagcagacattttggatccagactccaggctgaagacaacaatggacctgatggaaggtttgtttccccgagatgtgaacttgctgaaggaaaacagtgtaaagaggaaggccatacagagaactgtcagctcttcaggatgtgaaggcaagaggaatgaagacaaggaagcagtgagcatgttggttaactgccctgcctactacagtgtgtctgctcccaaggctgagctactgaacaaaatcaaagagatgccagcagaagtgaatgaggaagaggaacaggcagatgtcaatgaaaagaaggctgagctcattggaagtctcacccacaagctggagaccctccaggaggcgaaggggagcctgctcacggacatcaagctcaacaacgccctgggagaagaggtggaggctctgatcagcgagctctgcaagcccaatgagtttgacaagtataggatgttcataggggatttggacaaggtggtcaacctgctgctctccctctcggggcgtctagcccgtgttgagaatgtccttagcggccttggtgaagatgccagtaatgaagaaaggagctctctttacgagaaaaggaagatcctggctggtcagcatgaggatgcccgggagctgaaggagaacctggatcgcagggagcgagtagtgctgggcatcttggccaattacctttcagaggagcagctccaggactaccagcacttcgtgaaaatgaagtccacgctcctcattgagcaacggaagctggatgacaagatcaagctgggccaggagcaggtcaagtgtctgctggagagcctgccctcagatttcattcccaaggctggggccctggctctgcccccaaacctcacgagtgagcccattcctgctgggggctgtactttcagtggtattttcccaacattaacctctccactttaacctcttctaaaatacccaaccaaaagatcactgtttctctcaacactatttaatctgaaaaatgtttcagtacaaaccactgtttgaactatctgggttattggtgtttgttcctgatgaaaggaaaaaaattctctccaggaggaagcctttttccttcttgcccttcctgattgatcttctgagagctcgaatgctgctggacacgtacccctttctattattactttgtagtagaaagaaagttaatgaaactgagaactgattggagggtgtttgatcatttagtttttaacaggctgaggcaacatggatcagtgtgtgtccccctcaggaatgtatccacagtggccttccttgctggtgggcagtgtatcctgatggcagggtacaagtaccattaatgaagggtctgcaacataaagccttaaaaagacacacactaagaaaactgtaaaaccttgaacattgttatttatattttttaaaatggaaaagatcactatgtttgttgtgctaaccacttatttgattctgttttgtggtggacatagatgattacgtttgagctttgtattttgtgaaaaccttaatgaaatgaattccaaagat

SEQ ID NO: 93 - DNA, 4768 bp, Homo sapiens
  ref <308>: DATABASE ACCESSION NUMBER: AB040926
  ref <309>: DATABASE ENTRY DATE: 2001-06-18
tctgcttggcttgtggacaatcagagcatagtttttctctttccatcaggtgagagataacagtatcctggttgatcaatgttttcttctttaatcacagatgatggaaagagaaaaactatgctctgcttggcttgtggacaatccatgagaacagagaaaggactgaaacaattgcttccaggggttccattcctctgtatttcaggcaccaagactcagaagcccttcttacaagggcccttcaaggtcatcagtgtggctgaggttgatttgtcgtgtgacaaggctgaaaaaactctaagttactaccaagcacgtctattgtctttacggatgaagacctgcacgcaagctgcatctcacagtggcatggcagccacacaccagaaggcagtgaaaataattgcatacaaaaatggggatgggtatcgtaatgggaagttaattgtggctggaacattccccatgcttcttacagaatgcacggaacaacttgggcttgccagagcagcctccaaagtatataccaaagatggaaccccaatctttaccttgcgtgatttggttttatgggctctagatgaatcctttctccagagagactctgagaaacaaaagcaagatgcagctcctgttggaaaagaacagataattgttgaaagtatggaagaaaatccaagaatgaaagtgaaaaacagattatttgcaaaatctgtgacatccgatagtttggatggtatagacaagtctttgcttaccctcatcctcagaaatcctattgccatctgggtgtcttgtggtgaaccatttctacctccaaatgctttgcagaaagcagaaaaattagagaaacagaactggctaaaaaaggacagaattttggctgatctagataccatgagacacaaaatgagacagttaaaagggcggcgagtagcggcatgtcagccagccaccatggttcctaccaagagccctgtgcagcccgtggtggttgaaggaggctggaccgaacagactcaacaggaaattaaactcatggaacttataagacatacagaggcacacctttctgaaatccaagaaatggaatccaaaataaattttccaattgcaaccaaacgtatagcagtcaagccgagcaacctgtataagcagcccaacacaaaacgagtgtggatttatctaaatggaggcagacctgaagatggcacttatgcctggggcaaaactatttcagaggtcagcttactttatctgaagacatggatctttatttggagcaggaaagttttcttctattttttgataactgcttaaggttaatgtattctagattcctctccagtaacaccaataatgtataggtttaatatctgatgtcttgacattataaatgtttgacttttctctctcatacactttgtctcttttcctttttctgtatcctgtgagatcttctccacctagtctgccctaataatgatttgaatttctgtaatattgagtcttttttctttcttaccttctctcctcttgtcattcagctctctcttcatcctcacttgaaaccctatttcttctctcactagcagctatacaactttggttattatatttaacctctttgttctccatttttctcatcaacaaaaggtggatactaattatttccacagaacaaaattagattgttcttgagaacttttagaaaaatacccagtccctagaaatgtgtcaatatgttttaatcagtattactgttatcagcagcctcagcatctctcctgtatctgagcaatactcctttcctttaagctgtggttgtctcgtttctgtgtgtatctgtgagtatatttacacacagaagtcatatttttttgaatttaggggtaacacaacacagatacttttgaaaatgtactcctgctgtaaatctttttcaaaatcttcaccttgagtacaatgtaccctttttttatgttgtagaatattttcattagctttacattgttgctattgttgatttttctatttatatttccttgtacaaggagagatcttttgataacagacagaataggttagttctctttggtgaccctagacatctacttgggagctgtcagaatcctccctcaatggtaggttgaaggattggtttgtatgcagagtatttaatcaaattgcttctgactggatggtatttggcaggagtagggctgcatttaaccaacatggcacatgtatacatatgtaacaaacctgcacattgtgcacatgtaccctagaacttaaagtatgataaaaaaatatataaaaatagataacattaaaaaaagactactctcctgttggtcctctctgactatcctattctatagaggggaatatatttttggataatttgaattattattaaattcaatccactcatcccttactcaaaatactgggtgaaaagctgcgctttttgaactgcatcgccccatcactcttcttgtcttggctcatattcctgatgcatttgccagatgcaaggtgtcatcacatgcccagccctgacccctgccattctgccttgttgtgagttgtagcatctaaacagatctataaacagaagtattgatggtgatttggagggctgatgtggacttggcacctgcattttgggggaacaggcttttggccctctaataggtgaaagccatacaggcagctgctgcaagactgctcctctcgtctcaaaatgacccacccagctagagcactgtacacccccagtggagagccaattcagtcctgggacgacatagagcgagatatggtcatctgtgtgtctatgggacatggtttcaaaaccccaaaagagttaaaacaactgatggagatcagagcaaattatgccagaatccgaaggcagcagggccctcaagccacagacattgtggtgtcaccatccacgaagctgctgtctctggcacatctccacaattaactcctatcagaaccatcggattttctgctgtatttttctggaaagaaaactttctttacccacttataaacagaagactgtgacaagaaggccaattatttccatcgctgaagactctaaatttggcaaatcttctaaataacaatcctgcatagtttattaaaaaaaattagtcgtaaaatttatccttcaaaaatctgcattttaaataaaccctgacagtgatttctcaagactgtaaagatattagtctgagaatgcaactctaacagactgctctgggcatcttttctctttgccttggccaggcctctcagaattgagtgagcgtgtgactccatttgcacagtgggacagatgagtacaactgaaataaaaagtggaggcctctgcaaaaaataaaaaataaaaaataaatttatccttcaaaataactcagttttttcaatgggcctattttgaagaatgaacattgaaaaatgagacaatatatccataaattcatagtatgacataccataatcgagagcattgttagccatagacattttgtatgccagtgaaatctgtatacattctctaaatttttccagtttatcgtgtggcttattggaaaaaaaaaaagcatatacactgactgcatgttttgtctccccaactaaatgataagtgcctagagggcaggaacacccttggttttatttacttgggacagagctctacccacaagggctcactgataaaactcatcagtcccaccccacagcaacatgatggggacatgaggttcagttcttctactcttggcctgagccgcaaaccaaaattacaacagtacaatgggaatagaggatctgctttatagaatttcctttcagtcagctgctcagaaactacaatcctcagagtgaaattaaatggagttatactgggatagtcctctctgcttttcagaggaaagaaacacttctcgaaattgtgcaaatgaaagaaatgtcatggtataaactagacatcttatatccttaaaatatatctttgatgattatacatattggtttcaaatcccaagtttgaagaaacatccaaaagttatgtgaaattacttatagatgaattgacaacatttgagacttcgacaggcaatcatgaagcagttctcaagttgatttggtttatatagctctttaagaatcttttggaaagccataatctcacaaaatacagatatgcaattttttttttttgagatggagtctcactctgttgcccagtctggagttcagtggcgcgatctcagctcactacaagctccccttcccaggttcaagcaattctcctgtctcagcctcctgagtagctgggactacaggcgcctgccaccacacccagctaacttttgtatttttagtagagatggggtttcaccttgttggtcaagctggtctcaaactcctgacctcaggtgatccactcgcctctgcctcccaaagtgctgggattacaggcgtaagccaccacacccagcccaaaaaatgtttgtgcacagaactgtggatgtttgtcacagaactttccaaataaagaagttctgataaaagagaagatatttctcatttccataatctttaaggtgtgggggatacgtaatctggacttctcaaatggatgatttctaaatacgcgtcagatgaagtgattctaactttctctgtagtaatatcttattttgttttattcaaaaacaataaaccatgtagatttatt

SEQ ID NO: 94 - DNA, 5294 bp, Homo sapiens
  ref <308>: DATABASE ACCESSION NUMBER: AB040955
  ref <309>: DATABASE ENTRY DATE: 2001-06-18
ggctcgcatccccatagtgctgggttacagtgaaggtacgccccgcgctctgctctggagaggcagggtgggatagggaacgtctcgagtggcgcccgcagtcatggtggtgttcgttggccgccgcctcccggcgctcctagggctgtttaagaagaagggctctgccaaggctgagaatgacaaacatctaagtgtagggcctggccaggggccagggtctgcagtggatgagcaccaggacaacgtcttctttcccagtgggcgacccccccacctggaagagctgcacactcaggcccaggaggggctccgctccctacaacaccaagagaaacagaaactgaacaagggtggctgggaccatggagacacccagagtatccagtcctcccggacggggccggatgaagacaacatctccttctgcagtcagaccacatcctacgtggctgagagctccacagcagaggacgcgctctccatccgctcggagatgatccagcgcaaaggctccaccttccgaccccatgactcatttcccaaatctggaaagtcagggcggcgtcggcgggagcggcggagcactgtgctgggactcccgcagcatgtgcagaaggagcttggcctgaggaatgagcgtgaggcaccaggcacgccccgggctcctggtgcacgggatgccgtacgcatccccacagtggacggccgcccccgaggcacctcagggatgggggcccgggtgtccctgcaggcgctggaggcggaggcagaggctggcgctgagacagaggccatgctgcagcgccacattgaccgtgtctaccgggatgacacctttgttggccggtccacgggtacccgggccccaccattgacccggcccatgtccctagcagtgcctggattgacaggaggggcagggcctgcagagcccctgagcccggccatgtccatctccccccaggccacctacctgtcgaagttgattccacatgctgtgctgccgcctacagtggacgtggtggccctaggccgctgcagcctgcgcacactaagccgctgcagcctgcactcggccagcccagcctcagtccgctcgctggggcgcttctcctccgtctccagcccacagccccgcagccgccacccatcctcctccagtgacacctggagccactctcaatcctccgacaccattgtgtctgacggttccaccctctcctctaagggtggctctgagggccagccggagagctctacggctagcaatagcgtggtaccccctccccagggaggcagtgggaggggctctcccagtgggggcagcactgctgaggcctcagacacactcagcattcggagcagtgggcagttgtctggccggagtgtgtccctgcgtaagctgaagcggcctccaccccctccccgccggacccactccctccatcagcggggcttagcagtgcctgatgggccattagggttgccccctaagcctgagcgtaagcagcagccccagctgcctcggccacccaccactggtggctcagaaggggcgggggcagcaccctgtccacccaacccagccaacagctgggtacctggcttgtctccgggtggttcccggcgccccccacggtccccagaacggacactttcgccctccagtggatactcgagccaaagtggtactcccaccctccctcccaagggcctggcaggtccccctgcttccccaggcaaggcccagccccctaaaccagagcgtgtcacgtctcttcgctcccctggggcctccgtctcctcttccctcacgtctttatgttcctcctcctctgacccagccccctcagaccgctctgggccacagatattgacccccctgggtgacaggtttgtcatacctcctcaccccaaggtgcctgcccccttctccccacctccctccaagcccaggagccctaacccagctgcccctgctctagccgcccctgctgtggttcctgggcctgtttctaccactgacgccagtcctcagtcccctcccactccccagacaaccttgactccactgcaggagtctcctgtcatctccaaagaccagtcacccccaccttccccacccccatcttatcatccacccccaccacccactaagaagccagaggtggttgtggaggcaccatctgcctcagagactgctgaggagcccctccaagatcccaactggccccctcccccaccccctgcccctgaggagcaggacctgtccatggctgacttccccccaccagaggaggcttttttctctgtggccagccctgagcctgcaggcccttcaggctccccagagcttgtcagctccccggctgcttcgtcctcctcagctactgctttgcagattcagcccccgggtagcccagaccctcctccagctccgccagccccagctcctgctagttccgccccagggcatgtggccaagctccctcagaaggaaccggtgggctgtagcaagggtggtgggcctcccagggaggacgtaggtgcgcccctggtcacgccctcgctcctgcagatggtgcggctgcgctccgtgggtgctccaggaggggctcccaccccagcactggggccatcggccccccagaaaccactgcgaagggccctgtcagggcgggccagcccagtgcctgccccctcctcagggctccatgctgcggtccgactcaaggcctgcagcctggccgccagtgaaggcctctcaagtgctcagcccaacggaccgcctgaggcagagccacggcctccccagtcccctgcctcaacggccagtttcatcttctccaagggctctaggaagctgcagctggagcggcccgtgtcccctgagacccaggctgacctccagcggaatctggtggcagaactccggagcatctcagagcagcggccaccccaggccccaaagaagtcacctaaggctcccccacctgtggcccgcaagccgtctgtgggagtccccccacccgcctcccccagttaccctcgagctgagccccttactgctcctcccaccaatgggctccctcacacccaggacaggactaagagggagctggcggagaatggaggtgtcctgcagctggtgggcccagaggagaagatgggcctcccgggctcagactcacagaaagagctggcctgaccaccaggcacctcactggcactgctgacccatcccagaaacacaatctcagggacccgagcagctccaaggacgagaggatacagcagacacaacctaatagagagggcgcctgcagccttaacctccacggccttcgatacttatgcaagcctggtgttgctcctgtcctcagagtcatcctgcgctcatgccttttcccgaatgggttcacctctggcagttgccgcttcagtcttggccttagcctcatcttgaagtgggtagctggcgggagagggtggctgcgccccctgctggccctgaggctgcagagttgggagcaggacacctcacctgagtttcattttttttcatgtccaaaccatgcacatactatagtccagaatcaaagcacttttgaaaagtggctgcatggccatcctccagggcccaggaagttgcattccaagggcctgtttacatggcagcagaatccatccccggcagtcagcccatagcttgggaccagtctgtgccctcctgcccagtccagtttactcctcttggttcctgaaggtggccaagtcattgtgttcccacaggcttctctaggctgggggcaggtgtggggctgtggaattccaaagcacaaaaggtgcagaggggattggccttcctgtgcctcaactcaccaaccaccctcctgccttccagttctgccaggtgctccatgctggggacaagtaggagactgccagggcccaaagaaatgggtgagcagtagagtcatctcggggcacttggcagtgtcaagcacctgccccttgcctccttgaccacactggggtgggtgggcccccagcacttcagaggcaggagcctttgggctgagcaagcactgaggaggtggatggaagggagcatctggagggggggagcttccttgagcagtgggcccaggcctggccctccacacttcattctctgacctttctctctcctcatttcggtgcatgtcctttctgcagctgcctttcagcacaggtggttccactgggggcagctaacgctgagtgacaaggatgggaagccacaggtgcattttactcaagtcttctctagtcaatgaggggcacccagtgcttctagggcaggctgggtggtggtcccctaggtatcagcctctcttactgtactctccgggaatgttaacctttctattttcagcctgtgccacctgtctaggcaagctggcttccccattggcccctgtgggtccacagcagcgtggctgccccccagggccaccgcttctttcttgatcctctttccttaacagtgacttgggcttgagtctggcaaggaaccttgcttttagcttcaccaccaaggagagaggttgacatgacctccccgccccctcaccaaggctgggaacagaggggatgtggtgagagccaggttcctctggccctctccagggtgttttccactagtcactactgtcttctccttgtagctaatcaatcaatattcttcccttgcctgtgggcagtggagagtgctgctgggtgtacgctgcacctgcccactgagttggggaaagaggataatcagtgagcactgttctgctcagagctcctgatctaccccaccccctaggatccaggactgggtcaaagctgcatgaaaccaggccctggcagcaacctgggaatggctggaggtgggagagaacctgacttctctttccctctccctcctccaacattactggaactctatcctgttaggatcttctgagcttgtttccctgctgggtgggacagaggacaaaggagaagggagggtctagaagaggcagcccttctttgtcctctggggtaaatgagcttgacctagagtaaatggagagaccaaaagcctctgatttttaatttccataaaatgttagaagtatatatatacatatatatatttctttaaatttttgagtctttgatatgtctaaaaatccattccctctgccctgaagcctgagtgagacacatgaagaaaactgtgtttcatttaaagatgttaattaaatgattgaaacttg

SEQ ID NO: 95 - DNA, 2614 bp, Homo sapiens
  ref <308>: DATABASE ACCESSION NUMBER: AB040961
  ref <309>: DATABASE ENTRY DATE: 2001-06-18
ctgagagtcggagccacagccagagccctgcccaggccgagccggagctgcagcccgagcgcggtggtgccctcagccccgtcctcttgtcctcctcagcctcggtgccttggaatttgtgtcgctgagtcagcaagcctttcagatttgcccggtttttgttgtttgtggtttgtatcaagatgggaactcaaacaagtcattcctcctaaggagctggtgtcttcatccagaagggacagtttgtgccagctctccagagagaaaagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccggcaccatgcgagctgtgcggagacacctgttcccccagcactcagcccctggccgaggtgtcgtctgggagtggctgagcgacgatggctcctggactgcctatgaagccagcgtctgtgactatctggagcagcaggtggccaggggcaaccagctcgtggacttggcccccctggggtacaactacactgtcaactacaccacccacacgcagaccaacaagacttccagcttttgccgcagcgtgcggcgccaagcagggccgccttacccggtgaccaccatcatcgctccgccgggccacacaggcgtcgcctgctcttgccaccagtgcctcagtggcagcagaactggccccgtgtcaggccgctaccgccactccatgaccaacctccctgcataccccgtcccccagcaccccccacacaggaccgcttctgtgtttgggacccaccaggcctttgcaccgtacaacaaaccctcactctccggggcccggtctgcgcccaggctgaacaccaccaacgcctggggcgcagctcctccttccctggggagccagcccctctaccgctccagcctctcccacctgggaccgcagcacctgcccccaggatcctccacctccggtgcagtcagtgcctccctccccagcggtccctcaagcagcccagggagtgtccctgccactgtgcccatgcagatgccaaagcccagcagagtccagcaggcgctcgcaggcatgacgagtgttctgatgtcagccattggactccctgtgtgtcttagccgcgcaccccagcccaccagccctcccgcctcccgtctggcttccaaaagtcacggctcagttaagagattgaggaaaatgtccgtgaaagaagcgaccccgaagccagagccagagccagagcaggtcataaaaaactacacggaagagctgaaagtgcccccagatgaggactgcatcatctgcatggagaagctgtccgcagcgtctggatacagcgatgtgactgacagcaaggcaatcgggtccctggctgtgggccacctcaccaagtgcagccatgccttccacctgctgtgcctcctggccatgtactgcaacggcaataaggatggaagtctgcagtgtccctcctgcaaaaccatctatggagagaagacggggacccagccccagggaaagatggaggtattacggttccagatgtcgctccccggccacgaggactgcgggaccatcctcatagtttacagcattccccatggtatccagggccctgagcaccccaatcccggaaagccgttcactgccagagggtttccccgccagtgctaccttccagacaacgcccagggccgcaaggtcctagagctcctgaaggtggcctggaagaggcggctcatcttcacagtgggcacgtccagcaccacgggtgagacggacaccgtggtatggaacgagatccaccacaagacagagatggaccgcaacattacgggccacggctatcccgaccccaactacctgcagaacgtgctggctgagctggctgcccagggggtgaccgaggactgcctggagcagcagtgacctcgcaccccagcacgcccgcctctggtggccaccccgctgccccatggctggctgggtggccaggcaggaagtgcccagcccgagaggctgggaggtttgttgagggtgtggggtgtgccccacctgaagccggggctccccctgcctgcctctctctcctcctcccctctgggaattgggcagccctgggcagttgtactcatgggggcttaggatgcagctacctcagtgcgcagggcccgtctgtcctctgggggctgcttcgggcccgcggtgctcggggcctggtgtggggcgagtagagacttccccagcctggacgggcgtgggttctgggtcagcttcttttacctcaattttgtttgcaataaatgctctatagcc

SEQ ID NO: 96 - DNA, 575 bp, Homo sapiens
  ref <308>: DATABASE ACCESSION NUMBER: AB041269
  ref <309>: DATABASE ENTRY DATE: 2001-06-18
ccaccattgagaacgccaggattgtcctgcagatcaacaatgctcaactggctgcagatgacttctgaaccaagtttggtttgagtgtttgggtgctggatgaggtgaccctggccaggactgatctggaggcacagatcaaaggcctgaaggaagagctggcctacctgaagaagaagcatgaggaggaaatcaatgccctgaggggccaagtgggagaccaggtccatgtgagggtggattcagctcggacctgccaagatcctgagtgacaggcaaagccaatatgagatcatggccaagcagaactggaaggatgctgaagcctggttcaccagctggactgaggaactgaaccaggaggtcactggccacatagagcagctccagataagcaggtccgaggtcactgacctgcagtgcaccctccagggtcttgagattgagctgcactcgcagctcagcgtgaaagctcccttagaaggcacactggcagaaacagaggcatgctttggagcccagctggtgcagatccaggcactgatcagcagtattgaagcccagctgggcgatgt

SEQ ID NO: 97 - DNA, 1755 bp, Homo sapiens
  ref <308>: DATABASE ACCESSION NUMBER: AF000974
  ref <309>: DATABASE ENTRY DATE: 2001-06-18
cgcccgggcaggtcccaaaattaggggggaagaggaaaaaaaaaagccagaaaaagttttcttttctggagtcccaaacgaggtgcgggacggaagagggggtgaaggccagaggctcggggcttcaagaccgctgtctggagtccccctttccaggccatgtcggggcccacctggctgcccccgaagcagccggagcccgccagagcccctcaggggagggcgatcccccgcggcaccccggggccaccaccggcccacggagcagcactccagccccaccccagggtcaatttttgcccccttccatctgagcagtgttaccaggccccagggggaccggaggatcgggggccggcgtgggtggggtcccatggagtactccagcacacgcaggggctccctgcagacagggggggccttcgccctggaagcctggacgccgagatagacttgctgagcaccacgctggccaaactgaatgggggtcggggtcatgcgtcacggcgaccagaccgacaggcatatgagcccccgccacctcctgcctaccgcacgggctccctgaagccaaatccagcctcgccgctcccagcgtctccctatgggggccccactccagcctcttacactaccgccagcaccccggctggcccagccttccccgtgcaagtgaaggtggcacagccagtgaggggctgcggcccacccaggcggggagcctctcaggcttctgggcccctcccgggcccccactttcctctcccaggccgaggtgaagtctgggggcctggctataggagccagagagagccagggccaggggccaaagaggaagctgctggggtctctggccctgcaggaagaggaagaggaggcgagcacgggccccaggtgcccctgagccagcctccagaggatgagctggataggctgacgaagaagctggttcacgacatgaaccacccgcccagcggggagtactttggccagtgtggtggctgcggagaagatgtggttggggatggggctggggttgtggcccttgatcgcgtctttcacgtgggctgctttgtatgttctacatgccgggcccagcttcgcggccagcatttctacgccgtggagaggagggcatattgcgagggctgctacgtggccaccctggagaaatgtgccacgtgctcccagcccatcctggaccggatcctgcgggctatggggaaggcctaccaccctggctgcttcacctgcgtggtgtgtcaccgcggcctcgacggcatccccttcacagtggatgctacgagccagatccactgtattgaggactttcacaggaagtttgccccaagatgctcagtgtgcggtggggccataatgcctgagccaggtcaggaggagactgtgagaattgttgctctggatcgaagttttcacattggctgttacaagtgcgaggagtgtgggctgctgctctcctctgagggcgagtgtcagggctgctacccgctggatgggcacatcttgtgcaaggcctgcagcgcctggcgcatccaggagctctcagccaccgtcaccactgactgctgagtcttcctagaagtacctgctgggttctcagttccagttcccatcctttgattgatcactctccctgacatccacctgtatgactttgtcaccaaatgctgtcttctctttctccaatcaagaaataataatccctcgagtttacaaaaaaaaaaaaaaaaaaaa

SEQ ID NO: 98 - DNA, 1007 bp, Homo sapiens
  ref <308>: DATABASE ACCESSION NUMBER: AF005487
  ref <309>: DATABASE ENTRY DATE: 2001-06-18
gaatacagaatgtgggcaaactcgcttctgtgccggccgccagaaggtttgctgagggcaatcactccctggtgccgggctccttgaggttatgcactgggacatctagagcctattgtttgaggaatgcagtcttgcaagcctgctctggatcaagccacagactgaaacacccccgaagagcaagcacgtttcttggagcaggctaagtgtgagtgtcatatcttcaatgggatgaagcgggtgcagtacctgaacagatacatccataaacgggaggagaacctgcgcttcgacagcaacgtggaggagttccaggcagttacggaactggggcggcctgtcgcagagaactggaacagccagaagggcatcccggaggagaagcgggacaagatggacgactactgcagatacaattacggggttttttgagagcttcacagtgcagccgcgagtccatcctaaggtgactgtgtatcctgcaaagacccagcccctgcatcaccgcaaccccctggtcggctctgtgagtggtttctatccaggcagcattaaagtcaggtggttccagaatggtcaggaagagaaggctgcggtggtctccataggcctgatccagaatggagattggaccttccagaccctggtgatgctggaaacagttcctcggagtggagaggtttacacctgccaagtggagcatccaagcgtgacgagccctctcacagtggaatggagtacacggactgaatctgcacagagcaagatgctgagtggagtcgggggctttgtgctgggcctgctcttccttgggacagggctgttcatctacttcaggaatcagaaaggacactctggacttcagccaacaggactcctgcgctggactcctgagctgaagtgcacatgaccacattcaaggaagaaccttctgccacagctttgcaggatgaaaagctttcccacttggctcttattcttccacaagagctctctcaggacca

SEQ ID NO: 99 - DNA, 1825 bp, Homo sapiens
  ref <308>: DATABASE ACCESSION NUMBER: AF007153
  ref <309>: DATABASE ENTRY DATE: 2001-06-18
aaaatccatgttgtttaatagaatgccatcctttacctacttttgctctgtatggacgtttttcttttcatgctctagtgagctttccctatatcatgagaagtggttatatttgtgcaaatatacaaatataggaaaacaaagattcatacctgtaggcaatagtctaacttgtccaaaccactttgcctttactgctatttttatccccaatgcgtagatatttcccccaggcctatagcctttgtgaaggaaagcaaatcatacctcctgtatattgacacgaatctggttttcaaatgtcatttccagattttttagttaattgggggttgtccttttcccttaatgtgagagtcattttcctgtatatttctggatctctcaggggctgggaggggggagtgaggggactacaaccatagcactccaagaacccttttgggattactccagtaatcaactacgaaagttattttctaaatgtagatatgtaaggtgttcttttaaagtaaggtactttgaaatatgtagcataaactggtactgctgttaaatgggtcgattattaaacggagcagctgtgtgagggcagctaactttgaatgcctgtctccctggctggtgtgtctccttctcatgttgagagcaccagggattgcgtggctgcatgctgaaaccgcattttcccatggtgtatgactagttcatctctttcttgagcaccattacaagaagatcaaatgaaaatgagatcaatgtggaagacaattcatagcacaaaaaaagtcatcttaaatctactctcaaacattcatcttatacatgcatcaaagtaatttactgacatcagtttgggtgagagagggagtcactttactgaaaaggcagaggcttaaggtgtatacatttgtactcacttccttattttcttaacttgtaagcagaaaacaagccctctctcttgtgaagtatcttcaaaggattggggtgcaaaaataccttgctggtaagccatcaatgttttatttaaatccctgcattcaaagttagctgcctttttgaaataaacaaacaaaaaatactactgtatgtttgaaaatgtgaatagtatttttatagcttgtttaaagacatggctagttgcatttgtaaataagtataatgttgctttgattttcttttgtggacatctttatttggaacataattgtctttagggttgatttgtatataagtaattggcctgtgattgtttcttttttggttggaagttatcattttgacattacttgtgattctgtgttcagcactattgtgatgtgttcaacctctgcactcgcttacacaataggatatgccaattgtgtgtggtgtaatgttattttgatttttttccatgttattgatgaaggatcatgcacctaacacatactaacttttttaatgttaggcatatttttagtatactttctcttattctttcttctcctccaaccttttacccatcctccttcctttccctcattcctgttgttatttgagaatgagggagaaacagtattttacatttatgtaattaggcttttccgttagttctcaaggatcctcttttggctcttgggaaagaattgtacctgtacaaggcaattatagaatgcgaactgctttgcctcattccatactgatcatcccagctgaacaatttgaaaactgttctgcctttttgttacatgaatctgtcagaaatatatttttaatttaatataaatgaaattcaataaaatatgaaacaaaaaaaaaaaaaaaaaaaaaaaaaaaaaaa

SEQ ID NO: 100 - DNA, 1387 bp, Homo sapiens
  ref <308>: DATABASE ACCESSION NUMBER: AF007155
  ref <309>: DATABASE ENTRY DATE: 2001-06-18
cctcgtgccaagttccttcctgtgtatcaccccagccctgaggagagcagggaccccaccctctatgccaacaatgttcagagggtcatggcacaggctctgggcattccagccaccgaatgtgagtttgtagggagcttacctgtgattgtggtgggccggctgaaggtggcgttggaaccacagctctggggaactgggaaaagtgcttcggaaggctgggctgtccgctggctatgtggacgctggggcagagccaggccggagtcgaatgatcagccaggaagagtttgccaggcagctacagctctctgatcctcagacggtggctggtgcctttggctacttccagcaggataccaagggtttggtggacttccgagatgtggcccttgcactagcagctctggatgggggcaggagcctggaagagctaactcgtctggcctttgaggtaatggggggtggcggtggtggggggtgcttagtggctatgctcaccccgctccaggaggcctattttggtatgctgtttccagtagcttctagatactaggcatttggtatccaacctagtgccacagtgcctaaaactgcagacccccggcctctatgttgagacctagctgggcacaagaagaaggaagaagaaggaaaaagctataaagtctacagttctgcagaaagggcactggagggtcagggaaggcttgtgcaccacccttttggaagaggaggagcctgtcaggccagtctgtggggcagggtgaggccatggcatgaggagagaacttgactcttatccctttctctcccaagctctttgctgaagagcaagcagagggtcccaaccgcctgctgtacaaagacggcttcagcaccatcctgcacctgctgctgggttcaccccaccctgctgccacagctttgcatgctgagctgtgccaggcaggatccagccaaggcctctccctctgtcagttccagaacttctccctccatgacccactctatgggaaactcttcagcacctacctgcgccccccacacacctctcgaggcacctcccagacaccaaatgcctcatccccaggcaaccccactgctctggccaatgggactgtgcaagcacccaagcagaagggagactgagtgcctcagcctctcaccccctcctcctcagggcagcgctaggggcctcccctatgcctcagccccatctctgctcctgtttgaattttgttattgttgtttggttgttgtttttttaagttgattttaattttttgtttggttgatttttttgtaaaaaactattttatatataaatataaatctatatctatatctattaaaaaaaatgaagtccaaaaaaaaaaaaaaaaaa

SEQ ID NO: 101 - DNA, 2853 bp, Homo sapiens
  ref <308>: DATABASE ACCESSION NUMBER: AF015041
  ref <309>: DATABASE ENTRY DATE: 2001-06-18
cggatcatttaggtgacactatagaatacggatccgtcgacggccattaccaatcgcgaaaccgctcgcgcgcgtgcatcccgcaccatcccccggccccgggccctggccggcgtcagaccgagctgccgccgccaccaccgcagcagcagcagtcggggagccaggcccagccagggccgcgggaggcgggggcgcccgggccctggatgtcccgcagcgcggcggccagcggcggaccccggaggcctgagcggcacctgcccccagccccctgtggggccccggggcccccagaaacctgcaggacggagccagacggggcgggcaccatgaacaagttacggcagagcctgcggcggaggaagccagcctacgtgcccgaggcgtcgcgcccgcaccagtggcaggcagacgaggacgcggtgcggaagggcacgtgcagcttcccggtcaggtacctgggtcacgtggaggtagaggagtcccggggaatgcacgtgtgtgaagatgcggtgaagaagctgaaggcgatgggccgaaagtccgtgaagtctgtcctgtgggtgtcagccgatgggctccgagtggtggacgacaaaaccaaggatcttctggtcgaccagaccatcgaaaaggtctccttttgtgctcctgaccgcaacctggacaaggctttctcctatatctgtcgtgacgggactacccgccgctggatctgccactgttttctggcactgaaggactccggcgagaggctgagccacgctgtgggctgtgcttttgccgcctgcctggagcgaaaacagcgacgggagaaggaatgtggggtcacggccgccttcgatgccagccgcaccagcttcgcccgcgagggctccttccgcctgtctgggggtgggcggcctgctgagcgagaggccccggacaagaagaaagcagaggcagcagctgcccccactgtggctcctggccctgcccagcctgggcacgtgtccccgacaccagccaccacatcccctggtgagaagggtgaggcaggcacccctgtggctgcaggcaccactgcggccgccatcccccggcgccatgcacccctggagcagctggttcgccagggctccttccgtgggttcccagcactcagccagaagaactcgcctttcaaacggcagctgagcctacggctgaatgagctgccatccacgctgcagcgccgcactgacttccaggtgaagggcacagtgcctgagatggagcctcctggtgccggcgacagtgacagcatcaacgctctgtgcacacagatcagttcatcttttgccagtgctggagcgccagcaccagggccaccacctgccacaacagggacttctgcctggggtgagccctccgtgccccctgcagctgccttccagcctgggcacaagcggacaccttcagaggctgagcgatggctggaggaggtgtcacaggtggccaaggcccagcagcagcagcagcagcaacagcaacagcagcagcagcagcagcagcaacagcagcaagcagcctcagtggccccagtgcccaccatgcctcctgccctgcagcctttccccgcccccgtggggccctttgacgctgcacctgcccaagtggccgtgttcctgccacccccacacatgcagcccccttttgtgcccgcctacccgggcttgggctacccaccgatgccccgggtgcccgtggtgggcatcacaccctcacagatggtggcaaacgccttctgctcagccgcccagctccagcctcagcctgccactctgcttgggaaagctggggccttcccgccccctgccatacccagtgcccctgggagccaggcccgccctcgccccaatggggccccctggccccctgagccagcgcctgccccagctccagagttggacccctttgaggcccagtgggcggcattagaaggcaaagccactgtagagaaaccctccaaccccttttctggtgacctgcaaaagacattcgagattgaactgtagtccgagccgccccacccactccatcatctccaggtgccccacgcctgggggtggaggcacaacctctcccctaaccctgctccctggggctgcgcccctcaacaccctctcaacacccccctccctcaaccaccccgacaaccactacagaaccaacattgtgacgcccaggttgcaacaggatggaattcagggacggacccagcctggctaagggaaccatttcactgccggacttaggctggcaatgcccccttccccaaccccagacacaggggttggccacaatcccactgaatgcccttggttcacactccatttcccagtttctgttgacccccaccttccagtgttggacaggatggaggggggacacttgcttaggggctctcctgggccccacaccagtgcccaccccaaatctggtcgtctcctccccccatgcacagcacaagctaagggctgccctctgaccacacgctgcgttcactgccaatgctgtactcacctccatcaccctccaactttggggcccatgtcttccttgggccaaggtctcatgggggctagcgccaagttgggggcccaggaggcggggagggaggaggaggagaagatgcgcagttacctcatgtcggtgcccgctggggaggggtccgggaagaaggggaaggggtgcctggcgggtacttttctatcttttatttccagattttttttgtatctaaacttgaagatttgtattatacaaggacagccaataaaggaagaatataaaaaaaaaaaaaaaaaaaaaaaaaaaaaaacaaaaaaa

SEQ ID NO: 102 - DNA, 1642 bp, Homo sapiens
  ref <308>: DATABASE ACCESSION NUMBER: AF016004
  ref <309>: DATABASE ENTRY DATE: 2001-06-18
taaaaagcaaaagaattccggggtagttatgggaaagaacctagagagcaagaagaaaagaggaatggtgcccgaatctgggagagatagacttcaggatggccagtcattgaatgggggataggtgaagaacagagcctctcaatcagacgggtgtaaataagagacggaggggagtccaaaagaaaaggaagaggaggaaaaacaagtgtgtgttggggggaacagggggaaaagcatttttggtggatggtatgaagccagccatggaaactgcagccgaggaaaatactgaacaaagccaagagagaaaaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctgatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaaa

SEQ ID NO: 103 - DNA, 2890 bp, Homo sapiens
  ref <308>: DATABASE ACCESSION NUMBER: AF016495
  ref <309>: DATABASE ENTRY DATE: 2001-06-18
gtcgcagattcaaacaaatagcagcgaacagggaatgacagttccaccagaagacgattaagccacagcctctaattggaacggcatttgtacagtcagagactcttaccagacatctccaggaatctgtgagccattgtcaaaacgtccattttcatctggctgtgaaagtgaggaccacaacaggtaggtattggtagaaacaggagtcctcagagaagccccaagatgcagcctgagggagcagaaaagggaaaaagcttcaagcagagactggtcttgaagagcagcttagcgaaagaaaccctctctgagttcttgggcacgttcatcttgattgtccttggatgtggctgtgttgcccaagctattctcagtcgaggacgttttggaggggtcatcactatcaatgttggattttcaatggcagttgcaatggccatttatgtggctggcggtgtctctggtggtcacatcaacccagctgtgtctttagcaatgtgtctctttggacggatgaaatggttcaaattgccattttatgtgggagcccagttcttgggagcctttgtgggggctgcaaccgtctttggcatttactatgatggacttatgtcctttgctggtggaaaactgctgatcgtgggagaaaatgcaacagcacacatttttgcaacatacccagctccgtatctatctctggcgaacgcatttgcagatcaagtggtggccaccatgatactcctcataatcgtctttgccatttttgactccagaaacttgggagcccccagaggcctagagcccattgccatcggcctcctgattattgtcattgcttcctccctgggactgaacagtggctgtgccatgaacccagctcgagacctgagtcccagacttttcactgccttggcaggctgggggtttgaagtcttcagagctggaaacaacttctggtggattcctgtagtgggccctttggttggtgctgtcattggaggcctcatctatgttcttgtcattgaaatccaccatccagagcctgactcagtctttaaggcagaacaatctgaggacaaaccagagaaatatgaactcagtgtcatcatgtagtggcatgctcagctctggatttgcagtcagtttgggattctcttcagaaagatggcatctaagtgtctgtgttcttgtaagcctgaggtggaatccacccagttttgtctgctagccatatgggacatctaattggaaaagcatctgcataaaagtttggaaacaatgaccacttctctaccattgtcccccaccccaccccccagaataacgctgactgtcccctgaaacagccttctctcctgccctgtttatttcatcctcgatgggaattcttgctaggtaagcactaataactcggcatcttgacgatagtcccatttgggtggtttcagctgcactatctgtatgaaatggtgtcaccaaaacccttttcttcagtatcgacaaagattacattctgagtaccaaccaaaccctaaattgaaagacaaaactatggtttcagtcaacatattcatgaattagggagctaatgggttaagcttccagttcccgctatgctactggatttgtataaatactgatattctccaaacctagtggtgtagggagcaagagaatgcagctggaaggcacaaggggaggacattgtggcattcagaaactgcaggagacaagatgaatttgagaagccaaatggaatttttaatggaaaccatttatcagattaatctcttgctctcctgcattttagaggacaccaattaatttcctggtctttagtatataataacctaaaataccattgtaacctcagtcatgaaaaatacatcactctgtctttttagctcaaatgtattttcctaattgcccacttgagaacagacatttgacaagttatatcaacgactgtgcttgtccattattttacacatgccctagaagccaaaactgaaagccactggatcctggtctagctgaatcttcagagtgggaggtctccaaaaagatattaccttattgggcttaacaattcacaaggcactttcacacccattatctaatttaatcctcataatgactatgtgaggcaaatgccacattgcccatttttcagataaagaaacaaaatcttagggaagataagttgagttgtccaagagcacactgaaagttgaatgttatctaatgcattcctctacctttcagaagatcagtagctggctgagaatctttgccaaatcttccttgctagccagaagtggaattggcagcttctagaatatgtacacctctggacaaaatgttcctcaatcttaagatacaaagaccctcattgtctgggtctattcccacacttactgagtacagatgaaggaaagtggtagcaatttaatcataactttcatttgctgaaaaacattatgagaaggcctcccttcctaagccacctctggtcttgctaagtcttgatcttgcttcctgccagcaccaaacattacattcaggggatttcctctggctcagtcttttccccttgaagttctctaatagatgttacttttgacaaaagatcgcctatgagttacaagcaccaggggatgctctacatcaagggatgcaccttcagtcaaactgtcaaaaagcccagaattcccaaaggcattaggtttcccaactgctttgtgctgatatcagaacagcagaaattaaatgtgaaatgtttctgatgacttatgttctacaatctatggacatacgggatttttttttcttgctttgaagctacctggatatttcctatttgaaataaaattgttcggtcattgtt

SEQ ID NO: 104 - DNA, 762 bp, Homo sapiens
  ref <308>: DATABASE ACCESSION NUMBER: AF020919
  ref <309>: DATABASE ENTRY DATE: 2001-06-18
gcagagaccggctagactttactcaatttgaagagaaatttataggatctgcagaagatttgggaaagttaagaaatgatgggagtttgatgttccagcaagtaccaatggttgagattgatgggatgaagttggtacagaccagagcccttctcaactacattgccagcaaatacaacctctacgggaaagacataaaggagagagccctaattgatatgtatacagaaggtatggcagatttgaatgaaatgatccttcttctgcccttatgtcgacctgaggaaaaagatgccaagattgccttgatcaaagagaaaacaaaaagtcgctatttccctgccttcgaaaaagtgttacagagccatggacaagactaccttgttggcaacaagctgagccgggctgacattagcctggtggaacttctctactatgtggaagagcttgactccagccttatctccaacttccctctgctgaaggccctgaaaaccagaatcagcaacctgcccacggtgaagaagtttctacagcctggcagcccaaggaagcctcccgcagatgcaaaagctttagaagaagccagaaagattttcaggttttaataaagcagccatggaggctaagaacatgcaagaccaatattctaaagttttgcaacaatgaagtgctttacttaagtgttgattgtgcctgttgtaaagctaatgaaccctttccaattatatgctaattaaataataaaaactcctatttgct

SEQ ID NO: 105 - DNA, 3200 bp, Homo sapiens
  ref <308>: DATABASE ACCESSION NUMBER: AF026941
  ref <309>: DATABASE ENTRY DATE: 2001-06-18
caggaagggccatgaagattaataaagatttggactcagggcaaatatttacttagtagcaataactcaaagaattactgttgaataaataagccaattaagcagccaatcacgtactatgcggatgcacacaaatgaaaccctcacttcaacctgaagacattcgcacatgagttacgtagagggacctgcaggaagcggtagagaaaacataaggcttatgcgtttaatttccacaccaatttcaggatctttgtcactgacagcagcactaagacttgttaactttatatagttaagaagaacaaggctgagcgcgatgactcacgcctgtaagcctagaactttgggaggccaaagcaggcagactgcttgagcccaggagttccagaccagcctgggcaacatggcaacaccccatctctacaaaaaaatacaagaatcagctgggcgtggtgatgtgttcctgtaatctcagctactcgggaggcagaggcaggaggattgcttgaacccgggaggcagaggttgtagttagccgagatctcgccactgcactccagtctggacgacagagtgagactcagtctcaaataaataaataaatacataaatataaggaaaaaaataaagctgctttctcctcttcctcctctttggtctcatctggctctgctccaggcatctgccacaatgtgggtgcttacacctgctgcttttgctgggaagttcttgagtgtgttcaggcaacctctgagctctctgtggaggagcctggtcccgctgttctgctggctgagggcaaccttctggctgctagctaccaagaggagaaagcagcagctggtcctgagagggccagatgagaccaaagaggaggaagaggaccctcctctgcccaccaccccaaccagcgtcaactatcacttcactcgccagtgcaactacaaatgcggcttctgtttccacacagccaaaacatcctttgtgctgccccttgaggaagcaaagagaggattgcttttgcttaaggaagctggtatggagaagatcaacttttcaggtggagagccatttcttcaagaccggggagaatacctgggcaagttggtgaggttctgcaaagtagagttgcggctgcccagcgtgagcatcgtgagcaatggaagcctgatccgggagaggtggttccagaattatggtgagtatttggacattctcgctatctcctgtgacagctttgacgaggaagtcaatgtccttattggccgtggccaaggaaagaagaaccatgtggaaaaccttcaaaagctgaggaggtggtgtagggattatagaatccctttcaagataaattctgtcattaatcgtttcaacgtggaagaggacatgacggaacagatcaaagcactaaaccctgtccgctggaaagtgttccagtgcctcttaattgaaggtgagaattgtggagaagatgctctaagagaagcagaaagatttgttattggtgatgaagaatttgaaagattcttggagcgccacaaagaagtgtcctgcttggtgcctgaatctaaccagaagatgaaagactcctaccttattctggatgaatatatgcgctttctgaactgtagaaagggacggaaggacccttccaagtccatcctggatgttggtgtagaagaagctataaaattcagtggatttgatgaaaagatgtttctgaagcgaggaggaaaatacatatggagtaaggctgatctgaagctggattggtagagcggaaagtggaacgagacttcaacacaccagtgggaaaactcctagagtaactgccattgtctgcaatactatcccgttggtatttcccagtggctgaaaacctgattttctgctgcacgtggcatctgattacctgtggtcactgaacacacgaataacttggatagcaaatcctgagacaatggaaaaccattaactttacttcattggcttataaccttgttgttattgaaacagcacttctgtttttgagtttgttttagctaaaaagaaggaatacacacaggaataatgaccccaaaaatgcttagataaggcccctatacacaggacctgacatttagctcaatgatgcgtttgtaagaaataagctctagtgatatctgtgggggcaatatttaatttggatttgattttttaaaacaatgtttactgcgatttctatatttccattttgaaactatttcttgttccaggtttgttcatttgacagagtcagtattttttgccaaatatccagataaccagttttcacatctgagacattacaaagtatctgcctcaattatttctgctggttataatgcttttttttttttttgcttttatgccattgcagtcttgtactttttactgtgatgtacagaaatagtcaacagatgtttccaagaacatatgatatgataatcctaccaattttcaagaagtctctagaaagagataacacatggaaagacggcgtggtgcagcccagcccacggtgcctgttccatgaatgctggctacctatgtgtgtggtacctgttgtgtccctttctcttcaaagatccctgagcaaaacaaagatacgctttccatttgatgatggagttgacatggaggcagtgcttgcattgctttgttcgcctatcatctggccacatgaggctgtcaagcaaaagaataggagtgtagttgagtagctggttggccctacatttctgagaagtgacgttacactgggttggcataagatatcctaaaatcacgctggaaccttgggcaaggaagaatgtgagcaagagtagagagagtgcctggatttcatgtcagtgaagccatgtcaccatatcatatttttgaatgaactctgagtcagttgaaatagggtaccatctaggtcagtttaagaagagtcagctcagagaaagcaagcataagggaaaatgtcacgtaaactagatcagggaacaaaatcctctccttgtggaaatatcccatgcagtttgttgatacaacttagtatcttattgcctaaaaaaaaatttcttatcattgtttcaaaaaagcaaaatcatggaaaatttttgttgtccaggcaaataaaaggtcattttaatttaaaaaaaaaaaaaaaaaaaaaaaaaaaaaaaaggcca

SEQ ID NO: 106 - DNA, 1016 bp, Homo sapiens
  ref <308>: DATABASE ACCESSION NUMBER: AF035191
  ref <309>: DATABASE ENTRY DATE: 2001-06-18
cctgagtgagtctctggcgtcccaaattgcctgtttttctcgcaggctctattccgttcgctggttcgccacctcaggggaacgatggccatggagtccacagccactgccgccgtcgccgcggagctggtttctgccgacaaaattgaagatgttcctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctccttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgctgaatacaagaaagaaattgaggaactaaaggaactgctacccgaaattag

SEQ ID NO: 107 - DNA, 1799 bp, Homo sapiens
  ref <308>: DATABASE ACCESSION NUMBER: AF035284
  ref <309>: DATABASE ENTRY DATE: 2001-06-18
gcttgaaccggggaggtggaggttgcagtgagctgagatcacgccattgtactccagcctgggcgacagagcaagactccatttcaaaaaaaaaaaaaaaaaaaaaaatccactcatataaaaggtgagctcagctcactggtccatttctcagtggcttctccatcctcatttgcaaacctcagagggataaggcagttgaacctgatgagcaagaattataacagcaaggaaacattaatgcttagaattctgagatccagcacaactcagtctgtgggagctcagctcgctgcccagggataggtatgacctatgtctgccttaggctgctgggagatgccattctccagtttcagaagcaggcagggcaaaggtcaagactgtggtattggggtcttttggctctgaaggatcctggaaccactgattttggtttattccctccagggtctaaagagaacaagaggtgctagctcttaccaaaacagatggtagagagagttgctggctatttaaaaagctctttcatcttttaattcacctcttcttttcacctctttaaccactcctcaggaacagaacacttctaggactgggggtcttttagctccataagcaagtgagcagatgggacaagttagtcttttctccctagaaacaaaggggatgcccagtggtttccctttgcttcccaacctaaaatttcaagtttaataaaatagcaattagcagaagtgaccaaattgggagataattatcagtcatgaggaaagacacagatttcggtcataaagaatgtaagggctataagtagaaactttctataacctaaatgatgttatagaattatttttgagcaggagcagaaagattaaatatgatcacttcatacttctaaatcagaaataggaagattaaaaccacagaacagtttgtgatttctattgctggtagctaggtatcttactctgtccactcttgttcaagtatctaactcttctggaaaccaaataggctttagaagagattatcctatattcctatcagtataatactaaaatgtaactttttaatcatctggtttttaaaagataaacagtttagcccatctctccagagagcaaacataggaatatgactcaggagcctcctagggcttatcatcagccctcacacccgcttccccctccaacccacagcctttgcttccaggtggcaggattactactttgcctcttcagcagcatctactctaggcatattgatcattttagacactgggagaagagaacctcaaactaggaggaaaagacagagcctccacttagttttgggaggggatggcagacagtcaaggagatgagcgtcctaaggcatgttgggatagggtcagatgcaccacccatggagaggtttgtcaacacaaagacatggaaggttagaggtttgtcaacaaaaagacatggaaggttaggtttgtcaacacaaagacatggaagattagaggtttgtcaacacaaagatacaggaagaatgggctgcagaagatttagatgttttccatttgggcacattttacttagctggagaactaggtttaaaacagcctgggtaggaaaattagaagcaagctggatgcagtggctcatgcctgtaatcccaacacttttgggaggtccaggcaggaggatcacttgggcccaggaggtcaagcctgcagcgagctgagatcacaccactgcactccagcctggggtgatagaacaagaccctgtctcaaaaaaaaaaaaaaaaaa

SEQ ID NO: 108 - DNA, 1672 bp, Homo sapiens
  ref <308>: DATABASE ACCESSION NUMBER: AF035318
  ref <309>: DATABASE ENTRY DATE: 2001-06-18
atcacattgaatggttaatttatttttaattctatgaaaggagctggagagagagaagtaaaatattcaggggattttctgtgttttaaaagagaaaacctcctgattgcaagctctaaaataaatgctaagatttgtcacactttcagcccacgggagatttgcttttctcgcatagtatggactcaccaggatctgaaattaggggctttccttagaggtggcctcaggctttcctacccccacagttggattatgcagagaaggtcactgggtcctgaggctgctgccgagcgtgctgtcccgggtggacagcgtgccctgtcatctttcattaggatgtgtgtgcctgtgccgcaccagccacaggtcaggatgccagcccctgcacgccctgcgtgctcatttgaaaactgagggtatctgggaagtcaccttacaaggtgccgaggagcagatggctaatttaaaggcaatctgtatgtgctctgagcctcccaaattatccatttcttgaatcctcaatgtgtgaaattcagcacactaagtcctcacaggctaggaaatcaaatgctggacaggccattccctaccatcatctggagtattcagagtatttggaatattcacagtcttcaaggtgtagctgtcgggctctgtgaaggataccttgcatttatagggatcgtcaggtctcctcttcctacgtatttgaagtattatggcttggagtactttctccaccaatgaagaaaagtttatatggcctctcctacgctcttgtcttgtcccaaaagtagggcttaactctgtccttgccatcaatctgtgcacatgttatggagtgaccatggtgaatgggcgatagaggttccttcctaggagaaactttcccagcttccccaaatgtgagaggggcgcctctctcccgaattccccagagccctttcctcccttccctctgccctcacctccctggatgcttcaggatactctgtggatactcttccgtgctccaggagagcatggccccgtggctgatagactcagctctcacccctctaagagctgctcatgagtatcctcgagtggatgagtgaacagatttctaactcaacagacataaatccccagtggagcttaagttaaatgcctggtttttaaattaagaaatatgacttcagcaatatgtataaaccaaaggaacattaaactaatgatagtatctttacaaatgagttgttgaggatttggagatagtttgtataacataaaacataacaaatacagtagaaagcatatggtagtgggattgaagaaacccgagaggttatttatcccaaacaccacctgatgttacagtgcttattgagtgattgatactgtgtcctacgtagagggggcacataaacaattcacatgtaatttttctgtattacattgacagatatatataaaatgatctctgcatctaaaattcaagcagtccagcctggaatactatcaccaaaaagtgaaaactgattttagaaacgaataatattttgttgtgaacaactctgaaaacatactggtcgatgaggtttatagctagagtctaaaatgccacatttatatgggtgaaacattttcagcttcaggagaaaataaaaccaaaaaaaaaaaaaaaaaa

SEQ ID NO: 109 - DNA, 1527 bp, Homo sapiens
  ref <308>: DATABASE ACCESSION NUMBER: AF038182
  ref <309>: DATABASE ENTRY DATE: 2001-06-18
ctcggcgccgcagtcctgcgcctctcccgcccctgtctcccgctccgcagccccgggcacggcggaggcagcggagccctgggccatcgtacctggagtagaacagaaaaattattatgtctgtgttcccttgggactcattggaaattgtacagtgacatcttctgggatttagtctggattgtgcagactggtgcttaaaatggaagtcgatattaatggagagtctagaagtaccctgaccaccttgcccttccctggggctgaggccaactccccgggaaaggcggaggcagagaagccccgctgctccagcacaccctgctccccgatgcggaggaccgtgtcaggctaccagatcctacacatggactctaactatttggttggcttcacgactggcgaggaactcctgaagttagctcagaagtgcacaggaggtgaagagagcaaagcagaagccatgccatccttacgctccaaacagctagatgcaggacttgcccgttcctctcgtttgtataaaaccagaagtaggtactaccagccatacgagattccagctgtcaatggcaggaggcgaaggcggatgccaagctcaggagacaagtgcactaaatctttaccttatgaaccttacaaggccctccatgggcctctgcctctttgtcttcttaaaggtaagagggctcactccaaatctctggactacctcaatctagataaaatgatcaaggagccagctgatacagaagtgctacagtaccagcttcaacacctaaccctccgaggggaccgtgtgtttgctaggaataatacatgaatgacttggagagagcttaaaccaatttaggtcagcctacgcttggctagaaaaaacccactgctgtactctgtacatgactcttcacactatagatggttatatcagctaagtgttcctggaacataaaaattgtttgggtcaaatttgaatacaggaatgaaatcacaggtacttgggggggggatatcattctagagcacgcaactgcaaagaaaacagaatgttgactgttagtttgtatagctttttagctaggaaaaaaaggctttggtacagtaatttcatctttatgattctgacactcaaattgggaatgttacctgcttggttgttgctgacttgatatgattcattagaaatttatatcttcagtactcaagtacttcttgaatctctgtattttactataaaatgtatgtaatgatttgttttatgaaatttagaacttgaacattgctgaattggaccactttttatttttaaatattgagtttaaatattttataactggttttgcactgaaaaaattaacatttcagattgacaagagagtaatctttcttcacttgcctcaataatgttattgagcaatgaattttttatttccgcatggaaagttattgatctctatggctgtaaaatatttctttatagcgttattaaagtgtgtcttaataaaattaaaaaaaaaaaaaaaaaaa

SEQ ID NO: 110 - DNA, 1585 bp, Homo sapiens
  ref <308>: DATABASE ACCESSION NUMBER: AF038193
  ref <309>: DATABASE ENTRY DATE: 2001-06-18
gacatgaaagtcattaacaaagccagccgtgaaaaggtgccccagagttgctgtggacagacctgtaaggacttgcaaaacaaaagaaagtgaggggtttttttaacctcagagctagctgctctctgcagcctcctccactggcttctctggctcacccaagctctcccttacagaggcaacacagaattataaggaatcagaaatcccccttctaccaggctgcaaatgtggctctagcacttgcaaattgttttttcttccgaatagttcagcagggacaagttatctgaggggcaaaatgcctgcttggaggtctgcaattttggaacactgcagtatggaactttggcattggagggtctgtaaaatatttttgttcttttaccaccaacttaggggactgttttaaagagccatcccaaggcctctcctagcaggcagaagccactcctctgataacggcctctgtaaatgttctgatttgctctcagctgcagagacacagagacactgcagatgtcacacgctttcatcttccctttgagcccttttgaaccctcctggggctctggggtagatgagagaagcctgaaaaaggcagagtttgaaagctcccatttaaaaacaaaatactttttaaagccctcttgcctcttccctgcccactcctgccccctgaccagaagacagaatttgaagctggaaagggaagaccccttttcccctcctcctgtccccagtgagtcttagcgagacttttgccctgcgcacaattgcatctgaatgtgcgggggagagggctgggggccggagggcaggcaaggcctggggggtgctcgtgatacgtgctcaagccagttgtgggaaaaactcgagtcctcccctcctcccgacctaccccgtgtggctgcttttggctggattccctgcacccagtgcaacacaccctttccccttcactctcccttggttactatggaaacaagggtgtcattgatgtgggctgagctggggaacatgtcggtgcacagctgaaagtcagcgattatgccggcggttagaaatgtgccagggttaaaggagtccgcagctcccacggctgctgggaggacatggtcctgcccccttccttcctccctccctccgtctccacttctctctccttgcttttgacaaatttctttattcccctctggactaaagtagtggctatttttgtgccactctgcgccccaccctcactgttggccgctccttatccggcctggcctggagggtgacaccatgtcaccctcaccaggactcgtctctccattcccgtcagagtttgctttgatttccctttcctttccttctcggggaccagttcttacttccttttatttttagctctgcactccatgtggtttcagggttcagtctgatccatcaaaaggttctttttttataatcccttttgaaaatgataatcaaaggaagagatgtggtgtttggtcatgtggaaaactcaatgtataatttagacgtctgtcaaaaatccgacaaataaaatttagctggaacgaaaaaaaaaaaaaaaaaa

SEQ ID NO: 111 - DNA, 4693 bp, Homo sapiens
  ref <308>: DATABASE ACCESSION NUMBER: AF042838
  ref <309>: DATABASE ENTRY DATE: 2001-06-18
ccgagccctgaggcaggcggcggcggaggagccctcaaggcgagcagcgcgcgcgcggctgccgcgggactgctgcgggaggcgggcagcgggggccgcgagcgggcggactggcggcggcggcagctgcgcaaagtgcggagtgtggagctggaccagctgcctgagcagccgctcttccttgccgcctcaccgccggcctcctcgacttccccgtcgccggagcccgcggacgcagcggggagtgggaccggcttccagcctgtggcggtgccgccgccccacggagccgccagccggcgcggcgcccaccttaccgagtcggtggcggcgccggacagcggcgcctcgagtcccgcagcggccgagcccggggagaagcgggcgcccgccgccgagccgtctcctgcagcggcccccgccggtcgtgagatggagaataaagaaactctcaaagggttgcacaagatggatgatcgtccagaggaacgaatgatcagggagaaactgaaggcaacctgtatgccagcctggaagcacgaatggttggaaaggagaaataggcgagggcctgtggtggtaaaaccaatcccagttaaaggagatggatctgaaatgaatcacttagcagctgagtctccaggagaggtccaggcaagtgcggcttcaccagcttccaaaggccgacgcagtccttctcctggcaactccccatcaggtcgcacagtgaaatcagaatctccaggagtaaggagaaaaagagtttccccagtgccttttcagagtggcagaatcacaccaccccgaagagccccttcaccagatggcttctcaccatatagccctgaggaaacaaaccgccgtgttaacaaagtgatgcgggccagactgtacttactgcagcagatagggcctaactctttcctgattggaggagacagcccagacaataaataccgggtgtttattgggcctcagaactgcagctgtgcacatggaacattctgtattcatctgctatttgtgatgctccgggtgtttcaactagaaccttcagacccaatgttatggagaaaaactttaaagaattttgaggttgagagtttgttccagaaatatcacagtaggcgtagctcaaggatcaaagctccatctcgtaacaccatccagaagtttgtttcacgcatgtcaaattctcatacattgtcatcatctagtacttctacatctagttcagaaaacagcataaaggatgaagaggaacagatgtgtcctatttgcttgttgggcatgcttgatgaagaaagtcttacagtgtgtgaagacggctgcaggaacaagctgcaccaccactgcatgtcaatttgggcagaagagtgtagaagaaatagagaacctttaatatgtcccctttgtagatctaagtggagatctcatgatttctacagccacgagttgtcaagtcctgtggattccccttcttccctcagagctgcacagcagcaaaccgtacagcagcagcctttggctggatcacgaaggaatcaagagagcaattttaaccttactcattatggaactcagcaaatccctcctgcttacaaagatttagctgagccatggattcaggtgtttggaatggaactcgttggctgcttattttctagaaactggaatgtgagagagatggccctcaggcgtctttcccatgatgtcagtggggccctgctgttggcaaatggggagagcactggaaattctgggggcagcagtggaagcagcccgagtgggggagccaccagtgggtcttcccagaccagtatctcaggagatgtggtggaggcatgctgcagcgttctgtcaatggtctgtgctgaccctgtctacaaagtgtacgttgctgctttaaaaacattgagagccatgctggtatatactccttgccacagtttagcggaaagaatcaaacttcagagacttctccagccagttgtagacaccatcctagtcaaatgtgcagatgccaatagccgcacaagtcagctgtccatatcaacactgttggaactgtgcaaaggccaagcaggagagttggcagttggcagagaaatactaaaagctggatccattggtattggtggtgttgattatgtcttaaattgtattcttggaaaccaaactgaatcaaacaattggcaagaacttcttggccgcctttgtcttatagatagactgttgttggaatttcctgctgaattttatcctcatattgtcagtactgatgtttcacaagctgagcctgttgaaatcaggtataagaagctgctgtccctcttaacctttgctttgcagtccattgataattcccactcaatggttggcaaactttccagaaggatctacttgagttctgcaagaatggttactacagtaccccatgtgttttcaaaactgttagaaatgctgagtgtttccagtgtttccactcacttcaccaggatgcgtcgccgtttgatggcttatgcagatgaggtggaaattgccgaagccatccagttgggcgtagaagacactttacaacgacaacaacacaacagcttttgcaggcatctgttcccaacaactatctggaaaccacagagaacagttccccttgagtgcacagtccatttagagaaaactggaaaaggattatgtgctacaaaattgagtgccagttcagaggacatttctgagagactggccaggatttcagtaggaccttctagttcaacaacaacaacaacaacaacaacagagcaaccaaagccaatggttcaaacaaaaggcagaccccacagtcagtgtttgaactcctctcctttatctcatcattcccaattaatgtttccagccttgtcaaccccttcttcttctaccccatctgtaccagctggcactgcaacagatgtctctaagcatagacttcagggattcattccctgcagaataccttctgcatctcctcaaacacagcgcaagttttctctacaattccacagaaactgtcctgaaaacaaagactcagataaactttccccagtctttactcagtcaagacccttgccctccagtaacatacacaggccaaagccatctcgacctaccccaggtaatacaagtaaacagggagatccctcaaaaaatagcatgacacttgatctgaacagtagttccaaatgtgatgacagctttggcttgagcagcaatagtagtaattgctgttataccagtgacgagacagtgttcaccccagtagaggagaaatgcagattagatgtcaatacagagctcaactccagtattgaggaccttcttgaagcatctatgccttcaagtgatacaacagtaacttttaagtcagaagttgctgtcctgtctcctgaaaaggctgaaaatgatgatacctacaaagatgatgtgaatcataatcaaaagtgcaaagagaagatggaagctgaagaagaagaagctttagcaattgccatggcaatgtcagcgtctcaggtagccctccccatagttcctcagctgcaggttgaaaatggagaagatatcatcattattcaacaggatacaccagagactctaccaggacataccaaagcaaaacaaccgtatagagaagacactgaatggctgaaaggtcaacagataggccttggagcattttcttcttgttatcaggctcaagatgtgggaactggaactttaatggctgttaaacaggtgacttatgtcagaaacacatcttctgagcaagaagaagtagtagaagcactaagagaagagataagaatgatgagccatctgaatcatccaaacatcattaggatgttgggagccacgtgtgagaagagcaattacaatctcttcattgaatggatggcagggggatcggtggctcatttgctgagtaaatatggagccttcaaagaatcagtagttattaactacactgaacagttactccgtggactttcgtatctccatgaaaaccaaatcattcacagagatgtcaaaggtgccaatttgctaattgacagcactggtcagagactaagaattgcagattttggagctgcagccaggttggcatcaaaaggaactggtgcaggagagtttcagggacaattactggggacaattgcatttatggcacctgaggtactaagaggtcaacagtatggaaggagctgtgatgtatggagtgttggctgtgctattatagaaatggcttgtgcaaaaccaccatggaatgcagaaaaacactccaatcatcttgctttgatatttaagattgctagtgcaactactgctccatcgatcccttcacatttgtctcctggtttacgagatgtggctcttcgttgtttagaacttcaacctcaggacagacctccatcaagagagctactgaagcatccagtctttcgtactacatggtagccaattatacagatcaactacgtagaaacaggatgctcaacaagagaaaaaaaacttgtggggaaccacattgatatctacggccatgatgccactgaacagctatgaacgaggccagtggggaacccttacctaagtatgtgattgacaaatcatgatctgtacctaagctcagtatgcaaaagcccaaactagtgcagaaact

SEQ ID NO: 112 - DNA, 1281 bp, Homo sapiens
  ref <308>: DATABASE ACCESSION NUMBER: AF044127
  ref <309>: DATABASE ENTRY DATE: 2001-06-18
gaacccatacttgctggtctgatccatgcacaaggcggggctgctaggcctctgtgcccgggcttggaattcggtgcggatggccagctccgggatgacccgccgggacccgctcgcaaataaggtggccctggtaacggcctccaccgacgggatcggcttcgccatcgcccggcgtttggcccaggacggggcccatgtggtcgtcagcagccggaagcagcagaatgtggaccaggcggtggccacgctgcagggggaggggctgagcgtgacgggcaccgtgtgccatgtggggaaggcggaggaccgggagcggctggtggccatggctgtgaagcttcatggaggtatcgatatcctagtctccaatgctgctgtcaaccctttctttggaagcctaatggatgtcactgaggaggtgtgggacaagactctggacattaatgtgaaggccccagccctgatgacaaaggcagtggtgccagaaatggagaaacgaggaggcggctcagtggtgatcgtgtcttccatagcagccttcagtccatctcctggcttcagtccttacaatgtcagtaaaacagccttgctgggcctgaccaagaccctggccatagagctggccccaaggaacattagggtgaactgcctagcacctggacttatcaagactagcttcagcaggatgctctggatggacaaggaaaaagaggaaagcatgaaagaaaccctgcggataagaaggttaggcgagccagaggattgtgctggcatcgtgtctttcctgtgctctgaagatgccagctacatcactggggaaacagtggtggtgggtggaggaaccccgtcccgcctctgaggaccgggagacagcccacaggccagagttgggctctagctcctggtgctgttcctgcattcacccactggcctttcccacctctgctcaccttactgttcacctcatcaaatcagttctgccctgtgaaaagatccagccttccctgccgtcaaggtggcgtcttactcgggattcctgctgttgttgtggccttgggtaaaggcctcccctgagaacacaggacaggcctgctgacaaggctgagtctaccttggcaaagaccaagatattttttcctgggccactggggaatctgaggggtgatgggagagaaggaacctggagtggaaggagcagagttgcaaattaacaacttgtaaatgaggtgcaaataaaatgcagatgattgcgcggctttgaaaaaaaaaaaaaaaaaa

SEQ ID NO: 113 - DNA, 753 bp, Homo sapiens
  ref <308>: DATABASE ACCESSION NUMBER: AF045229
  ref <309>: DATABASE ENTRY DATE: 2001-06-18
taccgagctcggatccactagtaacggccgccagtgtgctggaattcgcccttactcactatagggctcgagcggccgcccgggcaggtggattgttggtctgcgtggaacttctcaggtggacaccagagcatggaacacatccacgacagcgatggcagttccagcagcagccaccagagcctcaagagcacagccaaatgggcggcatccctggagaatctgctggaagacccagaaggcgtgaaaagatttagggaatttttaaaaaaggaattcagtgaagaaaatgttttgttttggctagcatgtgaagattttaagaaaatgcaagataagacgcagatgcaggaaaaggcaaaggagatctacatgacctttctgtccagcaaggcctcatcacaggtcaacgtggaggggcagtctcggctcaacgagaagatcctggaagaaccgcaccctctgatgttccagaaactccaggaccagatctttaatctcatgaagtacgacagctacagccgctttcttaagtctgacttgtttttaaaacacaagcgaaccgaggaagaggaagaagatttgcctgatgctcaaactgcagctaaaagagcttccagaatttataacacatgagcccccaaaaagccgggactggcagctttaagaagcaaaggaatttcctctcaggacgtgccgggtttatcattgctttgttatttgtaaggactgaaatgtacaaaacccttcaat

SEQ ID NO: 114 - DNA, 993 bp, Homo sapiens
  ref <308>: DATABASE ACCESSION NUMBER: AF047002
  ref <309>: DATABASE ENTRY DATE: 2001-06-18
gggcgccggggccgcggccgggccggctccagggccggccgccgcggtggggcgcaggccgccgcgcgagtgaatcgaggcggcgggcccatccggaaccggccggccatcgcccgcggcgcggccggcggaggcggcaggaaccgaccggcgccctacagcaggccaaaacaacttcccgacaagtggcagcacgatcttttcgacagtggcttcggcggtggtgccggcgtggagacaggtgggaaactgctggtgtccaatctggattttggagtctcagacgccgatattcaggaactctttgctgaatttggaacgctgaagaaggcggctgtgcactatgatcgctctggtcgcagcttaggaacagcaaacgtgcactttgagcggaaggcagatgccctgaaggccatgaagcagtacaacggcttccctctggatggccgccccatgaacattcagcttgtcacgtcacagattgacgcacagcggaggcctgcacagagcgtaaacagaggtggcatgactagaaaccgtggcgctggaggttttggtggtggtggaggcacccggagaggcacccgcggaggcgcccgtggaagaggcagaggtgccggcaggaattcaaagcagcagctttcggcagaggagctggatgcccagctggacgcctataatgcgagaatggacaccagttaaacagaccagcaaatccgcgtgcggaacaggacccaggcgtctcctcttgctccctggttggggggcggtggctggggctgtgcgcccaatgatggatttgtttcttttatgttttaaaataggatttaaaaactcatgtaaaggttttttttttttcttttttttttttttaattctgaaacagacctgttttgtaccgagttatttttgggataaattttactggttgctgttgtggagaaggtggcgtttccaccggaattccaaaaaaaaaaaaaaaaaaaaaaaaaa

SEQ ID NO: 115 - DNA, 1445 bp, Homo sapiens
  ref <308>: DATABASE ACCESSION NUMBER: AF047826
  ref <309>: DATABASE ENTRY DATE: 2001-06-18
ggcacgaggcaagttcttaacatcaatgatcatgctcctgagttctctcaatactatgagacttatgtttgtgaaaatgcaggctctggtcaggtaattcagactatcagtgcagtggatagagatgaatccatagaagagcaccatttttactttaatctatctgtagaagacactaacaattcaagttttacaatcatagataatcaagataacacagctgtcattttgactaatagaactggttttaaccttcaagaagaacctgtcttctacatctccatcttaattgccgacaatggaatcccgtcacttacaagtacaaacacacttaccatccatgtctgtgactgtggtgacagtgggagcacacagacctgccagtaccaggagcttgtgctttccatgggattcaagacagaagtcatcattgctattctcatttgcattatgatcatatttgggtttatttttttgactttgggtttaaaacaacggagaaaacagattctatttcctgagaaaagtgaagatttcagagagaatatattccaatatgatgatgaagggggtggagaagaagatacagaggcctttgatatagcagagctgaggagtagtaccataatgcgggaacgcaagactcggaaaaccacaagcgctgagatcaggagcctatacaggcagtctttgcaagttggccccgacagtgccatattcaggaaattcattctggaaaagctcgaagaagctaatactgatccgtgtgcccctccttttgattccctccagacctacgcttttgagggaacagggtcattagctggatccctgagctccttagaatcagcagtctctgatcaggatgaaagctatgattaccttaatgagttgggacctcgctttaaaagattagcatgcatgtttggttctgcagtgcagtcaaataattagggctttttaccatcaaaatttttaaaagtgctaatgtgtattcgaacccaatggtagtcttaaagagttttgtgccctggctctatggcggggaaagccctagtctatggagttttctgatttcccctggagtaaatactccatggttattttaagctacctacatgctgtcattgaacagagatgtggggagaaatgtaaacaatcagctcacaggcatcaatacaaccagatttgaagtaaaataatttaggaagatattaaaagtagatgagaggacacaagatgtagtcgatccttatgcgattatatcattatttacttaggaaagagtaaaaataccaaacgagaaaatttaaaggagcaaaaatttgcaagtcaaatagaaatgtacaaatcgagataacatttacatttctatcatattgacatgaaaattgaaaatgtatagtcagagaaattttcatgaattattccatgaagtattgttt

SEQ ID NO: 116 - DNA, 2329 bp, Homo sapiens
  ref <308>: DATABASE ACCESSION NUMBER: AF049460
  ref <309>: DATABASE ENTRY DATE: 2001-06-18
gcaggggccgagtctctcggaagccctcgtgaggactcggacctattcggactgattcggcttcccacttcggggaacttcgaccctcctcggttcaggactcggtctcggctcggcggcttcgtgcaggttcggctcctactcgggcagcctctgttcgcctcggctccgctccgcgggcggactcggctcggctctgctcggcggctggctgccttttcggtccctattcgggcggcggcttcgggcggcctcggcccagctcgggcgtcctcttcgggccccgcttcgggctccgcgaccggcgcttcgggcggtcccggacggcgccttcgggaaggctcggcggagtccggatggaggactcggactcggcggcaaagcagctgggcctggctgacgcggccgcggcaggaggcgaggcggaggagccggtgctgagcagggacgaggactcggaggaggacgcagactcggaggcggagcgggagacgccgcgggtcacggcagtggcggtgatggcggcggagcccgggcacatggacatgggcgccgaggccctgcccggccccgacgaggccgccgctgccgcagccttcgcagaggtgaccacagtgacagtggccaacgtgggggctgctgcagacaatgtcttcaccacgtctgtggcgaacgcggcatccatctcaggacatgttctgtctggtaggacggcccttcagatcggggacagcctgaacaccgaaaaagcgacactgattgtcgtccacacagatgggagcatcgtggagaccaccgggctgaaaggcccggcagctcccctcaccccaggtcctcagtctcctccaacccctctggctcccggccaagaaaaaggtggaactaaatacaactgggacccttctgtgtacgacagtgagctgcccgtacggtgccggaacatcagcggcactctgtacaagaacaggctcggctcaggcggccggggacggtgcatcaagcagggggagaactggtacagtcccaccgagtttgaggccatggcaggaagagccagcagtaaggactggaaaagaagcattcgctacgcgggccgacccttgcagtgcctcatccaggatgggatcttaaaccctcacgctgcctcttgcacctgtgctgcctgctgcgacgacatgaccttaagtggcccagtcaggctttttgtgccttacaaaaggcgcaagaaggagaatgaactgcccacaactcccgtgaagaaggactcccccaagaacatcacattgcttccagccaccgcggctaccaccttcaccgtgaccccctcgggacagatcacgacctcgggggcactgacctttgaccgagcgtccacggtagaggccactgctgtcatatcagagagtccggcccagggcgacgtcttcgcaggggccacagtccaagaggccagcgtgcagcccccatgcagggccagccaccctgagcctcactaccccggctatcaggacagctgccagatcgcaccgtttccagaagctgcgttgccaacgtcacatcccaaaatagtgttgacatccctgcctgcgctggcggtcccacccccgactcccaccaaagcggcacctcccgcgttggtcaatgggctggagctgtcagagccgcggagctggctgtacctagaagagatggtcaactccttgctcaacacagcgcagcagctgaagacgctgtttgagcaagccaagcatgccagcacctaccgagaagctgccacaaaccaggccaagatccacgctgacgcagagcggaaggagcagtcctgcgttaactgcggccgggaggctatgagcgagtgcaccggctgccacaaggtcaactactgctccaccttctgccaacgcaaggactggaaggatcaccagcacatatgcggccagtcagcagctgtcaccgtccaggcagacgaagtccacgtggctgaaagcgtgatggagaaggtgaccgtgtgaggctccatcggccgccctgggagctggggcccctcgcactcctgtgaggcttttgcaggtcgaaggcccccctgaggactctggggggacgttgagaagaggggtgtgggaaggtaaagaaacttgctggacaagtcattaacacactttaagcgaatggtgccctgggaagcgcactccccctgcccgggccccctgcccgctcgcggacagattttttatccctgggatcatgagcgtccggtctggcccacagggcctgtgctgcgacgcacatacatacgtgttgtgtctgtcaataaagtgtaaataaggtc

SEQ ID NO: 117 - DNA, 1230 bp, Homo sapiens
  ref <308>: DATABASE ACCESSION NUMBER: AF052101
  ref <309>: DATABASE ENTRY DATE: 2001-06-18
cgtaaatggccaagttgagtaatatctgtggaactgagacagagagccagggacccatgtacccagggaccagtcccctggggaatcacacagtggctcagactagactgctctatcccaccagaactctgctgctgttcatttccatcaggaccacccaggaaagcaaataagttagccttctcatcattaggtcacctaatctcttgggttgcaggatgagagcatatatagatctcctgtttagagagtgtgttcataattgtagaaagggatagaaaatggaataaccaagaggctgtgtcattttttaagaggatggcaaggatgacctcaaatgagctcaacaaaactgggaatccaaggaatggtgcttgtagggaaagagaggtcagttgtggtccttaaacctcttggcaccttgtgcgggttataaaacaaggagctggagtaaaattgcccttacccccaatccaaatgctgtccaggatttaggagctacccaacctgtggttatatggtgttggtttccattttttgtttgtttgcttgtttccaaaatagccttgcttggtactgcatggaaagttcaagcttttcttcttgcccgctcagggctggcctcttccccgtgtcttcacagcgtccctaaggaagatttttgcagcactctctggagctgaggggagtgaaatttggtccagagaaggcggaaggaaatagttttcctgtttccttttctcgaggtggatgtcctcaggcttccttcacacctccttctcatgggtgcggctggcagtacagtcaggctgtggaggagggctgagaagaaaggggcactggtccagccccaggtttggtctgagacaggtacacagcagataccatcccaccttcctctctaaagaacaggccagccacacatataaccctttccctactttactaatgtatcccttatgtggtaccagcaatggaggacaggcagacttaccccctgccatctagagagaatgttgttattacccgtaaaacttgaccacccccatatcccactcctttttgtaaaaacaaatgcttaaacctgtgagcctgccgttcctttctatgtgttaatcagtttccttccatttgagctgtgtgggagggaagggcattgaaattgtaggttgtaatcttgtgccaaccaataaaaaccagtatttcacacacaaaaaaaaaaaaaaaaaa

SEQ ID NO: 118 - DNA, 1622 bp, Homo sapiens
  ref <308>: DATABASE ACCESSION NUMBER: AF052117
  ref <309>: DATABASE ENTRY DATE: 2001-06-18
attagtcatagcctggctttatagaatccaggaggtccttttagctgaaacaagtggcttcaaaagggaacatgaaacagtgaaaagatagccaaaggtcagtgaaaccacagcatttctttctaatctggctgaggccatgggggggaatgaggggaaaatatgcttccgggccaaggtcaccgagggggaccttgggatttgtgtcctccccagtgcttagagtagagatacctgcaaattcatggcaaacagttggaagaattacttgactgaaacaacccaatcttactttctttcgtaagttgaacctctgatttattgtggggttcaggctctcctcaatagaaggccagagttggacaggtggactaaggtcaaggatgaggagtctgcagtggggactaccacagcaaactgccttccttccgtggagtcctaactcagccatgtggtccactcacccaggggcccgggggctcagacaaaccccatggggaacatgctgccatgctctgtctttcttgtaaacgtagttgggtagggatcccaagggtatttgctctctccaaatgcagaacttccatccactttatctggtgatctgatgaacagcatggggacgtggaggtgaaataagcatctttcagaataaggtttttttttttttcctcttccagaaccaaaggctttagacatttgtagaactttctggattccttctgaatcgggttttaacataaaaaaccatcaacacatcatgggaaaggagctctttcatgatatacatcacatgtttcttgctctcattgaggaaatgtgttgtacaaaagcaccaaataagggcaccctggaagtgacatgtgtgtttcttctaagtcgtttttagtgcatcccctgcgattgcatgatgctcatgtggcttttagggaaaggcagaatgtgctagaagtcgaagtcattcaatattcagtgcttactgttactttgaaccaggtaatctcagttctttattcagtccttcccaaagaccttacaaaggagatgtgtaaactgatagattttgagcctaataagtcacagaaatggaaaattttagagcagtttgtttcacttaggtgagaactgattactttaaattaccaacatgtgcaaattctacttagtattcattattagatgctaagctggaaaagatgagaaacccaaggagaactattgaattaccacataattgtaatattatgctttaattttgtatgggcagtgttctatcagactaagcttctagcctttgaaatgatttacatgaggagagagcctgtatatctgacttgggaaacattaagcagaccctattttcactggcgcggtaataactatttatttgctatcctagaggtgctgggaatgagcctacgtgcgactttgatgagatatattcacatttggtgttggaacgaccacatagcaaagtgttggtttttttttattgtaacactctgtgtaaacgttgacaccttattaaatattaaatgtctgaactctatttttaaaaataaaacaagcacagagtctgcaacaaacatgttaaaaaaaaaaaaaaaaaaaaaaaaaaaaaa

SEQ ID NO: 119 - DNA, 1484 bp, Homo sapiens
  ref <308>: DATABASE ACCESSION NUMBER: AF052155
  ref <309>: DATABASE ENTRY DATE: 2001-06-18
tggtactgaggaggcctagcagggtgaaggccacggtcgcggccttcacgggttcctcggccgtcctgagtcccaaatcccaagctggagccgttcagctcccctccaccgcttagagatttggggggctctggccccgtccttgcggaccattccgaggggagtccagaggtgtcagtaattaacactgtggatacctcccatgaggacatgattcacgacgcccagatggactactatggcacccgcctggcaacctgctcatcagacaggtccgtcaaaatctttgatgtgcgcaatggagggcagatccttatcgccgacctcaggggtcatgagggtcctgtgtggcaagtggcctgggctcaccccatgtacggcaacatcctggcatcgtgctcctatgaccggaaagtcattatctggagagaggaaaacggcacctgggagaagagccacgagcatgcgggacacgactcctcagtgaactcggtgtgctgggccccccatgactacggcctgatcctggcctgtgggagctcggatggggccatctccctgctgacttacaccggggaaggccaatgggaagtaaagaagatcaacaacgctcacaccattggctgcaatgccgtcagctgggcccctgctgttgtacctggaagcctcatagaccacccatcggggcagaaacccaattacatcaagaggtttgcatcaggtggctgtgacaacctcatcaagctgtggaaggaggaggaggacggccagtggaaggaggagcagaagctagaagcgcacagtgactgggttcgagatgtggcctgggccccctccatcggcctgcccaccagcaccatcgccagctgctcccaggatggtcgtgtgttcatttggacctgtgatgatgcctcaagcaatacgtggtcccctaaattgttgcacaagttcaacgatgtggtgtggcatgtgagctggtccatcacagccaacatcctggctgtctctggtggagacaataaggtgaccctgtggaaggagtcagttgatgggcagtgggtgtgcatcagtgatgtcaacaagggccagggctccgtatcagcatcagtgacagagggccagcagaacgagcagtgacaagacaggtggggcctggctccccacccgccagctccaggactgccccttcctgggccaactaaccaaacaactgggaagagcccccaactccaacaggattattttcccaggaggagttacagatgcagccacagattgatcatctgccttaacgtgatcggagatgctttgtaatctactgtccagctgaaagcactcatgttacgaggaagaaactacaagtgatgttcaaatctattttgggtcatttttatgtacctttgggttcaggcattatttggggggttttgtttccaaaggaactaaataaagtcatattgcttataaaaaaaaaaaaaaaaaaa

SEQ ID NO: 120 - DNA, 1316 bp, Homo sapiens
  ref <308>: DATABASE ACCESSION NUMBER: AF052159
  ref <309>: DATABASE ENTRY DATE: 2001-06-18
aaatagaatcaacttgggttatatttgtcatttactttgttctgttagattttttcagttgtttttggaaaaattctagaaatcaggatgaaaaatgcagcttttccagggttgctggactgggggttttatttgggcctccttattataatttgtcactacttataaaaaacattctgttgcaaacagtggtgttgcattgaattgaactttggcaatgagaacacagcacacagctcccttttcaaaaagggtctcaaccccagtgtgtatttttgtacatcaacatttagaatacttatggcagataagtaaggcatgtcactgtgtccttcagtaacctctctcagtaactggtttctttatccctaacatgaattcatttctcctttgaagtcatttattattttataaattgagaacaaccacaccaccaaatgtcacaccttcttataaagtgtgaacaaggaaggtcatgtttttgtgggtattttgtcagacttagaggtttcatttcagggcatagtcaaaggcatcatcctcccaactacccacttgattatgtatttcagatccctccgtgggggccttcttctgacagagaattctttgaggtacgcagtagtgcttttgtcagcacagactgctaatctacatcttgctgcgttctgtttgctgaggttgggcttattcatttaacacgtaccaaccattatccagaggcaccatggagagttagtcatggaataaagcactgtccttgcagatgaaaaaagtctccagagcagacttctgacaggaaaggtttagatgctggagagttgaagaggtgtaagaagagatcgtgccctcatttttcacttatttttttggttattcatttataataaaaggttggcattgatatggtacaacctgcaaattacttgcagttctgagtttcagataaaacattataaaacattaaattcaatacatactgctcctttgaaatttgggtaaaaaattgtacaaccgtatatatagtcatttttgtattttttctatgttgtgaaaaccaaaattgtaattttataagtctttgattcactaaaattatataatttaaatgtattttttgtatatttagaaataaggagtccagagactacgcttaactttctatgcatgcatttgaaagctgtttttacctgataatgtagtaataagttgtattcataaaatactgatctgtgttgcatttcaaaataaactggtgtgtgctctgcctggatttgaaaaaaaaaaaaaaaaaaaaaaaaaaaaaaaaaaaaaaa

SEQ ID NO: 121 - DNA, 1380 bp, Homo sapiens
  ref <308>: DATABASE ACCESSION NUMBER: AF052162
  ref <309>: DATABASE ENTRY DATE: 2001-06-18
gtcaaaggatatttatttataggcctttttttttttaatatagaatctgaggctgtttgggctttgacttaaatttccatcaggcctctctccagcaggtaatccctctccttccgctgggtcccctggggaggtgtgaactcaagggcctagccccaaaacactttttctgcttttcttaatccttttccagtcccctctttttttataaacgttggcagtttgatgtttctgtttcggcataacgtaatccatttcactgtagcctaaactccagtccgaggttggatattgttcaaatgagcagggcccgagctggaagcgcaaggcagccgccgccgtgccgctcctcccttgccctcaggccaggtccctgctggaagcggctgcatcttcctgtcagccctggtttccatggtgactggcgtcacgcagccacccgagtatggctgaccttcctgcagagagaggagccgcagtcttttgcttgtggaaggagacgctgggctgtgcggtgcggagggtgatgaggatgtctggtgacagccgtgcggacaccactcctctctgcagcactgcctcccagcgccagggtcgcgggcacatcccactgagagcgggggtcctgccccatcttagagtcaaaggcagaggggcttccaggccctggatggggtattttggtgtcacctgaagtccctctgacatcaccttgtttcatcattttttatgacagaattagaaacccatccttcaagcacaataatcatcacagacttgagtttgcttcctaaagcaaaggctccgggtttgtttggaaaatttttttgatttctgaaatgaattgatttttatatttggggcatctctatagaaagtgaccaccaaggccagtaagtacgggaaaaaatgtttactaacttcctcagagattcgtgatacgcgtttctccactgacagacatttaaaaacaaccttcagctccgtttcaatcaatcacctcgacttgttttttagcatggacactgccagcaggacagacagggatggagtaaaccgaagtcaatttcagggctcttggcgtgttggacacagaagaaatcctagtgcagcctttggtagctaacagtcactgattttataattggagaatgcgtaaagattcatttttcaaggagaagagcctgcaaatggccaatgaaggaggtaaataaactaagatattccgagggaagggacccaggccacctcccttccgcaggtctgcagatgaagggttttttgaatgaaatgccactgtgcattttcagaaaaaaaaatctctgataaacagactttgaatggaaaaaaaaaaaaaaaaaaaaaaaaaaaaaaaaaaaa

SEQ ID NO: 122 - DNA, 1325 bp, Homo sapiens
  ref <308>: DATABASE ACCESSION NUMBER: AF052176
  ref <309>: DATABASE ENTRY DATE: 2001-06-18
gaaaaaaaatgaactattttgtagcattgaacaagggtaggttccttgaatagtgccttgaaaatcatttacttaaatgctatcattttatggatactgaaagtgtgacatcagtgcccaagattacatggcttaaacttagagggtagggtgggacccagaatcctgacttgtgaatctcccttgctagagttttctgcctcatgccagagcctcctcctgcacagggatttctcacgccctccccaccctgcagcttcaatagggattttccctggacatactggctgctcttctccatagtaggcatttttccatgaagcaagtgtcattatgcccatgcacagatgaagaaactgaagccatgcatatggaggaagcaaaccaatacacatccaaagcaatgcacatccaatgacatggatgatccaaagccactcagctgtaactgctggagctgagacttgagcccagtgctcctaacccctgcattagtgccattctactgatgccaggttgaaaagaagctgtacacatgcagaagacacttttgggagcctttgcaatagcagatgttttatagctgagcagatcaagctgggaagaaatggtcgcttttcatagccatctctctgcacttgttggccttccctgacagtagcaacgttcttcattcttagatccctttcatcactaaggggatgccactaaactgaatttcttagcatggaaatgttacattccagggattgattttcctgcatagtatttctagaaaagttaatcgcctcattagtcatatttacattttattttaattgcatcctcgagagcaaatgtattcatttttttcctatgttatagttctctctttaacaaccccttaataaagcagagacaagatcagagcacatgaagagcactttgctttcttaaaatatgccacctcccaaaaatgtagggcccaattatcactgcggctataagctaattatcagatacaaaatatggatcacaactaattatcagaatctgaccttatttccaagtcatagattcctataaactaggttaacattagagatttaagcaggaactcaagaactgcagtaacccatggaaatgaatgtttatatttctaacaaatggctaaggcaagagatgattttctgaggcttatgtctggtgaaattttccagaagttcacgctctgcaaggccttattagtagaacatggatgatgaacggtccatttcattagtaacctgaaaccttctatttggagataaagatgactgcttccatttaaaaaaaaaaaaaaaaaa

SEQ ID NO: 123 - DNA, 1320 bp, Homo sapiens
  ref <308>: DATABASE ACCESSION NUMBER: AF052185
  ref <309>: DATABASE ENTRY DATE: 2001-06-18
ggcggcgtccaagggaggttgagggctctgaggaggcgttgagaggtttccgtacagcccgaccgtgcggctttggggatcccatcgctctgtgtttcctgctccaggtttcgcgtctcgcatcttcccagaccctcgggcgcgatgtggaggagctgcctccggctgcgggacgggggacgccgtctcctgaatcggccggcgggtggccccagcgcttctatgagtccggggccaaccatcccgtctccagcccgggcttacgccccgccgacagaaaggaagaggttttatcagaatgtcagcatcacacagggtgaaggtggctttgagataaacctggaccacaggaagctgaaaactccccaagccaagctctttaccgtccccagcgaggccctggccattgcagtggctactgagtgggattcccagcaggataccatcaagtactacaccatgcacctgaccacattgtgcaacacatcattggacaacccaacccagagaaacaaggatcagctgatccgggcagccgtgaagtttctggacaccgacaccatctgctacagggtggaggagcccgagacattagtggaacttcaaaggaatgagtgggatccaatcatcgaatgggctgagaaaagatacggcgtggagatcagctcctccaccagcataatgggacccagcatccctgccaaaactcgggaggtgctcgtcagccacctggcatcttacaacacatgggctttacaagggattgagtttgtagctgcccagctcaagtccatggtgctaaccttgggcctgattgacctgcgcctgacagtggagcaggccgtgctgctgtcacgcctggaggaggagtaccagatccagaagtggggcaacattgagtgggcccatgactatgagctgcaggagctgcgggcccgcaccgccgccggcaccctcttcatccatctctgctccgagagcaccacagtcaagcacaagctcctgaaggagtgaggcctgggcagagcacactcagcaggatagaggcagtgcagccacagctcccccggccttcagggctccccagcctgtggggctggcttccttggcttttggggactcggcctcagcgtcaccctgagattccccccgagacacagtgcgctagtacggctgtccggaggtcagcctgatttcaacccaggtgcccctggcctggccagcagtgaatgtaggagatgaattgtgcaagtgactttctctcgactctgattttattaaatatttctccaccctggaaaaaaaaaaaaaaaaaaaaaa

SEQ ID NO: 124 - DNA, 1722 bp, Homo sapiens
  ref <308>: DATABASE ACCESSION NUMBER: AF055033
  ref <309>: DATABASE ENTRY DATE: 2001-06-18
ggggaaaagagctaggaaagagctgcaaagcagtgtgggctttttccctttttttgctccttttcattacccctcctccgttttcacccttctccggacttcgcgtagaacctgcgaatttcgaagaggaggtggcaaagtgggagaaaagaggtgttagggtttggggtttttttgtttttgtttttgttttttaatttcttgatttcaacattttctcccaccctctcggctgcagccaacgcctcttacctgttctgcggcgccgcgcaccgctggcagctgagggttagaaagcggggtgtattttagattttaagcaaaaattttaaagataaatccatttttctctcccacccccaacgccatctccactgcatccgatctcattatttcggtggttgcttgggggtgaacaattttgtggctttttttcccctataattctgacccgctcaggcttgagggtttctccggcctccgctcactgcgtgcacctggcgctgccctgcttcccccaacctgttgcaaggctttaattcttgcaactgggacctgctcgcaggcaccccagccctccacctctctctacatttttgcaagtgtctgggggagggcacctgctctacctgccagaaattttaaaacaaaaacaaaaacaaaaaaatctccgggggccctcttggcccctttatccctgcactctcgctctcctgccccaccccgaggtaaagggggcgactaagagaagatggtgttgctcaccgcggtcctcctgctgctggccgcctatgcggggccggcccagagcctgggctccttcgtgcactgcgagccctgcgacgagaaagccctctccatgtgcccccccagccccctgggctgcgagctggtcaaggagccgggctgcggctgctgcatgacctgcgccctggccgaggggcagtcgtgcggcgtctacaccgagcgctgcgcccaggggctgcgctgcctcccccggcaggacgaggagaagccgctgcacgccctgctgcacggccgcggggtttgcctcaacgaaaagagctaccgcgagcaagtcaagatcgagagagactcccgtgagcacgaggagcccaccacctctgagatggccgaggagacctactcccccaagatcttccggcccaaacacacccgcatctccgagctgaaggctgaagcagtgaagaaggaccgcagaaagaagctgacccagtccaagtttgtcgggggagccgagaacactgcccacccccggatcatctctgcacctgagatgagacaggagtctgagcagggcccctgccgcagacacatggaggcttccctgcaggagctcaaagccagcccacgcatggtgccccgtgctgtgtacctgcccaattgtgaccgcaaaggattctacaagagaaagcagtgcaaaccttcccgtggccgcaagcgtggcatctgctggtgcgtggacaagtacgggatgaagctgccaggcatggagtacgttgacggggactttcagtgccacaccttcgacagcagcaacgttgagtgatgcgtccccccccaacctttccctcaccccctcccacccccagccccgactccagccagcgcctccctccaccccaggacgccactcatttcatctcatttaagggaaaaatatatatctatctatttgaggaaaaaaaaaaaaaaaaaaaa

SEQ ID NO: 125 - DNA, 6503 bp, Homo sapiens
  ref <308>: DATABASE ACCESSION NUMBER: AF055084
  ref <309>: DATABASE ENTRY DATE: 2001-06-18
attactgtatatgtatgtattcagccgtgattcccaaaggttcattttatgacagcatctttctgatttcctcacagtttattatcttcccattgcccaagtttagtaactttatattagttttggcttcgtacaggcaccactcattgggagcaacacagaaatctgtttcaaaacatcatttcaggaaaaagagaatattttagcgttgaggatctttaaaagtattgcagtactttatagaactaagttgtaggagctaagaggatcttttaattcatgctatgcaattatgtattttttgttgttgttgtattttattttattttgatttgtatgactttggaagagggtatgattttaccattcaagaaaatggacttcagatagatcaacctcctgaaataggaaacatctccattgttcgcatcataataatgaaaaatgataacgcagaaggcatcattgaatttgacccaaagtatactgccttcgaagtggaggaagatgttgggctgatcatgatcccagtggtgaggctacatggaacttatggctatgtgacagctgatttcatctctcagagctcctctgccagtcccggaggtgttgattacattttgcatggcagtacagtcacctttcagcatgggcaaaacttaagttttataaatatctccatcattgatgacaatgaaagtgaatttgaggagcccattgaaattctactcactggagctactggaggagcggtccttgggcgccacctagtgagcagaatcataatagctaagagtgactctccctttggagttataaggtttctcaatcaaagcaaaatttctattgctaatcccaattccacaatgattttatcactggtgctggagcggactggaggactcttgggagagattcaggtgaactgggagacagtaggacccaactctcaagaagccttactgccacagaatagagacattgcagacccagtgagcgggttgttctattttggagaaggagaaggaggagtgagaaccataattctgacaatctatcctcatgaagaaattgaagttgaagagacattcattattaaacttcatcttgtgaaaggagaagctaaattagactccagagctaaagatgttacattaaccatacaagagtttggtgacccaaatggagttgttcagtttgctcctgaaactttgtctaagaagacttattcagagcctctggctctggaagggcccctgctcattaccttctttgtcagaagagtcaagggcacctttggagagattatggtttactgggaattaagtagtgagtttgacattactgaagactttctttccaccagtggatttttcaccattgctgatggagagagtgaagctagctttgatgttcatttgctaccagatgaggtacctgagatagaggaagattatgtgatccagcttgtttctgtagagggaggagccgaactggatctggagaagagtatcacatggttctctgtttatgcaaatgatgacccacatggagtatttgccctgtattcggatcgccagtcaatacttattgggcagaaccttattagatccatccaaattaacataacccggcttgctggaacatttggagatgtggctgttgggcttcgaatatcatcggatcataaagaacagccgattgttaccgaaaatgcagagaggcagctggtggtcaaagatggtgccacatataaagtggacgtggtgccaataaagaatcaggtcttcctatcactgggctctaatttcactttgcaactggtgactgtgatgcttgtcggtggacgtttctatggaatgccaacaattcttcaggaagcaaaatctgctgtccttccagtctctgagaaagctgccaattctcaggtcggatttgaatccactgcttttcaactcatgaacatcactgctggcacaagccacgttatgatttctaggagaggcacatatggagctctctcggttgcctggaccactggatatgctcctgggttagaaattcctgaattcattgttgttggcaacatgaccccaacactggggagcctttcattttcccacggtgaacaaaggaaaggagttttcctgtggacgtttcctagccctggttggccagaggcctttgttcttcacctatcaggagtgcagagcagtgctcctggcggagctcaactccgatcaggtttcattgttgctgaaattgaaccaatgggcgtcttccaattttccactagctcaagaaatatcatagtgtcagaagatacacagatgatcagattacatgtacaaagactatttgggttccacagcgatcttattaaagtttcttatcagaccactgcaggaagcgccaagccactggaagattttgagcctgttcagaatggggaactgttttttcaaaaattccaaactgaggttgattttgaaataaccattattaatgatcagctttctgagatagaagaatttttttacattaaccttacttcagtagaaattaggggattacaaaagtttgatgttaattggagcccacgcctgaatctagatttcagtgttgcagtgattacaatattggataatgatgacctggcaggaatggatatttccttccccgagacaactgtggctgtagcagttgacacaactctcattcctgtagaaactgaatccaccacatacctcagcacaagcaagacgactaccattctgcagccaaccaacgtggttgccattgttactgaggcaactggtgtatctgccatccctgagaaacttgtcacccttcatggcacacctgctgtgtctgaaaagcctgatgtggccactgtaactgccaatgtttccattcatggaacattcagccttgggccatccattgtttatattgaagaggagatgaagaatggcacattcaacactgcagaagttcttatccgaagaactggtgggtttactggcaatgtcagcataacagttaaaactttcggtgaaagatgtgctcagatggaaccaaatgcattgccctttcgtggtatctatgggatttccaacctaacatgggcagttgaagaagaagactttgaagaacaaactcttacccttatattcctagatggagaaagagaacgtaaagtatcagttcaaattttggatgatgatgagcctgaggggcaggaattcttctacgtgtttctcacaaaccctcaagggggagcacagattgtggaggggaaggatgatactggatttgcagcttttgccatggttattattacagggagtgaccttcacaatggcatcataggattcagtgaggagtcccagagtggactagaactcagggaaggagctgttatgagaagattgcaccttattgtcacaagacagccaaacagggcctttgaagatgtcaaggtcttttggcgagtcacacttaacaaaacagtcgtcgtgctccagaaggatggggtaaacctgatggaggaacttcagtctgtgtcagggaccacaacctgtacaatgggtcaaacaaaatgctttatcagcattgaactcaaaccagaaaaggtaccacaggttgaagtgtatttttttgtggaactatatgaagctactgctggagcagcaataaacaacagtgccagattcgcacagattaaaatcttagaaagtgatgaatctcaaagccttgtgtatttttctgtgggttctcggctggcagtggctcacaagaaggccactttaatcagtctgcaggtggccagagattctgggacaggactaatgatgtctgttaactttagtacccaggagttgaggagtgctgaaacaattggtcgtaccatcatatctccagctatttctggaaaggattttgtgataactgaaggcacattggtctttgaacctggccagagaagcactgtattggatgtcatcctaacgccagagacaggatctttaaattcatttcctaaacgcttccagattgtcctttttgacccaaaaggtggtgccagaattgataaagtgtatgggactgccaacatcactcttgtctcagatgcagattcgcaggccatttgggggcttgcagatcagctacatcagcctgtgaatgatgatattctcaacagagtgctccataccatcagcatgaaagtggccacagaaaacacagatgaacaactcagtgccatgatgcatctaatagaaaagataactactgaaggaaaaattcaagctttcagtgttgccagccgaactcttttctatgagattctttgttctcttattaacccaaagcgcaaggacactaggggattcagtcactttgctgaagtgactgagaattttgccttttctctgctgactaatgttacttgcggctctcctggtgaaaaaagcaaaaccatccttgatagttgcccatatttgtcaatattggctcttcactggtatcctcagcaaatcaatggacacaagtttgaaggaaaggaaggagattacattcgaattccagagaggctactggatgtccaggatgcagaaataatggctgggaaaagtacatgtaaattagtccagtttacagagtatagcagccaacagtggtttataagtggaaacaatcttcctaccctaaaaaataaggtattatctttgagtgtgaaaggtcagagttcacaactcctgactaatgacaatgaggttctctacaggatttatgctgctgagcctagaattattcctcagacatctctgtgtctcctttggaatcaggctgctgcaagctggttgtctgacagtcagttttgcaaagtgattgaggaaactgcagactatgtggaatgtgcctgttcacacatgtctgtgtatgctgtctatgctcggactgacaacttgtcttcatacaatgaagccttcttcacttctggatttatatgtatctcaggtctttgcttggctgttctttcccatatcttctgtgccaggtactccatgtttgcagctaaacttctgactcacatgatggcagccagcttaggtacacagattctgtttctggcgtctgcatacgcaagtccccaactcgctgaggagagctgttcagctatggctgctgtcacacattacctgtatctttgccagtttagctggatgctcattcagtctgtgaatttctggtacgtgctggtgatgaatgatgagcacacagagaggcgatatctgctgtttttccttctgagttggggactaccagcttttgtggtgattctcctcatagttattttgaaaggaatctatcatcagagcatgtcacagatctatggactcattcatggtgacctgtgttttattccaaacgtctatgctgctttgttcactgcagctcttgttcctttgacgtgcctcgtggtggtgttcgtggtgttcatccatgcctaccaggtgaagccacagtggaaagcatatgatgatgtcttcagaggaaggacaaatgctgcagaaattccactgattttatatctctttgctctgatttccgtgacatggctttggggaggactacacatggcctacagacacttctggatgttggttctctttgtcattttcaacagtctgcagggactttatgttttcatggtttatttcattttacacaaccaaatgtgttgccctatgaaggccagttacactgtggaaatgaatgggcatcctggacccagcacagcctttttcacgcccgggagtggaatgcctcctgctggaggggaaatcagcaagtccacccagaatctcatcggtgctatggaggaggtgccacctgactgggagagagcatccttccaacagggcagtcaggccagccctgatttaaagccaagtccacaaaatggagccacgttcccgtcctctggaggatatggccaggggtcactgatagccgatgaggagtcccaggagtttgatgatttaatatttgcattaaaaactggtgctggtctcagtgtcagtgataatgaatctggtcaaggcagccaggaggggggcaccttgactgactcccagatcgtggagctcaggaggatacccatcgccgacactcacctgtagcacctcactaaccattcgactgagcacactttcatatttgtatcagcttttgtgctaaaactctctaagtacatccacctgtgtaataggaacctgtgaattgtactggatgattaatacaaacgtgattgttgtatttggagtataaattactgattgtatgtgacctgaaaattcactgctataagaaaggtggagtcagtttgtatcagttaataggatgttcatattccaaggatattagttgtttttttaatcatcctatatggctaacattgtttaatgaaagtaataatcaataaagcaatagaatct

SEQ ID NO: 126 - DNA, 1341 bp, Homo sapiens
  ref <308>: DATABASE ACCESSION NUMBER: AF055270
  ref <309>: DATABASE ENTRY DATE: 2001-06-18
ccacgcgtccgggcgggtgaaggtgtgtgtcagcttttgcgtcactcgagccctgggcgctgcttgctaaagagccgagcacgcggtctgtcatcatgtcgcgttacgggcggtacggaggagaaacccaagatgtatgttggtaacctgggaactggcgctggcaaaggagagttagaaagggcttcagttattattgtcttagactggatgattgaagggacattatgcttatattgtcaatcgttcagccggcgaagaagaagcaggtcacggtctagatcacatctcgatccagaggaaggcgatctctcgctcacgcagcaggagcaggggacgaaggtcaaggtcagcatctctcgacgatcaagatctatctctcttcgtagatcaagatcagcttcactcagaagatctaggtctggttctataaggatcgaggtattcaacccgtcgaggtcaagatcaagatccagctattacgaccaagaagcagccgatcaagtccagactcattcaagagtgtccatagagtctcgatgcttccgcgcgttgggagctctcccatatggactagtgattagtcagccacgccaggggatgaaggactgctacaaggagtgtgaagaggaatggggaccacgggaagctggtggggtcctcacccatctgtggtttttagtccgatggaacagatactatcccatccacagaaagcctttatctactaggagactaagaaaaagaaaaatactcagacttgctaggaccacaggtgtgggtgtttgttgggaaaaagtattgggaagatcggggtccatagggcgaggcgtctctgatcccctttgaggtttaactttctgcttttgatttcctgttagcatttggcctcctacagtggctgactaataaaagggttccggggttttttcccaatccccgtcgaggtcaagctccaagatccaggtctatttccacgacccaagaagccagccgatcaaagtcccagattctcatctccaaaaagaagtcgttccccatcaggaagtcctcgcagaagtgcaagtcctgaaagaatggactgaagctctcaagttcaccctttagggaaaagttattttgtttcacattattataagggatttgtgatgtctgtaaagtgtacacctaggaaagataattcaaccatctaatcaaaatggatctggattactatgtaaattcacagcagtaagataatataaataaagttgaatgtattaacatcatatggtctgaaaatgtgggtttttatttggcacatttaaataaaatgtttctaactagaaaaaaaaaaaaaaa

SEQ ID NO: 127 - DNA, 325 bp, Homo sapiens
  ref <308>: DATABASE ACCESSION NUMBER: AF058075
  ref <309>: DATABASE ENTRY DATE: 2001-06-18
tcctatgagctgacagccaccctcggtgtcagtgtccccaggacagacggccaggatcacctgctctgcagatgcattgccaaagcaatatgcttattggtaccagcagaagccaggccaggcccctgtgctggtgatatataaagacagtgagaggccctcagggatccctgagcgattctctggctccagctcagggacaacagtcacgttgaccatcagtggagtccaggcagaagacgaggctgactattactgtcaatcagcagacagcagtggtacttcccatgtggtattcggcggagggaccaagctgaccgtccta

SEQ ID NO: 128 - DNA, 2139 bp, Homo sapiens
  ref <308>: DATABASE ACCESSION NUMBER: AF061034
  ref <309>: DATABASE ENTRY DATE: 2001-06-18
cctggtcagcgtcccatcccggtcgggagttctctccaggcggcacgatgccgaggaaacagtgaccctgagcgaagccaagccgggcggcaggtgtggctttgatagctggtggtgccacttcctggccttggatgagccgtacgcctctgtaaacccaacttcctcacctttgaaacagctgcctggttcagcattaatgaagattagtcagtgacaggcctggtgtgctgagtccgcacatagaagaatcaaaaatgtccaaaatgtaactggagagaaagtgggcaacttttgggagtgacttttccacaggaacttctgcaatgtcccatcaacctctcagctgcctcactgaaaaggaggacagccccagtgaaagcacaggaaatggacccccccacctggcccacccaaacctggacacgtttaccccggaggagctgctgcagcagatgaaagagctcctgaccgagaaccaccagctgaaagaagccatgaagctaaataatcaagccatgaaagggagatttgaggagctttcggcctggacagagaaacagaaggaagaacgccagttttttgagatacagagcaaagaagcaaaagagcgtctaatggccttgagtcatgagaatgagaaattgaaggaagagcttggaaaactaaaagggaaatcagaaaggtcatctgaggaccccactgatgactccaggcttcccagggccgaagcggagcaggaaaaggaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctgggtccacgagaacagtctccactggcacggcattgtctcactataggaggagatctgcagatggggccaagaattacttcgaacatgaggagttaactgtgagccagctcctgctgtgcctaagggaagggaatcagaaggtggagagacttgaagttgcactcaaggaggccaaagaaagagtttcagattttgaaaagaaaacaagtaatcgttctgagattgaaacccagacagaggggagcacagagaaagagaatgatgaagagaaaggcccggagactgttggaagcgaagtggaagcactgaacctccaggtgacatctctgtttaaggagcttcaagaggctcatacaaaactcagcgaagctgagctaatgaagaagagacttcaagaaaagtgtcaggcccttgaaaggaaaaattctgcaattccatcagagttgaatgaaaagcaagagcttgtttatcctaacaaaaagttagagctacaagtggaaagcatgctatcagaaatcaaaatggaacaggctaaaacagaggatgaaaagtccaaattaactgtgctacagatgacacacaacaagcttcttcaagaacataataatgcattgaaaacaattgaggaactaacaagaaaagagtcagaaaaagtggacagggcagtgctgaaggaactgagtgaaaaactggaactggcagagaaggctctggcttccaaacagctgcaaatggatgaaatgaagcaaaccattgccaagcaggaagaggacctggaaaccatgaccatcctcagggctcagatggaagtttactgttctgattttcatgctgaaagagcagcgagagagaaaattcatgaggaaaaggagcaactggcattgcagctggcagttctgctgaaagagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggtaaatgtcagattttttcctccccaaaaaaaaaaaaaaaaaaaaaaa

SEQ ID NO: 129 - DNA, 333 bp, Homo sapiens
  ref <308>: DATABASE ACCESSION NUMBER: AF063725
  ref <309>: DATABASE ENTRY DATE: 2001-06-18
aattttatgctgactcagccgcactctgtgtcggggtctccggggacgacggtaaccatctcctgcacccgcagcagtggcagcattgacagcaactatgtgcagtggtaccactagcgcccgggcagtgcccccaccactgtggtctatgaggataaccagagaccctctggggtccctgatcggttctctggctccatcgacagctcctccaactctgcctccctcaccatctctgaactgaagactgaggacgaggctgactactactgtcagtcttatgatagcacctatcatgtgatattcggcggagggaccaagctgaccgtccta

SEQ ID NO: 130 - DNA, 1384 bp, Homo sapiens
  ref <308>: DATABASE ACCESSION NUMBER: AF063936
  ref <309>: DATABASE ENTRY DATE: 2001-06-18
ccagctcagcctctgtgcccaccctagctagcaccctgggtgaagcccctgccccacccccactgtcagtgcgagtcctgggcagctcctccttgcagctgctgtgggagccttggccccggctggcccagcacgagggcggcttcaagctgttttaccgcccagcaagcaagacctccttcaccggccccatcctgctgcctggaaccgtctcctcctacaacctcagccagctcgaccccactgcagtgtatgaggtgaagctgctcgcctacagccagcatggagatggcaatgccacagtccgctttgtgtctttgaggggagcatctgagaggacagccttgagcccaccatgtgactgccggaaggaggaggccgccaaccagacgtccaccacaggcatcgtcatcggcatccacatcggggtcgcttgcatcatcctctgtgtcctcttcctcctgttcggccaaaggggcagggtcctcctgtgtaaagatgtggaaaaccagctgtcccctccacagggtccccggagccagagggaccctggcattctggccctaaatggggcgagacggggacagcggggccagctgggccgagacgagaaacgtgtggatatgaaggagctggagcagctgttccccccggccagcgcagcagggcggccggaccccagacccacacaggatcctgcagcccccgctccgtgtgaggagacccagctctccttgctgccacttcaggggtgcggcctgatggaggggaagacgacggaggcgaagaccacagaggccacggctccctgcgccggcctggcggctgccccaccacccccagatggaggccctggcctcctcagtgaaggccaggcttccaggcctgcagcggcccgggttacccagccagctcactcggaacagtagccagtgtctggcaggctccagagggtggacggagcggggcccattctcaggtcaaaagcaagatttctactgtcatgtgggatttgaatggtcctgggggctccccagtatttctatcctgactgcctcttgggttgtcaaaacccaaggcagccttgacagggaccccccggccctaacacccatcaggagttggagcagttcctgcaggagcctgttccttccctgggctgacgcccccttgcctctgcctggtacccacatgacttggaactgaactaacatttttctttaaaaagcaaaacttaaaaaaaaaaaagaggagagagatagaggaaggtgaattagactccaaaagatgaccctgctgtagctgggccctgacactgtcaccctccaccgactttgttttctcaggatggatttttgctgttttggctctcagcacctacctc

SEQ ID NO: 131 - DNA, 255 bp, Homo sapiens
  ref <308>: DATABASE ACCESSION NUMBER: AF065241
  ref <309>: DATABASE ENTRY DATE: 2001-06-18
gtgaagcagatcgagagcaagactgcttttcaggaagccttggacgctgcaggtgataaacttgtagtagttgacttctcagccacgtggtgtgggccttgcaaaatgatcaagcctttctttcatgatgttgcttcagagtgtgaagtcaaatgcatgccaacattccagttttttaagaagggacaaaaggtgggtgaattttctggagccaataaggaaaagcttgaagccaccattaatgaattagtctag

SEQ ID NO: 132 - DNA, 3005 bp, Homo sapiens
  ref <308>: DATABASE ACCESSION NUMBER: AF067972
  ref <309>: DATABASE ENTRY DATE: 2001-06-18
gccgcggcaccagggcgcgcagccgggccggcccgaccccaccggccatacggtggagccatcgaagcccccacccacaggctgacagaggcaccgttcaccagagggctcaacaccgggatctatgtttaagttttaactctcgcctccaaagaccacgataattccttccccaaagcccagcagccccccagccccgcgcagccccagcctgcctcccggcgcccagatgcccgccatgccctccagcggccccggggacaccagcagctctgctgcggagcgggaggaggaccgaaaggacggagaggagcaggaggagccgcgtggcaaggaggagcgccaagagcccagcaccacggcacggaaggtggggcggcctgggaggaagcgcaagcaccccccggtggaaagcggtgacacgccaaaggaccctgcggtgatctccaagtccccatccatggcccaggactcaggcgcctcagagctattacccaatggggacttggagaagcggagtgagccccagccagaggaggggagccctgctggggggcagaagggcggggccccagcagagggagagggtgcagctgagaccctgcctgaagcctcaagagcagtggaaaatggctgctgcacccccaaggagggccgaggagcccctgcagaagcgggcaaagaacagaaggagaccaacatcgaatccatgaaaatggagggctcccggggccggctgcggggtggcttgggctgggagtccagcctccgtcagcggcccatgccgaggctcaccttccaggcgggggacccctactacatcagcaagcgcaagcgggacgagtggctggcacgctggaaaagggaggctgagaagaaagccaaggtcattgcaggaatgaatgctgtggaagaaaaccaggggcccggggagtctcagaaggtggaggaggccagccctcctgctgtgcagcagcccactgaccccgcatcccccactgtggctaccacgcctgagcccgtggggtccgatgctggggacaagaatgccaccaaagcaggcgatgacgagccagagtacgaggacggccggggctttggcattggggagctggtgtgggggaaactgcggggcttctcctggtggccaggccgcattgtgtcttggtggatgacgggccggagccgagcagctgaaggcacccgctgggtcatgtggttcggagacggcaaattctcagtggtgtgtgttgagaagctgatgccgctgagctcgttttgcagtgcgttccaccaggccacgtacaacaagcagcccatgtaccgcaaagccatctacgaggtcctgcaggtggccagcagccgcgcggggaagctgttcccggtgtgccacgacagcgatgagagtgacactgccaaggccgtggaggtgcagaacaagcccatgattgaatgggccctggggggcttccagccttctggccctaagggcctggagccaccagaagaagagaagaatccctacaaagaagtgtacacggacatgtgggtggaacctgaggcagctgcctacgcaccacctccaccagccaaaaagccccggaagagcacagcggagaagcccaaggtcaaggagattattgatgagcgcacaagagagcggctggtgtacgaggtgcggcagaagtgccggaacattgaggacatctgcatctcctgtgggagcctcaatgttaccctggaacaccccctcttcgttggaggaatgtgccaaaactgcaagaactgctttctggagtgtgcgtaccagtacgacgacgacggctaccagtcctactgcaccatctgctgtgggggccgtgaggtgctcatgtgcggaaacaacaactgctgcaggtgcttttgcgtggagtgtgtggacctcttggtggggccgggggctgcccaggcagccattaaggaagacccctggaactgctacatgtgcgggcacaagggtacctacgggctgctgcggcggcgagaggactggccctcccggctccagatgttcttcgctaataaccacgaccaggaatttgaccctccaaaggtttacccacctgtcccagctgagaagaggaagcccatccgggtgctgtctctctttgatggaatcgctacagggctcctggtgctgaaggacttgggcattcaggtggaccgctacattgcctcggaggtgtgtgaggactccatcacggtgggcatggtgcggcaccaggggaagatcatgtacgtcggggacgtccgcagcgtcacacagaagcatatccaggagtggggcccattcgatctggtgattgggggcagtccctgcaatgacctctccatcgtcaaccctgctcgcaagggcctctacgagggcactggccggctcttctttgagttctaccgcctcctgcatgatgcgcggcccaaggagggagatgatcgccccttcttctggctctttgagaatgtggtggccatgggcgttagtgacaagagggacatctcgcgatttctcgagtccaaccctgtgatgattgatgccaaagaagtgtcagctgcacacagggcccgctacttctggggtaaccttcccggtatgaacaggccgttggcatccactgtgaatgataagctggagctgcaggagtgtctggagcatggcaggatagccaagttcagcaaagtgaggaccattactacgaggtcaaactccataaagcagggcaaagaccagcattttcctgtcttcatgaatgagaaagaggacatcttatggtgcactgaaatggaaagggtatttggtttcccagtccactatactgacgtctccaacatgagccgcttggcgaggcagagactgctgggccggtcatggagcgtgccagtcatccgccacctcttcgctccgctgaaggagtattttgcgtgtgtgtaagggacatgggggcaaactgaggtagcgacacaaagtt

SEQ ID NO: 133 - DNA, 1452 bp, Homo sapiens
  ref <308>: DATABASE ACCESSION NUMBER: AF070536
  ref <309>: DATABASE ENTRY DATE: 2001-06-18
cactttcttgctcctgcctccctacctggcacccaggccggccctggtaccctggtactgaataaaggcacacgtctaaatgatgtcggggggaatctgcccagtgttggcactggagcgaacacgacccactgccagcatggcccacgagccacacccccccaagccagcacctcctccccagaggaagcacggggctcgacggggcacgcccctgaatgggaggtcacacatggtgagggctcccttgttcccagaggtctagctgtctccctgctaagatgcagagctcactatgggcctcgcagggggttaagccgagtcatttcatcttcacagcagctgtaggtcccgctgacatagctgacacatagagagctaaagtgacctgtgcaaggtcacaggctaggagtagcagcacggggcccagcacgaggaacagccttagcatcccccgcctccccaaccctgcagcctgccctgactccaatcccaggggaattcctgagctgcaggcaaaggctgaagcaggagctgacaagccctgctgagcccagagaggtctgggcggtcccaggagggcgtctccctagggctttgatgagttggtggccgcccaggcacctctgcctgcctgcccagcatggcaggtgtgtgggctggagcttctgcccagccctgccccacagccacaattaggggacgagtgcagataaagcacgggggccagttacatctgaatttcagataaacaatgaattgttattttagtacagtatgaaagtatttggccccaaagaactggaagcaggaaaaggaacagctcctcatacacccatgctcacagcattattcaccagagccggaaggtagaaacgatgtctctccacagtcgaatagattgtttccacaaactgtctgtaggtgcatacaatggaataggattaatccgtgaaaaggaagaaattctgacacatgctccggcgtggaggaaccttgaggacgacgctgagtgaaagaagccagacacgaaaggacagatacggcaagactcgacttatgtgaggtccctagaggagtcggattcatagagactggaagaattcgcgggccgcaggggcggtggagaggggaaatggggagttactgtttaatggggacagagtttcagttttacaagatgaaaagggtcctggagctggatgggggtgacggccgcacaacagcatgaatggactgaacgccactgaaaactgaactcttgaaaatggttaaactggcatattttgttatgcatattttgccacaaaaagcaaacaactcttctccccaaaaatatctggggtgtacttacactaaatatgtagggcatatttactctcaacatttatttccttatttgaaattaaagtatttgggacacactgcactacaaaaaaaaaaaaaaaaaaa

SEQ ID NO: 134 - DNA, 1492 bp, Homo sapiens
  ref <308>: DATABASE ACCESSION NUMBER: AF070552
  ref <309>: DATABASE ENTRY DATE: 2001-06-18
agagtccgggcgctgaaggccagtgcccaggatgctggggagtcctgcaccccagaggccgagggccgccctgaggagccatgtggcgagaaggcgcccgcctaccagcgcttccatgccctggcccagcccggcctgccgggactcgtgctgccctacaagtaccaggtgctggcggagatgttccgcagcatggacaccatcgtgggcatgctccacaaccgctccgagacgcccacctttgccaaggtccagcggggcgtccaggacatgatgcgtaggcgttttgaggagcgcaatgttggccagatcaaaaccgtgtacccggcctcctaccgcttccgccaggagcgcagtgtccccaccttcaaggatggcgccaggaggtcagattaccagctcaccatcgagccactgctggagcaggagctgacggagcagccccccagctcacggcctcgcgcctcctgcagcgacggcagatcttcagccagaagctggtggagcacgtcaaggagcaccacaagccttcctggcctccctgagccccgccatggtggtgccggaggaccagctgacccgctggcacccgcgcttcaacgtggatgaagtacccgacatcgagccggccgcgctgccccagccacccgccacggagaagctcaccactgctcaggaggtgctggcccgggcccgcaacctgatttcacccaggatggagaaggccttgagtcaattggccctgcgctctgctgcgcccagcagccccgggtctcccaggccagcactgccggctaccccaccagccaccccgcctgcagcctctcccagtgctctgaagggggtgtcccaggatctgctggagcggatccgagccaaggaggcacagaagcagctggcacagatgacgcggtgcccggagcaggagcagcggctgcagcgcttagaacggctgcctgagctggcccgcgtgctgcggagcgtctttgtgtccgaacgcaagcctgcgctcagcatggaggtggcctgtgccaggatggtgggcagctgttgtactatcatgagccctggggaaatggagaagcacctgctgctcctctccgagctgctgccggactggctcagcctccaccgcatccgcaccgacacctacgtcaagctggacaaggccgcggacctggcccacatcactgcacgcctggcccaccagacacgtgctgaggaggggctgtgagcctgggggccactgtggacagacgtgggcttcagaagctcgctggcctgggcccaccagcattttcttttatgaacatgatacactttggtcttcctttccccagcgcccctgagggccagaggcagatgtgggctgcaggctgcacagcccgagggtctctggctgcgggcggtgggccccttcatggggctcacctggtggattcacattaaaccggtttctgtgggcaaaaaaaaaaaaaaaaaaaaaaaaaaa

SEQ ID NO: 135 - DNA, 1326 bp, Homo sapiens
  ref <308>: DATABASE ACCESSION NUMBER: AF070617
  ref <309>: DATABASE ENTRY DATE: 2001-06-18
gtcttaatgatgacaaattaaagatgttttttcagtgctcaggtatgcatatattttcgtgttacttaagcaaaatcaactatataggaggaaaaatcaaaatggcattttattcagctaccagatggcttaaaatgagtaaaccccaacaacatcaagcacatttgtctgtgatattgaccctttttatccaatcattactattttagaagtagtggtgaactgtgtaaaataatggtatcttcagcagtgttccggaatcttagttgagggacaaacattccttccagtgagagattcaagaattgatgtgaattgaatatatttttcaaggtattataaattgtgttgtgttttcagtataagaaaatgttgacaggaaacaattttatagcatttataaaaaaccaacacttgtgcaatgctaaattggcgaagcttctgcacctgaattagagcacaataaatatgctgtttataaaccaaatcactgctattccttctctgaaatcatctctcctctttttaaacctttacttatagctagaataaatcactatttaattgcctctaatactttaaaactactggatggttaggcctggtttaactatttatggagagctatttgcaaacttaagttgtgtaaatgtaatttctacttgtgaatctgagctgtagcagcccagagggagctaggcaaactattccagaccaccaactgataagtgatcagattctttgtaatgtaggattttttaacctgttgattatgggtttgttgatataaatgtaataatgttcacctcgattttcctggagtaacaaccagcgttggtagtagcccacctgcatgaggacggccagtgttaacaatatttttgttctgatcttcttccccatttttgtttcctcaaacaggtttttaggagagtggagatttaaagtcaggatgtggcctttttattttaattatatacttaattcttagaacaagtagaatgggaaaggagtgactgataaatctaagattcaaaatagtcccgtcgaaacttaaaggccagattattgctttggagctttctataggtactagccatcccgtcgttaaatgttttcatggatatttgaaaagaagaccatgtacctttaataactgttcttttctcgagtttctgcctcgtgctttgacctggattgcattattattgtttatgcgaagtaaaaaaaaaaaaggaaagcacaagcttttcctgtatattatatttccatttccattttaaaataaaaacaattttccccaccaaaaaaaaaaaaaaaaaaaaa

SEQ ID NO: 136 - DNA, 2711 bp, Homo sapiens
  ref <308>: DATABASE ACCESSION NUMBER: AF073299
  ref <309>: DATABASE ENTRY DATE: 2001-06-18
taggcggagcgggctgagcagcccgggcgcgatgcgttgagcgctcggagggccaaccgccggtccccttggcggcaaccggcggcacccatggaaccactgggcaactggaggagcctgcgggcgccactgcctccgatgctgttgctgctgctcctgcaggtggcggggcccgtgggcgccctggcggagaccttgctgaacgcgccgagggccatgggcaccagttccagcccgcctagccctgcgagcgtggtggctcccggaacgacgctgttcgaggagagccggctgcctgtgtttacgctggattacccccacgtgcagatccccttcgagatcaccctttggatcctgctggcctccctggccaagattggcttccatctgtatcacaagttgcccacaatagtgcctgagagctgccttcttataatggttggacttctactaggtgggattatttttggtgttgatgagaagtctccccctgcaatgaagactgatgtatttttcttgtacctcctcccacccatcgtgctggatgccggctatttcatgcccactcgcccattctttgagaacattggcacgattttctggtatgctgtggtagggacactttggaattccattggcattggggtgtctttgtttggtatctgccagatcgaagcattcggcctcagcgacatcactttgctccagaacctgctctttggcagcttaatctcagctgtcgatcctgtggctgtgcttgctgtctttgagaacattcacgtcaatgagcagctctacatcctggtctttggagagtccctgctgaatgatgcagtaacagtggtcctgtacaacttgttcaagtcgttttgccagatgaaaaccattgagaccattgatgtgtttgcaggaatcgccaacttctttgttgtgggaatcggtggggtgctgattggcatcttcttgggctttatagcggcatttactactcgattcacccataatatccgagtgatcgagccactgtttgttttcctgtacagttatttgtcctacatcacagctgaaatgtttcacctctcaggcatcatggcaatcactgcttgtgcaatgactatgaataagtacgtagaagaaaatgtatctcagaaatcctacacgaccatcaagtacttcatgaagatgctgagcagtgtcagcgaaaccttgatcttcatcttcatgggtgtgtctaccgtgggcaagaaccacgagtggaactgggccttcgtctgcttcaccctggccttctgcctcatgtggcgagccctgggtgtttttgtcctgactcaggtcattaataggttccggaccattcccctgacctttaaggaccagttcatcattgcctatggaggacttcgaggtgccatctgttttgcgttagtgtttctccttcctgctgctgtgtttcctcggaaaaaattgtttattacggctgccattgttgtcatattctttactgtcttcattctgggaataactattcgaccactggtggagtttcttgatgtcaagaggtccaataagaaacaacaagctgtcagtgaagaaatctattgtcggttgtttgatcatgtgaagactggaattgaagatgtttgtggacattggggtcacaacttttggagagacaagtttaagaagtttgatgataaatatctgcggaagcttttgattcgggaaaaccaaccaaagtcaagtattgtatctttatataaaaagcttgaaataaaacatgccattgagatggcagagactgggatgataagtactgtccctacatttgcatctctaaatgattgtcgtgaagaaaaaataaggaaggtcacgtccagtgaaactgatgaaattcgagaactcttatcaagaaatctctatcaaatccgtcagcgaactttatcctacaacagacacagtctgacagccgacacaagtgagagacaagccaaggagattctgattcgccggcgacacagtttgcgagaaagcattaggaaggacagcagcttgaatcgagaacacagggcttccacttcaacctcccgatatttatccttacctaaaaatacgaagcttccagaaaagctacaaaagaggaggactatttctattgcagatggcaatagcagcgactcagacgcagatgccgggaccaccgtgctcaatttgcagcccagagccaggcgcttcttgccagaacagttctccaagaaatccccccagtcctataaaatggaatggaagaatgaggtagatgttgattctggccgagatatgcccagcacccccccaacaccccacagcagagaaaagggcacccagacgtcaggcttactacagcagccccttctctctaaagaccagtctggctcagagagggaagacagtttgactgaaggcatcccgcccaagccgccaccacggctggtctggagggcatcggaacctggaagccggaaagcccgatttgggagtgagaagccttaagagaagcagcgaaagcagatctgagtgtctgacccaggacagctgtggtttgtcactctgaaacctgatgcaacagtggaatccatgtaaaactctctgtgcatctaaatacttctggagggcgacagattcatgccacggataaatgaggcaaatccgaagaaaaaaaaaaaaaaaaaaaa

SEQ ID NO: 137 - DNA, 1912 bp, Homo sapiens
  ref <308>: DATABASE ACCESSION NUMBER: AF073519
  ref <309>: DATABASE ENTRY DATE: 2001-06-18
ccggcggctgttgtcgggcctccagcgggcggggccgttggcggagcagagcggaggcgcagccgggcggagggcccacgagggctcagccttcccggtcagcggtggtgacggtatcccagagtgccagagaaccgttgcttttccgagttgctcttcttccaggctccgttggtggtcggcatggcccgtggaaatcaacgagaacttgcccgccagaaaaacatgaagaaaacccaggaaattagcaagggaaagaggaaagaggatagcttgactgcctctcagagaaagcagagttctggaggccagaaatctgagagcaagatgtcagctgggccacacctccctctgaaggctccaagggagaatccttgctttcctcttccagctgctggtggctccaggtattacttggcttatggcagcataactcctatctctgcctttgtctttgtggtcttcttttctgtcttcttcccttctttttatgaggacttttgctgttggatttaggttccattctaacctaggatgatctcatttggaaatccttaatttcatctacaaaaactgttttcccaaataggtcacattcacgcatatcagatggacagatgtatcattttggggtccaccattcaacccactacaaggagttttttaaacaaaaataggaaacttagatgtaacttagcactttttttttttttttttgagatggagtctcactctgtcaccagactggagtgcagtggcgccatctcagctccatgcaacctctgcctcctgggttcaagcagttctcttgcctcagcctcctgggtagctgggattacaggcacgcgctgccacacccaggtaatttatttattttttttttgagacagagtctcgcactgttgcccaggctggactgcagtggcgtgatctctgctcactgcaacctccgcctcccgggttcaagcgattctccagcctcagcttcctgagtagatgggattacaggcgcctgccaccacgcccagctaatttttttgtattcttagtagagatggggtttcaccatgttggccaggctggtctccatctcctgacctcgtgattcacccgcctcggcctcccaaagtgctgggattacaggcgtgagtcacagcccccggccataatttagcactttaaaaaataatagccatgttgggccaggcgtggtggctcatgcctgtaatctgagcactttgggagaccaaggcgggtagatcccttgtgcccaggagttcaagaccagcctgggcaacatggcgaaaccccatttctactaaaaatacaaaaattagctggggcgaggggataggccgagttccgggtgtaagggggccattagggagagcagagcgaggcagctgatcttccggattgggggccttgcccggaagctggacctcacggagatgaaacggaagatgcacgaggatatgatctccatacagaactttctcatctacgtggccctgctgcgagtcactccatttatcttaaagaaattggacagcatatgaagattggacatcacatgtgaatgcatgatatgaagagcctggttacagtttctactgttctctgcaagtaaataggcccagaaaggtataagagactctttgaatggacataaaaattctgcttgttaagaacaagttgagctctggtaactgatcttaatagctaaaatataaaaatatttgggaagtctgaaatgaggtctcctggccctggtgtgcccttaatgcctgtgacagttggcctctgtgaatattggtataattgtaaataatgtcaaactccattttctagcaagtattaataattaagggaagtatgtctgaaatggcaaaaaaaaaaaaaaaaaaaaaaa

SEQ ID NO: 138 - DNA, 3152 bp, Homo sapiens
  ref <308>: DATABASE ACCESSION NUMBER: AF073770
  ref <309>: DATABASE ENTRY DATE: 2001-06-18
ggcgcgggcggtgaggacggacagtcaccgacttagtccagttccctgtgatctcaaaacaattgttgcagcaggctcctggcagtctcaagcagttcatcttcttggtgtactggtttcctattgtgattttatcatggaaaatcaactggctaaatcaactgaagaacgaacatttcagtaccaggattctcttccatcactgcctgttccttcacttgaagaatcattaaaaaaataccttgaatcagtgaaaccatttgcaaatcaagaagaatataagaaaactgaagaaatagttcaaaaatttcaaagtgggattggagaaaaattgcaccagaaattgcttgaaagagcaaaaggaaaaagaaattggctggaagagtggtggctgaatgttgcctatctggatgttcgtataccatcacaattgaatgtcaactttgcgggtcctgcagctcattttgaacactactggcctccaaaggaagggactcaattagaaagaggaagtataactctttggcataacttgaactactggcagctattaagaaaagaaaaagtgcctgttcataaagttggaaatactcctctagatatgaatcaattccgaatgctattttctacctgcaagggtccaggaattactagagactccattatgaattattttaggactgagagtgaagggcgttccccaaaccacattgtagtgctgtgtcgaggccgagcttttgtctttgatgtaatacatgaaggatgtttggtcaccccgccagagcttctcagacaactgacatatatccacaagaagtgccatagtgaacctgatggacctgggattgcagcattaactagtgaggagcgaactcgatgggctaaggcacgagaatatctgattggtcttgatccagagaacttggctttgttagaaaaaattcagagtagtttactggtatattccatggaggatagcagtccacatgtaacaccagaggattattctgagattattgcagccatccttattggagatccaacagtacgctggggtgacaaatcctataacttgatttccttttctaatggagtatttggctgtaattgtgatcatgctccttttgatgcaatgattatggtgaacatcagttattatgtggatgagaaaatttttcagaatgaaggaagatggaagggttcagagaaggtacgagatataccacttccagaagagctcattttcattgtggatgagaaagttttaaatgacatcaaccaagctaaagcccagtatctcagggaggcatctgatctacagattgcggcttatgcctttacatcttttggcaaaaagctaaccaagaacaagatgcttcacccggatacgtttattcagcttgcacttcagctggcctattacagacttcatggacaccctggttgttgctatgaaacagctatgacaagacatttttatcatggccgtacagagactatgcgatcatgcacagttgaagcagtgaggtggtgccagtccatgcaggatccttctgtcaatcttcgtgagcggcagcaaaagatgttacaagcttttgcaaagcataataaaatgatgaaagattgttcagctggaaaaggatttgatcgtcaccttttaggtctcttactcatagcaaaagaggaaggtcttcctgttccagaactctttacggacccacttttttccaaaagcggaggaggtggaaattttgttctctcaacaagtctggttggctatttacgagtccagggagtggtagttcccatggtacacaatggttatggatttttctaccatatcagagatgacaggtttgttgtggcctgttcagcctggaaatcctgtcccgagactgatgcggaaaagctagttcagctgactttttgtgcttttcatgatatgatacagctgatgaactctactcatctttagagatgaatcatctattaagcacttaccaaaacatatcattaaactgagtgctgggagtgagttggtaatatgagatgggaaggaatgttgacttgctaacattcctttaacaagttaagaaaacttgttaaatgtagaaattagtagaatcatgctctctaaatttattctgccatagaaggtagaaatatttttaagctcctctgatgcagcagcaatgcaaattatgacatagtgaatatagaactatgcagtatttaagcctcaacaatccaaatctacaaactttaacaatgcaagtcttactctaatttttaagtatttttgttggtacttacatgggttataaatcctctctctggacatcaatgtagagtccatctttcaagcactttaatttttttagctgccaaagggtatgaattacattattgtatgctaatttccctgaaatcaatgccttctatgttcaccacagggatacaagcctgttatgtttgatgggaaagaccactacaatctaatggtgatctaaaataacttttttgggctgggtgcagtggctcatgcctataatcttagcactttgggaggccaaggtaggaggattgcttgaagctaggagtttgagaccagcctgggcaacagggtaaggtcctgtctctacaagatcaaaaacttagccgggtatggtggtgcatgtgtgcctgtagtccaagctacttgaaggctgagacaggaggatcggttgagcccaggaggttgtggctgcagtgagctgtgatgtgcccttatgctatagcctgggcaagagcgtgagaccctgtctcaaagaagaaaaaaagagaaaaataactcttttgaacaaacagacaaattagctagtagtatggagatgtataccctctattacacacataaaaccgtaacaaaattcattgtggtgtattataattagttttgtgaatagaaaaataaagcacttatgtttaaatttgttacagtgacttttaaaggattaatgttgaatcacattgtcagaattttttcctcctcgctgttcaattttgtagtttttactctcaaaaaatgaaattctcaaaattatatagctttttgttttgtttgaataaatgattcattcctgtttaaaaaaaaaaaaaaaaaaaaaaaaaaa

SEQ ID NO: 139 - DNA, 2832 bp, Homo sapiens
  ref <308>: DATABASE ACCESSION NUMBER: AF076612
  ref <309>: DATABASE ENTRY DATE: 2001-06-18
caagtggctgcgggacactgctgccagacctgcccccaggagcgcagcagttcggagcggcagccgagcggcctgtccttcgagtatccgcgggacccggagcatcgcagttatagcgaccgcggggagccaggagctgaggagcgggcccgtggtgacggccacacggacttcgtggcgctgctgacagggccgaggtcgcaggcggtggcacgagcccgagcctcgctgctgcgctctagcctccgcttctctatctcctacaggcggctggaccgccctaccaggatccgcttctcagaccccaatggcagtgtcctgtttgagcaccctgcagcccccacccaagatggcctggtctgtggggtgtggcgggcagtgcctcggttgtctctgcggctccttagggcagaacagctgcatgtggcacttgtgacactcactcacccttcaggggaggtctgggggcctctcatccggcaccgggccctggctgcagagaccttcagtgccatcctgactctagaaggccccccacagcagggcgtagggggcatcaccctgctcactctcagtgacacagaggactccttgcattttttgctgctcttccgagggctgctggaacccaggagtgggggactaacccaggttcccttgaggctccagattctacaccaggggcagctactgcgagaacttcaggccaatgtctcagcccaggaaccaggctttgctgaggtgctgcccaacctgacagtccaggagatggactggctggtgctgggggagctgcagatggccctggagtgggcaggcaggccagggctgcgcatcagtggacacattgctgccaggaagagctgcgacgtcctgcaaagtgtcctttgtggggctgatgccctgatcccagtccagacgggtgctgccggctcagccagcctcacgctgctaggaaatggctccctgatctatcaggccgtgggtatctgccctgggctgggtgcccgaggggctcatatgctgctgcagaatgagctcttcctgaatgtgggcaccaaggacttcccagacggagagcttcgggggcacgtggctgccctgccctactgtgggcatagcgcccgccatgacacgctgcccgtgcccctagcaggagccctggtgctaccccctgtgaagagccaagcagcagggcacgcctggctttccttggatacccactgtcacctgcactatgaagtgctgctggctgggcttggtggctcagaacaaggcactgtcactgcccacctccttgggcctcctggaacgccagggcctcggcggctgctgaagggattctatggctcagaggcccagggtgtggtgaaggacctggagccggaactgctgcggcacctggcaaaaggcatggcctccctgctgatcaccaccaagggtagccccagaggggagctccgagggcaggtgcacatagccaaccaatgtgaggttggcggactgcgcctggaggcggccggggccgagggggtgcgggcgctgggggctccggatccagcctctgctgcgccgcctgtggtgcctggtctcccggccctagcgcccgccaaacctggtggtcctgggcggccccgagaccccaacacatgcttcttcgaggggcagcagcgcccccacggggctcgctgggcgcccaactacgacccgctctgctcactctgcacctgccagagacgaacggtgatctgtgacccggtggtgtgcccaccgcccagctgcccacacccggtgcaggctcccgaccagtgctgccctgtttgccctgagaaacaagatgtcagagacttgccagggctgccaaggagccgggacccaggagagggctgctattttgatggtgaccggagctggcgggcagcgggtacgcggtggcaccccgttgtgcccccctttggcttaattaagtgtgctgtctgcacctgcaaggggggcactggagaggtgcactgtgagaaggtgcagtgtccccggctggcctgtgcccagcctgtgcgtgtcaaccccaccgactgctgcaaacagtgtccagtggggtcgggggcccacccccagctgggggaccccatgcaggctgatgggccccggggctgccgttttgctgggcagtggttcccagagagtcagagctggcacccctcagtgcccccgtttggagagatgagctgtatcacctgcagatgtggggcaggggtgcctcactgtgagcgggatgactgttcactgccactgtcctgtggctcggggaaggagagtcgatgctgttcccgctgcacggcccaccggcggccagccccagagaccagaactgatccagagctggagaaagaagccgaaggctcttagggagcagccagagggccaagtgaccaagaggatggggcctgagctggggaaggggtggcatcgaggaccttcttgcattctcctgtgggaagcccagtgcctttgctcctctgtcctgcctctactcccacccccactacctctgggaaccacagctccacaagggggagaggcagctgggccagaccgaggtcacagccactccaagtcctgccctgccaccctcggcctctgtcctggaagccccacccctttcctcctgtacataatgtcactggcttgttgggatttttaatttatcttcactcagcaccaagggcccccgacactccactcctgctgcccctgagctgagcagagtcattattggagagttttgtatttattaaaacatttctttttcagtcaaaaaaaaaaaaaaaaaaa

SEQ ID NO: 140 - DNA, 2844 bp, Homo sapiens
  ref <308>: DATABASE ACCESSION NUMBER: AF079529
  ref <309>: DATABASE ENTRY DATE: 2001-06-18
cttcctcttctccacgcaggcttcaacaggagatttatggagaatagcagcataattgcttgctataatgaactgattcaaatagaacatggggaagttcgctcccagttcaaattacgggcctgtaattcagtgtttacagcattagatcactgtcatgaagccatagaaataacaagcgatgaccacgtgattcagtatgtcaacccagccttcgaaaggatgatgggctaccacaaaggtgagctcctgggaaaagaactcgctgatctgcccaaaagcgataagaaccgggcagaccttctcgacaccatcaatacatgcatcaagaagggaaaggagtggcagggggtttactatgccagacggaaatccggggacagcatccaacagcacgtgaagatcaccccagtgattggccaaggagggaaaattaggcattttgtctcgctcaagaaactgtgttgtaccactgacaataataagcagattcacaagattcatcgtgattcaggagataattctcagacagagcctcattcattcagatataagaacaggaggaaagagtccattgacgtgaaatcgatatcatctcgaggcagtgatgcaccaagcctgcagaatcgtcgctatccgtccatggcgaggatccactccatgaccatcgaggctcccatcacaaaggttataaatataatcaatgcagcccaagaaaacagcccagtcacagtagcggaagccttggacagagttctagagattttacggaccacagaactgtactcccctcagctgggtaccaaagatgaagatccccacaccagtgatcttgttggaggcctgatgactgacggcttgagaagactgtcaggaaacgagtatgtgtttactaagaatgtgcaccagagtcacagtcaccttgcaatgccaataaccatcaatgatgttcccccttgtatctctcaattacttgataatgaggagagttgggacttcaacatctttgaattggaagccattacgcataaaaggccattggtttatctgggcttaaaggtcttctctcggtttggagtatgtgagtttttaaactgttctgaaaccactcttcgggcctggttccaagtgatcgaagccaactaccactcttccaatgcctaccacaactccacccatgctgccgacgtcctgcacgccaccgctttctttcttggaaaggaaagagtaaagggaagcctcgatcagttggatgaggtggcagccctcattgctgccacagtccatgacgtggatcacccgggaaggaccaactctttcctctgcaatgcaggcagtgagcttgctgtgctctacaatgacactgctgttctggagagtcaccacaccgccctggccttccagctcacggtcaaggacaccaaatgcaacattttcaagaatattgacaggaaccattatcgaacgctgcgccaggctattattgacatggttttggcaacagagatgacaaaacactttgaacatgtgaataagtttgtgaacagcatcaacaagccaatggcagctgagattgaaggcagcgactgtgaatgcaaccctgctgggaagaacttccctgaaaaccaaatcctgatcaaacgcatgatgattaagtgtgctgacgtggccaacccatgccgccccttggacctgtgcattgaatgggctgggaggatctctgaggagtattttgcacagactgatgaagagaagagacagggactacctgtggtgatgccagtgtttgaccggaatacctgtagcatccccaagtctcagatctctttcattgactacttcataacagacatgtttgatgcttgggatgcctttgcacatctaccagccctgatgcaacatttggctgacaactacaaacactggaagacactagatgacctaaagtgcaaaagtttgaggcttccatctgacagctaaagccaagccacagagggggcctcttgaccgacaaaggacactgtgaatcacagtagcgtaaacaagaggccttcctttctaatgacaatgacaggtattggtgaaggagctaatgtttaatatttgaccttgaatcattcaagtccccaaatttcattcttagaaagttatgttccatgaagaaaaatatatgttcttttgaatacttaatgacagaacaaatacttggcaaactcctttgctctgctgtcatcctgtgtacccttgtcaatccatggagctggttcactgtaactagcaggccacaggaagcaaagccttggtgcctgtgagctcatctcccaggatggtgactaagtagcttagctagtgatcagctcatcctttaccataaaagtcatcattgctgtttagcttgactgttttcctcaagaacatcgatctgaaggattcataaggagcttatctgaacagatttatctaagaaaaaaaaaaaagacataaaataagcgaaacaactaggaccaaattacagataaactagttagcttcacagcctctatggctacatggttcttctggccgatggtatgacacctaagttagaacacagccttggctggtgggtgccctctctagactggtatcagcagcctgtgtaacccctttcctgtaaaaggggttcatcttaacaaagtcatccatgatgagggaaaaagtggcatttcatttttggggaatccatgagcttcctttatttctggctcacagaggcagccacgaggcactacaccaagtattatataaaagccattaaatttgaatgcccttggacaagcttttcttaaaaaaaaaaaaaaaaaa

SEQ ID NO: 141 - DNA, 318 bp, Homo sapiens
  ref <308>: DATABASE ACCESSION NUMBER: AF090353
  ref <309>: DATABASE ENTRY DATE: 2001-06-18
tcctatgagctgactcagccaccctcagtgtccgtgtccccaggacagacagccagcatcacctgctctggagataaattgggggataaatatgtttgctggtatcagcagaagccaggccagtcccctctattggtcatctatcaagataccaagcggccctcagggatccctgagcgattctctggctccagctctgagaacacagccactctgaccatcagcgggacccaggctatggatgaggctgactattactgtcaggcgtgggacaccaacactgcgatattcggcggagggaccaagctgacgtcctag

SEQ ID NO: 142 - DNA, 1402 bp, Homo sapiens
  ref <308>: DATABASE ACCESSION NUMBER: AF090913
  ref <309>: DATABASE ENTRY DATE: 2001-06-18
cggagtgggcacatggattgggcacaaagtactcagtagtccaagaatatttcagtaagactgcaagaagggaggaaatcaagtttcaggagaaattctaaaggcctaagactgtcatggatccaaatgtgtattttctgaatttaacatgcaaatctttgttaaggggttcaagaaagtcatttcttattttacaaatactagccatggtaaactgattaggaatatgtttaaaaacaaaaaaacaaaaaactagccataagaaactacttagttctatatcatccctgtgagaaaggaaaaaaaattcttatgttagagaaaacaaagtctaaattctttagatttttcatatatgtttaagcatgtgtgaataacataaaataagccaagcaaaacagagaaatcatagttatgcactgtaccaaattagctcccaaaagaaagtataaactggggtttaagtcaaaggaaaaggggaataaaaactatatgatcatgaccgaagaatcagtgtcatgattttattaagctcataattttaaaattagctcattttataatttcctataattgaataatgttctctaagtgtaaacagtattaaaggcatgattcatctgacagcaaactataatgaagtttacattttaatccaaaaacatttccaagaatattggcatctaatactttttaatagtggtccacatacaaatgttattttgttgaactttcattcaaataaattatattttgccacatacagttattaaaacaaagcagtattttttataaagcatatatgtgtttattttattttttttgaaacagtcagtggtgtgagtttgtctgaggtctttaagaaaagatcttcagccgggcgcagtggctcacacctgtaatcccagcactttgggaggccaaggtgggtggatcatgaggtcaggagttcgagaccagcctggccaacatagtgaaaccctgtctccactaaaaatacaaaaattagtcaggcatggtggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagaccccagtcgtgatgtggaggaagagccacctgcaagatggacacgagccacaagctgcactgtgaacctgggcactccgcgccgatgccaccggcctgtgggtctctgaagggacccccccccaatcggactgccaaattctccggtttgccccgggatattatagaaaattatttgtatgaataatgaaaataaaacacacctcgtggcatggcaaaaaaaaaaaaaaaaag

SEQ ID NO: 143 - DNA, 2795 bp, Homo sapiens
  ref <308>: DATABASE ACCESSION NUMBER: AF095719
  ref <309>: DATABASE ENTRY DATE: 2001-06-18
cggggacatgaggtggatactgttcattggggcccttattgggtccagcatctgtggccgagaaaaattttttggggaccaagttttgaggattaatgtcagaaatggagacgagatcagcaaattgagtcaactagtgaattcaaacaacttgaagctcaatttctggaaatctccctcctccttcaatcggcctgtggatgtcctggtcccatctgtcagtctgcaggcatttaaatccttcctgagatcccagggcttagagtacgcagtgacaattgaggacctgcaggcccttttagacaatgaagatgatgaaatgcaacacaatgaagggcaagaacggagcagtaataacttcaactacggggcttaccattccctggaagctatttaccacgagatggacaacattgccgcagactttcctgacctggcgaggagggtgaagattggacattcgtttgaaaaccggccgatgtatgtactgaagttcagcactgggaaaggcgtgaggcggccggccgtttggctgaatgcaggcatccattcccgagagtggatctcccaggccactgcaatctggacggcaaggaagattgtatctgattaccagagggatccagctatcacctccatcttggagaaaatggatattttcttgttgcctgtggccaatcctgatggatatgtgtatactcaaactcaaaaccgattatggaggaagacgcggtcccgaaatcctggaagctcctgcattggtgctgacccaaatagaaactggaacgctagttttgcaggaaagggagccagcgacaacccttgctccgaagtgtaccatggaccccacgccaattcggaagtggaggtgaaatcagtggtagatttcatccaaaaacatgggaatttcaagggcttcatcgacctgcacagctactcgcagctgctgatgtatccatatgggtactcagtcaaaaaggccccagatgccgaggaactcgacaaggtggcgaggcttgcggccaaagctctggcttctgtgtcgggcactgagtaccaagtgggtcccacctgcaccactgtctatccagctagcgggagcagcatcgactgggcgtatgacaacggcatcaaatttgcattcacatttgagttgagagataccgggacctatggcttcctcctgccagctaaccagatcatccccactgcagaggagacgtggctggggctgaagaccatcatggagcatgtgcgggacaacctctactaggcgatggctctgctctgtctacatttatttgtacccacacgtgcacgcactgaggccattgttaaaggagctctttcctacctgtgtgagtcagagccctctgggtttgtggagcacacaggcctgcccctctccagccagctccctggagtcgtgtgtcctggcggtgtccctgcaagaactggttctgccagcctgctcaattttggtcctgctgtttttgatgagccttttgtctgtttctccttccaccctgctggctgggcggctgcactcagcatcaccccttcctgggtggcatgtctctctctacctcatttttagaaccaaagaacatctgagatgattctctaccctcattcacatctagccaagccagtgacctttgctctggtggcactgtgggagacaccacttgtctttaggtgggtctcaaagatgatgtagaatttcctttaatttctcgcagtcttcctggaaaatattttcctttgagcagcaaatcttgtagggatatcagtgaaggtctctccctccctcctctcctgttttttttttttgaggcagagttttgctcttgttgcccaggctggagtgtgatgggctcgatcttggctcaccacaacctctgcctcctgggttcaagcaattctcctgcctcagcctcttgagtagcttggtttataggcgcatgccaccatgcctggctaattttgtgtttttagtagagacagggtttctccatgttggtcaggctggtctcaaactcccaacctcaggtgatctgccctccttggcctcccagagtgctgggattacagggggagccactgtgccggtcccgtcccctccttttttaggcctgaatacaaagtagaagatcactttccttcactgtgctgagaatttctagatactacagttcttactcctctcttccctttgttattcagtgtgaccaggatgggcgggaggggatctgtgtcactgtaggtactgtgcccaggaaggctgggtgaagtccccatctaaattgcaggatggcgaaattatccccatctgtcctaatgggcttccctcctctttgccttttgaactcacttcaaagatgtaggcctcatcttacaggtcctaaatcactcatctggcctggataatctcactgccctggcacattcccatttgtgctggggtatcctgtgtttccttgtcctggtttgtgtgtgtgtgtgtgtgtgtgtgtgtgtgtgtgtgtgtttgtgtgtgtgtgtctgtctattttgatccggcccaagttcctaagtagagcaagaattcatcaaccagctgcctttgtttcatttcacctcagcacgtaccatcgtcctttggggggttgtttgtttttgttttttgctttaaccaaaatgtttgtaaatcttaacctcctgcctaggatttgtacagcatttggtgtgtgcttataagccaataaatattcaatgtgagttccaaaaaaaaaaaaaaaaaaaaaaaaaaaaaa

SEQ ID NO: 144 - DNA, 484 bp, Homo sapiens
  ref <308>: DATABASE ACCESSION NUMBER: AF098641
  ref <309>: DATABASE ENTRY DATE: 2001-06-18
ccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaa

SEQ ID NO: 145 - DNA, 2032 bp, Homo sapiens
  ref <308>: DATABASE ACCESSION NUMBER: AF099032
  ref <309>: DATABASE ENTRY DATE: 2001-06-18
tttgcggcaagctcgggccgggcttgcttgacggcggtgtggcggaggccccgccccaggcggcaggaacctggagggaggcggaggaatatgtccgagagggaagtgtcgactgcgccggcgggaacagacatgcctgcggccaagaagcagaagctgagcagtgacgagaacagcaatccagacctctctggagacgagaatgatgacgctgtcagtatagaaagtggtacaaacactgaacgccctgatacacctacaaacacgccaaatgcacctggaaggaaaagttggggaaagggaaaatggagttcaaagaaatgcaaatattctttcaaatgtgtaaatagtctcaaggaagatcataaccaaccattgtttggagttcagtttaactggcacagtaaagaaggagatccattagtgtttgcaactgtaggaagcaacagagttaccttgtatgaatgtcattcacaaggagaaatccggttgttgcaatcttacgtggatgctgatgctgatgaaaacttttacacttgtgcatggacctatgatagcaatacgagccatcctctgctggctgtagctggatctagaggcataattaggataataaatcctataacaatgcagtgtataaagcactatgttggccatggaaatgctatcaatgagctgaaattccatccaagagatccaaatcttctcttgtcagtaagtaaagatcatgctttacgattatggaatatccagacggacactctggtggcaatatttggaggcgtagaagggcacagagatgaagttctaagtgctgattatgatcttttgggtgaaaaaataatgtcctgtggtatggatcattctcttaaactttggaggatcaattcaaagagaatgatgaatgcaattaaggaatcttatgattataatccaaataaaactaacaggccatttatttctcagaaaatccattttcctgatttttctaccagagacatacataggaattatgttgattgtgtgcgatggttaggcgatttgatactttctaagtcttgtgaaaatgccattgtgtgctggaaacctggcaagatgaaagatgatatagataaaattaaacccagtgaatctaatgtgactattcttgggcgatttgattacagccagtgtgacatttggtacatgaggttttctatggatttctggcaaaagatgcttgcattgggcaatcaagttggcaaactttatgtttgggatttagaagtagaagatcctcataaagccaagtaagtatttagaaatttctgttcaaaatttcaggctttttctccacacttgtatgccaatgtagagaagatcatttatatttgcagtgccatccttaagtcatttttaacatttactgttttcagagttaaagttattcttttttattccaataatttttgtttttcctaagtaccttggtgacaagtcatttcttgtttttatacaaattatgtagtgcttgttgaacttaaaatatatctaaattttataaaatttgagactgagctcttagtgaagtatattctggttttaagtgcttttcgtatgacttggaacatctgcttattttctaatccgctgttttagggtagacactgacaacgttatgtgtggtctttaacctgttgtcatgttttttccctagatgtacaacactgactcatcataaatgtggtgctgctattcgacaaaccagttttagcagggatagcagcattcttatagctgtttgtgatgatgccagtatttggcgctgggatcgacttcgataaaatactttgcctaatcaaaattagagtgtgtttgttgtctgtgtaaaatagaattaatgtatcttgctagtaagggcacgtagagcatttagagttgtctttcagcattcaatcaggctgagctgaatgtagtgatgtttacattgtttacattctttgtactgtcttcctgctcagactctactgcttttaataaaaatttatttttg

SEQ ID NO: 146 - DNA, 3075 bp, Homo sapiens
  ref <308>: DATABASE ACCESSION NUMBER: AF100756
  ref <309>: DATABASE ENTRY DATE: 2001-06-18
ggcactgtagcaccgctactccgtgccgcgcccgtcgagcattgcgttgctgcattgcgccccaccgactccactatgttgaagaaattcgacaagaaggatgaggagtcaggtggaggctccaacccattccagcaccttgagaagagtgcggtactccaggaggcccgtgtatttaatgaaactcccatcaaccctcggaaatgtgcccacatcctcaccaagattctttatctcataaaccagggggagcacctggggaccacggaagcgaccgaggccttctttgccatgaccaagctctttcagtccaatgaccccacactccgtcggatgtgctacttgaccatcaaggagatgtcttgcattgcagaggatgtcatcattgtcaccagcagcctaacaaaagacatgactgggaaagaagacaactaccggggcccggccgtgcgagccctctgccagatcactgatagcaccatgctgcaggctattgagcgctacatgaaacaagccattgtggacaaggtgcccagtgtctccagctctgccctcgtgtcttccttgcacctgctgaagtgcagctttgacgtggtcaagcgctgggtgaatgaggctcaggaggcagcatccagtgataacatcatggtccagtaccacgcactagggctcctgtaccatgtgcgtaagaatgaccgcctagccgtcaataagatgatcagcaaggtcacacggcatggccttaagtctccctttgcctactgcatgatgatccgggtggccagcaagcagctggaagaggaggatggcagccgtgacagcccactgtttgacttcatcgagagctgcttgcgcaacaagcacgagatggtggtgtatgaagccgcctcggccattgtcaacctgcctgggtgcagcgccaaggagctggccccagctgtctcagtgctccagctcttctgcagctcccccaaggccgccctccgttacgccgccgtccgcaccctcaacaaggtggccatgaagcacccgtccgctgtgacagcttgtaatctggatctggagaacctggtcacagattcaaaccgcagcattgccacgctggccatcaccaccctccttaagacgggcagcgagagcagcatcgaccgcctcatgaagcagatctcctccttcatgtcagaaatctcggatgaattcaaggtggtggttgtccaggccatcagtgccctgtgtcagaaatatcctcgcaaacacgccgtccttatgaacttcctgttcaccatgctgcgggaagagggtggctttgagtataagcgcgctatcgtggactgcatcatcagcatcattgaagagaactcagagagcaaggagacagggctgtcacatctgtgcgagttcatcgaggactgcgagttcacagtgctggccacccgtattctacatctcctgggccaggaggggcccaagaccaccaatccctcaaagtacatccgcttcatctataaccgagtggtcttggagcatgaggaggtccgggcaggtgctgtgagtgctctggcgaagtttggagcccagaatgaagagatgttacccagtatcttggtgttgctgaagaggtgtgtgatggatgatgacaatgaagtaagggaccgagccaccttctacctaaatgtcctggagcagaagcagaaggcccttaatgcaggctatatcctaaatggtctgactgtgtccatccctggtctggagagggctctgcagcagtacactctagaaccatcagaaaaaccttttgacctcaagtctgtgcccctggccacggcgcccatggcagagcagagaacagaaagtacccccatcacagcagtcaaacagcctgagaaagtggcagctaccaggcaggagatcttccaggagcagttggcagcagtgccagagttccgcggtcttgggcccctcttcaagtcctcgcctgagcccgtggccctcaccgagtcagagacggagtatgtcatccgctgcaccaaacacaccttcaccaaccacatggtttttcagtttgactgcacaaacacactcaatgaccagaccttggagaatgtcacagtgcagatggagcccactgaggcctatgaggtgctctgttacgtgcctgcccggagcctgccctacaaccagcccgggacctgctacacactggtggcactgcccaaagaagaccccacagctgtggcctgcacattcagctgcatgatgaagttcactgtcaaggactgtgatcccaccactggggagactgatgacgaaggctatgaggatgagtatgtgctggaagatctggaagttactgtagctgatcacattcaaaaggtcatgaaactgaacttcgaagcagcctgggatgaggtaggggatgaatttgagaaggaggaaacgttcaccttgtctaccatcaagacacttgaagaggctgtgggtaatattgtgaagttcttgggaatgcacccttgtgagaggtcagacaaagtgccggataacaagaacacccacacgttgctcctggctggtgtgttccggggtggtcatgacatcctggtgcgctcccggctgctgcttttggacacagtgacaatgcaggtgacagccagaagtttggaggagctgccagtagacatcatcttggcatctgtgggataagaggccagcctgcataggacctcatacccttccccaacactacctggaagttgtgccttcctcatgaaactggcagaaaccccttcccaagcttctgtattgaaaaacaattaggaatcattgcagatttttttttattctgctcccacctcccacccgggactacttgctggtgactttttttttttttttttttaaataggggatgattttagcttgtcctaaatcttgctgtccacccttccaggaaagggacattgtaaatgaataaaacattctcaactcctcttgaatctatcccccaagaaaccatcttatccctgtaataaatcagcatgtatttattgaaaaaaaaaaaaaaaaaaaaaaaaaaaa

SEQ ID NO: 147 - DNA, 3443 bp, Homo sapiens
  ref <308>: DATABASE ACCESSION NUMBER: AF101051
  ref <309>: DATABASE ENTRY DATE: 2001-06-18
gagcaacctcagcttctagtatccagactccagcgccgccccgggcgcggaccccaaccccgacccagagcttctccagcggcggcgcagcgagcagggctccccgccttaacttcctccgcggggcccagccaccttcgggagtccgggttgcccacctgcaaactctccgccttctgcacctgccacccctgagccagcgcgggcgcccgagcgagtcatggccaacgcggggctgcagctgttgggcttcattctcgccttcctgggatggatcggcgccatcgtcagcactgccctgccccagtggaggatttactcctatgccggcgacaacatcgtgaccgcccaggccatgtacgaggggctgtggatgtcctgcgtgtcgcagagcaccgggcagatccagtgcaaagtctttgactccttgctgaatctgagcagcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtcattgggggtgcgatatttcttcttgcaggtctggctattttagttgccacagcatggtatggcaatagaatcgttcaagaattctatgaccctatgaccccagtcaatgccaggtacgaatttggtcaggctctcttcactggctgggctgctgcttctctctgccttctgggaggtgccctactttgctgttcctgtccccgaaaaacaacctcttacccaacaccaaggccctatccaaaacctgcaccttccagcgggaaagactacgtgtgacacagaggcaaaaggagaaaatcatgttgaaacaaaccgaaaatggacattgagatactatcattaacattaggaccttagaattttgggtattgtaatctgaagtatggtattacaaaacaaacaaacaaacaaaaaacccatgtgttaaaatactcagtgctaaacatggcttaatcttattttatcttctttcctcaatataggagggaagattttaccatttgtattactgcttcccattgagtaatcatactcaaatgggggaaggggtgctccttaaatatatatagatatgtatatatacatgtttttctattaaaaatagacagtaaaatactattctcattatgttgatactagcatacttaaaatatctctaaaataggtaaatgtatttaattccatattgatgaagatgtttattggtatattttctttttcgtccttatatacatatgtaacagtcaaatatcatttactcttcttcattagctttgggtgcctttgccacaagacctagcctaatttaccaaggatgaattctttcaattcttcatgcgtgcccttttcatatacttattttattttttaccataatcttatagcacttgcatcgttattaagcccttatttgttttgtgtttcattggtctctatctcctgaatctaacacatttcatagcctacattttagtttctaaagccaagaagaatttattacaaatcagaactttggaggcaaatctttctgcatgaccaaagtgataaattcctgttgaccttcccacacaatccctgtactctgacccatagcactcttgtttgctttgaaaatatttgtccaattgagtagctgcatgctgttcccccaggtgttgtaacacaactttattgattgaatttttaagctacttattcatagttttatatccccctaaactacctttttgttccccattccttaattgtattgttttcccaagtgtaattatcatgcgttttatatcttcctaataaggtgtggtctgtttgtctgaacaaagtgctagactttctggagtgataatctggtgacaaatattctctctgtagctgtaagcaagtcacttaatctttctacctcttttttctatctgccaaattgagataatgatacttaaccagttagaagaggtagtgtgaatattaattagtttatattactctcattctttgaacatgaactatgcctatgtagtgtctttatttgctcagctggctgagacactgaagaagtcactgaacaaaacctacacacgtaccttcatgtgattcactgccttcctctctctaccagtctatttccactgaacaaaacctacacacataccttcatgtggttcagtgccttcctctctctaccagtctatttccactgaacaaaacctacgcacataccttcatgtggctcagtgccttcctctctctaccagtctatttccattctttcagctgtgtctgacatgtttgtgctctgttccattttaacaactgctcttacttttccagtctgtacagaatgctatttcacttgagcaagatgatgtatggaaagggtgttggcactggtgtctggagacctggatttgagtcttggtgctatcaatcaccgtctgtgtttgagcaaggcatttggctgctgtaagcttattgcttcatctgtaagcggtggtttgtaattcctgatcttcccacctcacagtgatgttgtggggatccagtgagatagaatacatgtaagtgtggttttgtaatttgaaaagtgctatactaagggaaagaattgaggaattaactgcatacgttttggtgttgcttttcaaatgtttgaaaataaaaaaatgttaagaaatgggtttcttgccttaaccagtctctcaagtgatgagacagtgaagtaaaattgagtgcactaaacgaataagattctgaggaagtcttatcttctgcagtgagtatggcccaatgctttctgtggctaaacagatgtaatgggaagaaataaaagcctacgtgttggtaaatccaacagcaagggagatttttgaatcataataactcataaggtgctatctgttcagtgatgccctcagagctcttgctgttagctggcagctgacgctgctaggatagttagtttggaaatggtacttcataataaactacacaaggaaagtcagccaccgtgtcttatgaggaattggacctaataaattttagtgtgccttccaaacctgagaatatatgcttttggaagttaaaatttaaatggcttttgccacatacatagatcttcatgatgtgtgagtgtaattccatgtggatatcagttaccaaacattacaaaaaaattttatggcccaaaatgaccaacgaaattgttacaatagaatttatccaattttgatctttttatattcttctaccacacctggaaacagaccaatagacattttggggttttataatgggaatttgtataaagcattactctttttcaataaattgttttttaatttaaaaaaaggaaaaaaaaaaaaaaaaa

SEQ ID NO: 148 - DNA, 304 bp, Homo sapiens
  ref <308>: DATABASE ACCESSION NUMBER: AF103375
  ref <309>: DATABASE ENTRY DATE: 2001-06-18
cagccaccctgtctgtgtctccaggggagagagccaccctctcctgcagggccagtcagagtgttagcagcagcttagcctggtaccagcagaaacctggccagcctcccaggctcctcatctatggtgcatccaccagggccactggtatcccagccagggtcagtggcagtgggtctgggacagagttcactctcaccatcagcagcctgcagtctgaagattttgcagtttattactgtcagcagtattatgattggccccggacgttcggccaagggaccaaggtggaaatcaaacgtaa

SEQ ID NO: 149 - DNA, 304 bp, Homo sapiens
  ref <308>: DATABASE ACCESSION NUMBER: AF103458
  ref <309>: DATABASE ENTRY DATE: 2001-06-18
tctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcaccgtggacgttcggccaagggaccaaggtggaaataa

SEQ ID NO: 150 - DNA, 325 bp, Homo sapiens
  ref <308>: DATABASE ACCESSION NUMBER: AF103530
  ref <309>: DATABASE ENTRY DATE: 2001-06-18
ccatcttctgtttctgcatctataggagacagagtcaccatcacttgtcgggcgagtcagggtgttagcaggtggttagcctggtatcaacagaaaccagggaaagcccctaaactcctgatctatgctgcaagcagtttgcaaagtggggtcccatcaaggttcagcggcagtggatctgggacagatttcactctctctatcagcagcctgcagcctgaagatttcgcaacttacttttgtcaacagactaacagtttcccgctcactttcggcggagggaccaaggtggagatcaaacgaactgtgggcccaccatctgtaa

SEQ ID NO: 151 - DNA, 2068 bp, Homo sapiens
  ref <308>: DATABASE ACCESSION NUMBER: AF103804
  ref <309>: DATABASE ENTRY DATE: 2001-06-18
ggcacgaggtggcatagcataaccacagtaagaacagaacagatattcagcagaaaactttttatactctaattctttttttttttttttttgagacagagttttagtcttgtttcccaggctggagtgcaatggcacaatcttggctcactgcaacctccgcctcctgggttcaggcaattttcctgcctcagcctcccaagtagctgggattacaggcacccaccaccatgcccagctaatttttgtatttttaatagagagctaataattgtatatttaataaagacgggtttcaccatgttggccaggctggtcttgaactcctgacctcaggtgatcctcctgcattggcctcccaaagtgctggaattccaggcatgagccactgcgcccagtctacacactaattcttgttagcccaacagctgttctgttctatctacccctcatttcacgctcaaggagtcatacctagaatagttacacacaagagggaaactggaagccaaacactgtacagtattgtgtagaaagtcacctccctactccttttattttacatgagtgctgatgtgttttggcagatgagctttcagctgaggcctgatggaaattgagataacctgcaaagacataacagtatttatgagttatatcttagttcttgaaattgtggaatgcatgattgacaatatatttttaatttttattttttcaagtaataccagtactgtttaactatagccagaactggctaaaatttttatattttcagagttgaagttggtgaagacattcatgatttaaacaccagatcctgaaaggggttaaatctactttgaaatgaatctgcaatcagtatttcaaagcttttctggtaattttagtgatcttatttgattagactttttcagaagtactaaataaggaattttaacaggtttttattaatgcacagataaatagaagtacagtgaggtctatagccattttattaaaatagcttaaaagtttgtaaaaaaatgaatctttgtaattacttaatatgttagttaagaacccgtcaagcttatatttgctagacttacaaattattttaaatgcatttatcttttttgacactattcagtggaatgtgtaagctagctaattcttgttttctgatttaaagcacttttaaatcttatcctgccccctaaaaacaaaaggttttgatcacaaggggaaatttaagattgttaaccctgtttttcagaagggctactgttaattgcacataaacatgaaatgtgttttcccctgtgtactaacacattctaggcaaaattcaaacttatagtggtaaagaaacaggttgttcacttgctgaggtgcaaaaattcttaagacttctgtttgaaattgctcaatgactaggaaaagatgtagtagtttactaaaattgtttttctaccatatcaaattaaacaattcatgcctttttagggtcaggcctacaatgaataggtatggtggtttcacagaattttaaaatagagttaaagggaagtgatgtacatttcgggggcattagggtagggagatgaatcaaaaaatacccctagtaatgctttatattttaatactgcaaaagctttacaaatggaaaccatgcaattacctgccttagttcttttgtcataaaaacaatcacttggttggttgtattgtagctattacttatacagcaacatttcttcaattagcagtctagacattttataaacagaaatcttggaccaattgataatatttctgactgtattaatattttagtgctataaaatactatgtgaatctcttaaaaatctgacattttacagtctgtattagacatactgtttttataatgttttacttctgccttaagatttaggttttttaaatgtatttttgccctgaattaagtgttaatttgatggaaactctgcttttaaaatcatcatttactgggttctaataaattaaaaattaaacttgtaaaaaaaaaaaaaaaaaaaaaaaaaaaaaaaaaaaaaaaaaaaaa

SEQ ID NO: 152 - DNA, 2091 bp, Homo sapiens
  ref <308>: DATABASE ACCESSION NUMBER: AF111849
  ref <309>: DATABASE ENTRY DATE: 2001-06-18
gaattccacctgcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaacttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgattaaaaaaaaaaaaaaaaaaaaaaaaaaaaaaaaaaaaaaaaaaaaaaaaaaaaaaaaaaaaaaaaaaaaaaaaaaaaaa

SEQ ID NO: 153 - DNA, 1104 bp, Homo sapiens
  ref <308>: DATABASE ACCESSION NUMBER: AF112213
  ref <309>: DATABASE ENTRY DATE: 2001-06-18
cctgctctgtagagccggcggcaaccgggtagcttggccaggttgtgaggaaccgcagcgcccgcaggaccgggccgctgagcctgcagccgccccgcgccgtgacctgcgaccctagaccccgactaccctttggctcagcccgcgcgccccaggcccggcccgggcggcgcgacgggaggatgagcggcgggcggcggaaggaggagccgcctcagccgcagctggccaacggggccctcaaagtctccgtctggagtaaggtgctgcggagcgacgcggcctgggaggataaggatgaatttttagatgtgatctactggttccgacagatcattgctgtggtcctgggtgtcatttggggagttttgccattacgagggttcttgggaatagcaggattctgcctgatcaatgcaggagtcctgtacctctacttcagcaattacctacagattgatgaggaagaatatggtggcacgtgggagctcacgaaggaagggtttatgacctcttttgccttgttcatggtcatttggatcatcttttacactgccatccattatgactgatggtgtacagctcccaagtgctccctatccagtccaaaggaccctcttgattacagcacaggaacttgatcgttggggaaccccagccccttggaacttggaagacccgtgtttcctggaccgcgaatcagtgtgttgggcatcagtgttttctgcaagggttgtgacctgaaactttttaaaaaccacccacctttggggaagcatttctgaatttatccatcaccaaccatttcttcttggataccatcaagtaacagctattatttgccaagtggagctgtcatttaatttgatgcacctctggattcagatgaaacattaaattgtcttcctcgattctccatcgggtgtagagtttttaaactatcaatggcatttcaagtcttctgaaacagcatggctgtatgtgcgtggtccatagcacagtacatgcagcatctaataagagtttccattgtagaatgttttcacatacttgaataaatcaaatctttaattgagaaaaaaaaaaaaaaaaaaaaaaaaaaaa

SEQ ID NO: 154 - DNA, 1065 bp, Homo sapiens
  ref <308>: DATABASE ACCESSION NUMBER: AF113132
  ref <309>: DATABASE ENTRY DATE: 2001-06-18
ccttggctgactcaccgccctcgccgccgcaccatggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctagctgttccagacaactataaggtgatttttctgcaaggaggtgggtgcggccagttcagtgctgtccccttaaacctcattggcttgaaagcaggaaggtgtgcggactatgtggtgacaggagcttggtcagctaaggccgcagaagaagccaagaagtttgggactataaatatcgttcaccctaaacttgggagttatacaaaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtgtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaac

SEQ ID NO: 155 - DNA, 1382 bp, Homo sapiens
  ref <308>: DATABASE ACCESSION NUMBER: AF116238
  ref <309>: DATABASE ENTRY DATE: 2001-06-18
agaacatccggcgaagaagctcaggagcggtggcgacgaggagcggcgcgagaagccgcccaagcggaagatcgtgctgctcatggcctattcgggcaagggctaccacggcatgcagaggaatgtcgggtcctcacaattcaaaacaattgaagatgacttggtgtccgccctcgtccggtcaggctgtattcctgaaaatcatggtgaggacatgaggaaaatgtccttccagcgctgcgcccggacagacaagggtgtgtccgcagccggccaggtggtatccctgaaggtgtggctgattgacgacattctagaaaagatcaacagccaccttccctctcacattcggattctgggactgaagcgggtcacgggcgggtttaactccaagaacagatgtgatgccaggacctattgctacctgctgcccacgtttgcctttgcgcacaaggaccgggacgttcaggatgagacctaccgcctgagcgccgagacgctgcagcaggtcaacaggctcctggcctgctacaagggcacgcacaacttccacaatttcacctcgcagaaggggccgcaggatcccagtgcctgccgctacatcctggagatgtactgcgaggaaccctttgtgcgggagggcctggagtttgcggtgatcagggtgaagggccagagcttcatgatgcatcagatccggaagatggtcggcctggtggtggccattgtgaagggttatgcccctgagagcgtgctggagcgcagctggggcacagagaaggtggacgtgcccaaggcgcccggactcggcctggtcctggagagggtgcacttcgagaagtacaaccagcgctttggcaacgatgggctgcatgagccgctggactgggcgcaggaggaaggaaaggtcgcagccttcaaggaggagcacatctaccccaccatcatcggcaccgagcgggacgaacgctccatggcccagtggctgagcaccttgcccatccacaacttcagtgccaccgctctcacggcaggtggcacgggcgccaaggtgcccagtcccctggaaggcagtgaaggggacggagacactgactgaggcgatgggagctgcccaccagagtgcctctgagcagctcacagtgtgtgcccagatgtgccacccctgtgggcagcaagaagctgggatcgctgcagccatgttttccggccatgccggcgttgtaacctcaggaccttcccttgtaggaacagcctttctcgaatctgttttcagctcttgcattgcatagatgaacctcagcatgtaaagaactatttttttaaagaagtgattttcttattaaacaagtacaaattttgcttagtcaaaaaaaaaaaaa

SEQ ID NO: 156 - DNA, 876 bp, Homo sapiens
  ref <308>: DATABASE ACCESSION NUMBER: AF116682
  ref <309>: DATABASE ENTRY DATE: 2001-06-18
gccgctttttttttttgcctcagccacttccttccttggcctcaccctccccagtgcactgaagaaggtaaccgggtccagacccacgcggcgccagttctccggcgggaaggaaaaccgcgcagagaggcagcaatgaatgtggatcacgaggttaacctcttagtggaggaaattcatcgtttgggttcaaaaaatgctgatggaaagttaagcgtgaaatttggggtcctcttccgtgatgataaatgtgccaacctctttgaagcattggtaggaactcttaaagctgcaaaacgaaggaagattgtaacatatccaggagagctgcttctgcaaggtgttcatgatgatgttgacattatattactgcaagattaatgtggtttacatatctttatgtactgccattttttgtttctggtaaactggaatataaagtgaaagaacaaacatttgaacatacttaatgtatttttatagaactttgtaaacgaaaggagattcatgttttagaagtctgtccttttttatatcttgaaagaaaatctatgtatgatgctataaaataaatcctattatttttctcaggaatctggttaggaattgcaggcaatgagattttttgcggggcagggatgggaatgtttgttcataaataattagacattttctatagatatttgacattctgcgaaagcaacaagcaaactgaagaccaactcctatgagaaatattatgatgtttatgtaataaagacatgtaactgtcttaaatttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 157 - DNA, 3149 bp, Homo sapiens
  ref <308>: DATABASE ACCESSION NUMBER: AF118224
  ref <309>: DATABASE ENTRY DATE: 2001-06-18
gacgcctgtgagacccgcgagcggcctcggggaccatggggagcgatcgggcccgcaagggcggagggggcccgaaggacttcggcgcgggactcaagtacaactcccggcacgagaaagtgaatggcttggaggaaggcgtggagttcctgccagtcaacaacgtcaagaaggtggaaaagcatggcccggggcgctgggtggtgctggcagccgtgctgatcggcctcctcttggtcttgctggggatcggcttcctggtgtggcatttgcagtaccgggacgtgcgtgtccagaaggtcttcaatggctacatgaggatcacaaatgagaattttgtggatgcctacgagaactccaactccactgagtttgtaagcctggccagcaaggtgaaggacgcgctgaagctgctgtacagcggagtcccattcctgggcccctaccacaaggagtcggctgtgacggccttcagcgagggcagcgtcatcgcctactactggtctgagttcagcatcccgcagcacctggtggaggaggccgagcgcgtcatggccgaggagcgcgtagtcatgctgcccccgcgggcgcgctccctgaagtcctttgtggtcacctcagtggtggctttccccacggactccaaaacagtacagaggacccaggacaacagctgcagctttggcctgcacgcccgcggtgtggagctgatgcgcttcaccacgcccggcttccctgacagcccctaccccgctcatgcccgctgccagtgggccctgcggggggacgccgactcagtgctgagcctcaccttccgcagctttgaccttgcgtcctgcgacgagcgcggcagcgacctggtgacggtgtacaacaccctgagccccatggagccccacgccctggtgcagttgtgtggcacctaccctccctcctacaacctgaccttccactcctcccagaacgtcctgctcatcacactgataaccaacactgagcggcggcatcccggctttgaggccaccttcttccagctgcctaggatgagcagctgtggaggccgcttacgtaaagcccaggggacattcaacagcccctactacccaggccactacccacccaacattgactgcacatggaacattgaggtgcccaacaaccagcatgtgaaggtgcgcttcaaattcttctacctgctggagcccggcgtgcctgcgggcacctgccccaaggactacgtggagatcaatggggagaaatactgcggagagaggtcccagttcgtcgtcaccagcaacagcaacaagatcacagttcgcttccactcagatcagtcctacaccgacaccggcttcttagctgaatacctctcctacgactccagtgacccatgcccggggcagttcacgtgccgcacggggcggtgtatccggaaggagctgcgctgtgatggctgggccgactgcaccgaccacagcgatgagctcaactgcagttgcgacgccggccaccagttcacgtgcaagaacaagttctgcaagcccctcttctgggtctgcgacagtgtgaacgactgcggagacaacagcgacgagcaggggtgcagttgtccggcccagaccttcaggtgttccaatgggaagtgcctctcgaaaagccagcagtgcaatgggaaggacgactgtggggacgggtccgacgaggcctcctgccccaaggtgaacgtcgtcacttgtaccaaacacacctaccgctgcctcaatgggctctgcttgagcaagggcaaccctgagtgtgacgggaaggaggactgtagcgacggctcagatgagaaggactgcgactgtgggctgcggtcattcacgagacaggctcgtgttgttgggggcacggatgcggatgagggcgagtggccctggcaggtaagcctgcatgctctgggccagggccacatctgcggtgcttccctcatctctcccaactggctggtctctgccgcacactgctacatcgatgacagaggattcaggtactcagaccccacgcagtggacggccttcctgggcttgcacgaccagagccagcgcagcgcccctggggtgcaggagcgcaggctcaagcgcatcatctcccaccccttcttcaatgacttcaccttcgactatgacatcgcgctgctggagctggagaaaccggcagagtacagctccatggtgcggcccatctgcctgccggacgcctcccatgtcttccctgccggcaaggccatctgggtcacgggctggggacacacccagtatggaggcactggcgcgctgatcctgcaaaagggtgagatccgcgtcatcaaccagaccacctgcgagaacctcctgccgcagcagatcacgccgcgcatgatgtgcgtgggcttcctcagcggcggcgtggactcctgccagggtgattccgggggacccctgtccagcgtggaggcggatgggcggatcttccaggccggtgtggtgagctggggagacggctgcgctcagaggaacaagccaggcgtgtacacaaggctccctctgtttcgggactggatcaaagagaacactggggtataggggccggggccacccaaatgtgtacacctgcggggccacccatcgtccaccccagtgtgcacgcctgcaggctggagactggaccgctgactgcaccagcgcccccagaacatacactgtgaactcaatctccagggctccaaatctgcctagaaaacctctcgcttcctcagcctccaaagtggagctgggaggtagaaggggaggacactggtggttctactgacccaactgggggcaaaggtttgaagacacagcctcccccgccagccccaagctgggccgaggcgcgtttgtgtatatctgcctcccctgtctgtaaggagcagcgggaacggagcttcggagcctcctcagtgaaggtggtggggctgccggatctgggctgtggggcccttgggccacgctcttgaggaagcccaggctcggaggaccctggaaaacagacgggtctgagactgaaaatggtttaccagctcccaggtgacttcagtgtgtgtattgtgtaaatgagtaaaacattttatttctttttaaaaaaaaaaa

SEQ ID NO: 158 - DNA, 1748 bp, Homo sapiens
  Modified_base 1 ... 1748: n = a,c,g, or t
  ref <308>: DATABASE ACCESSION NUMBER: AF118274
  ref <309>: DATABASE ENTRY DATE: 2001-06-18
aagaacgggcccaccgcgttcggggttctcctcccgsrgangggaacccaaaccctgtctctttccccakgtttcggaggaggctttggatacgtcctcggcggaatccactgggataaaacgggcttcgggagggccctggggggacagttccgagtcatwwacctcttcactgcggtcaccctgagygtcaccaccgtcctgaccctggtcagcatccctgagaggccgctgcggccgccgagtgagaagcgggcagccatgaagagccccagcctcccgctgcccccgtccccgcccgtcctgccagaggaaggccctggcgacagcctcccgtcgcacacggccaccaacttctccagccccatctcgccgcccagccccctcacgcccaagtacggcagcttcatcagcagggacagctccctgacgggcatcagcgagttcgcctcatcctttggcacggccaacatagacagcgtcctcattgactgcttcacgggcggccacgacagctacctggccatccctggcagcgtccccaggccgcccatcagcgtcagcttcccccgggcccccgacggcttctaccgccaggaccgtggacttctggagggcagagagggtgccctgacctccggctgtgacggggacattctgagggtgggctccttggacacctctaagccaaggtcatcagggattctgaagagacctcagaccttggccatcccggacgcagccggaggagggggtcccgaaaccagcaggagaaggaatgtgaccttcagtcagcaggtggccaatatcctgctcaacggcgtgaagtatgagagcgagctgacgggctccagcgagcgcgcggagcagcctctgtccgtggggcgcctctgctccaccatctgcaacatgcccaaggcgctacgcaccctctgcgtcaaccacttcctggggtggctctcattcgaggggatgttgctcttctacacagacttcatgggcgaggtggtgtttcagggggaccccaaggccccgcacacatcagaggcgtatcagaagtacaacagcggcgtgaccatgggctgctggggcatgtgtatctacgccttcagtgctgccttctactcagctatcctggagaagctggaggagttcctcagcgtccgcaccctctacttcatcgcctatctcgccttcggcctggggaccgggcttgccaccctctccaggaacctctacgtggtcctgtcgctctgcataacctacgggattttattttccaccctgtgcaccttgccttactcgctgctctgcgattactatcagagtaagaagtttgcagggtccagtgcggacggcacccggcggggcatgggcgtggacatctctctgctgagctgccagtacttcctggctcagattctggtctccctggtcctggggcccctgacctcggccgtgggcagtgccaacggggtgatgtacttctccagcctcgtgtccttcctgggctgcctgtactcctccctgtttgtcatttatgaaattcctcccagcgacgctgcagacgaggagcaccggcccctcctgctgaacgtctgacatcgcggagcctcgactccggagacgcgcctgcacctgggggtctggagcaggccgaccagtgaggaccaaagggccttgttggacagggggacaggctgcctactggaatgtaaatatgtgataaaataataaatgacaagcgc

SEQ ID NO: 159 - DNA, 3038 bp, Homo sapiens
  ref <308>: DATABASE ACCESSION NUMBER: AF119256
  ref <309>: DATABASE ENTRY DATE: 2001-06-18
gggcctactctgccgccgccgccgcccgcccgctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctccttctcctccccgcgtgcgcgtgcccttcttggctgcgcgccggcgccgcctggcgggcgggaggggaggtggcaggcgcgtttgcaggaggggcgcacctcttcgctcgcgcacccccccggaaggtagaccgggaaggggaagcgggcgggcggagaggagagatggcgcgcagtccagcgagggcgggggttggctatgtggggggtggtgcaccccgcagtctagacagtctgatccgggctgggggcgtgtacactcggcgcacctgcgagactacagagcctcgggccggcacgtgtggggagtgtggacacgtctgctgcgccccgcttctcgctgctgaggggaagggagggggcgggcaggtgcagcggccgggctagtgggagggggcggcggccatggagcgggtgaacgacgcttcgtgcggcccgtctggctgctacacataccaggtgagcagacacagcacggagatgctgcacaacctgaaccagcagcgcaaaaacggcgggcgcttctgcgacgtgctcttgcgggtaggcgacgagagcttcccagcgcaccgcgccgtgctggccgcctgcaacgagtactttgagtcggtgttcagcgcccagttgggcgacggcggagctgcggacgggggtccggctgatgtagggggcgcgacggcagcaccaggcggcggggccgggggcagccgggagctggagatgcacactatcagctccaaggtatttggggacattctggacttcgcctacacttcccgcatcgtggtgcgcttggagagctttcccgaactcatgacggccgccaagttcctgctgatgaggtcggttatcgaaatctgccaggaagtcatcaaacagtccaacgtacagatcctggtaccccctgcccgcgccgatataatgctctttcgcccccctgggacctcggacttgggcttccctttggacatgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggcatccagtgcccttcccctgactggcaagcgaggccggggccgcccaaggaaggccaacctgctggactcaatgtttgggtccccagggggcctgagggaggcaggcatccttccatgcggtctatgtggtaaggtgttcactgatgccaaccggctccggcagcacgaggcccagcacggtgtcaccagcctccagctgggctacatcgaccttcctcctccgaggctgggtgagaatgggctacccatctctgaagaccccgacggcccccgaaagaggagccggaccaggaagcaggtggcttgtgagatctgcggcaagatcttccgtgatgtgtatcatcttaaccggcacaagctgtcccactctggggagaagccctactcctgccctgtgtgtgggttgcggttcaagaaaaaagaccgcatgtcctaccatgtgcggtcccatgatgggtccgtgggcaagccttacatctgccagagctgtgggaaaggcttctccaggcctgatcacttgaacggacatatcaagcaggtgcacacttctgagcggcctcacaagtgtcaggtgtgggttgggagcagcagcggcctgccgcccctggaacctcttcctagcgacctgccatcatgggactttgcccagcctgctttgtggaggtcgtcccattcggttcctgacaccgccttttccctttctctaaaaaaatcattcccagcccttgaaaacctgggcccagcacactccagcaacactctcttctgcccagccccgccgggatatctgaggcagggctggactaccccagagggcagcagggcctttacccagtggcctgttggctagcctgggcctccctggagagggttgacagtggaagggaacaggaggggcatttggcctgagacccctgcttttgggaaaggctagcagggtggttcctgcccagcatgcccagctcctccctgggtgactcggaatctttcccatgtcaaaacccccaaatgggggtacaaagaacacctttctggaaccccctataacatccaaatttctttctgggctctcttgccttttcccccctttcacaaatggcacccctgggcatctgtccttgcctaagttattttggaagttggtgccttcctgggaactaaccaccaacttatctgcttcccttcccctggcatcacttcccataagcctggggtttctaaactggggcctggccacccctttccccactccaagagtgagtcggcctccagagaagactggcacaattccaactagagtcaacccatgctgccttttgcccttcccattcagatttagatcctgctttcatttttggctagtgaagtagatttttgtgtttttgaggtttattagcaggtttgctcaggaaccaaattaatgagtagttttatattgggccaccccaatatatggctttgggggctgaaaaagcagatgtagaccccctccctcggatccttattggtgtgccctttagcattccgcagattttgcggggtgaacaggagtgatgataaaatttttcattttaacaaaaaaaaaaaaaaaaaaaaaaaaaaaaaaaaaaaaaa

SEQ ID NO: 160 - DNA, 1282 bp, Homo sapiens
  ref <308>: DATABASE ACCESSION NUMBER: AF119665
  ref <309>: DATABASE ENTRY DATE: 2001-06-18
gggctctctccttgtcagtcggcgccgcgtgcgggctggtggctctgtggcagcggcggcggcaggactccggcactatgagcggcttcagcaccgaggagcgcgccgcgcccttctccctggagtaccgagtcttcctcaaaaatgagaaaggacaatatatatctccatttcatgatattccaatttatgcagataaggatgtgtttcacatggtagttgaagtaccacgctggtctaatgcaaaaatggagattgctacaaaggaccctttaaaccctattaaacaagatgtgaaaaaaggaaaacttcgctatgttgcgaatttgttcccgtataaaggatatatctggaactatggtgccatccctcagacttgggaagacccagggcacaatgataaacatactggctgttgtggtgacaatgacccaattgatgtgtgtgaaattggaagcaaggtatgtgcaagaggtgaaataattggcgtgaaagttctaggcatattggctatgattgacgaaggggaaaccgactggaaagtcattgccattaatgtggatgatcctgatgcagccaattataatgatatcaatgatgtcaaacggctgaaacctggctacttagaagctactgtggactggtttagaaggtataaggttcctgatggaaaaccagaaaatgagtttgcgtttaatgcagaatttaaagataaggactttgccattgatattattaaaagcactcatgaccattggaaagcattagtgactaagaaaacgaatggaaaaggaatcagttgcatgaatacaactttgtctgagagccccttcaagtgtgatcctgatgctgccagagccattgtggatgctttaccaccaccctgtgaatctgcctgcacagtaccaacagacgtggataagtggttccatcaccagaaaaactaatgagatttctctggaatacaagctgatattgctacatcgtgttcatctggatgtattagaagtaaaagtagtagcttttcaaagctttaaatttgtagaactcatctaactaaagtaaattctgctgtgactaatccaatatactcagaatgttatccatctaaagcatttttcatatctcaactaagataacttttagcacatgcttaaatatcaaagcagttgtcatttggaagtcacttgtgaatagatgtgcaaggggagcacatattggatgtatatgttaccatatgttaggaaataaaattattttgctgaaaaaaaaaaaaaaaaaa

SEQ ID NO: 161 - DNA, 1823 bp, Homo sapiens
  Modified_base 1 ... 1823: n = a,c,g, or t
  ref <308>: DATABASE ACCESSION NUMBER: AF121255
  ref <309>: DATABASE ENTRY DATE: 2001-06-18
atgcccatccagggccagccgtgcttctgcaaatacgcgcagggggcggacagcgtggagcccatgttccggcacctgaagaacacgtatgcgggcctgcagctggtggtggtcatcctgcccggcaagacgcccgtgtacgccgaggtcaagcgcgtgggagacacggtgctggggatggccacgcagtgcgtgcagatgaagaacgtgcagaggaccacgccacagaccctgtccaacctctggctgaagatcaacgtcaagctgggaggcgtgaacaacatcctgctgccccagggaaggccgccggtgttccaggagcccgtcatctttctgggagcagacgtcactcacccccccgccggggatgggaagaagccctccattgccgccgtggtggggagaatggacgcccaccccaatcgttactgcgccaccgtgcgcgtgcagcagcaccggcaggagatcatacaagacctggccgccatggtccgcgagctcctcatccagttctacaagtccacgcgcttcaagcccacccgcatcatcttctaccgcgacggtgtctctgaaggccagttccagcaggttctccaccacgagttgctggccatccgtgaggcctgtatcaagctagaaaaagactaccagcccgggatcaccttcatcgtggtgcagaagaggcaccacacccggctcttctgcactgacaagaacgagcgggttgggaaaagtggaaacattccagcaggcacgactgtggacacgaaaatcacccaccccaccgagttcgacttctacctgtgtagtcacgctggcatccaggggacaagcaggccttcgcactatcacgtcctctgggacgacaatcgtttctcctctgatgagctgcagatcctaacctaccagctgtgtcacacctacgtgcgctgcacacgctccgtgtccatcccagcgccagcatactacgctcacctggtggccttccgggccaggtaccacctggtggataaggaacatgacagtgctgaaggaagccatacctctgggcagagtaacgggcgagaccaccaagcactggccaaggcggtccaggttcaccaagacactctgcgcaccatgtactttgcttgacatgttttagtgtttagcgattgtgtaccgagtgggattcacgagaccagctacactcagaccaacagatggccagcccttccgtgacagccagcatcgaacatgagacgtcattgattttattagattctccgttttccagaatgccttccgtcccagatttcaacttggattttgactgcagactgtatgagaacccaatgtcataggaaatatggtttgctaaaatctataagctgcttattaaaacagagtcccgtgtgtcctaaaaatctcctaaaaccagtctatgaactcagggctttaaaacatttttaatttatttggtcattcaatttacttgtttttaatacatgattctctatgaaattgatgggctcaaactagctgtgaatcttctgagagtgaaagcaacacaaaacacaagtgtggttttaaagccttgaacattctgatgttgtcactaaagttgatttccaggcgatgctcgtgtgcccctggcgtggctcacccaagttcctcgactgagggccggtggccatncagaggcgtccgcaggtgccgtgttctgccagcaccgcccttcacccggcctgaactaaggagcagtgccagaaggtgggccccgtgtgtttacagcatttccaggtccagagaggttggcagacaagtgccattttaataaaaaa

SEQ ID NO: 162 - DNA, 1642 bp, Homo sapiens
  ref <308>: DATABASE ACCESSION NUMBER: AF131748
  ref <309>: DATABASE ENTRY DATE: 2001-06-18
aaaattgatgctactcaggtggaagtgaatccctttggtgaaactccagaaggacaagttgtctgttttgatgccaagataaactttgatgacaacgcagaattccgacaaaaagacatatttgctatggacgacaaatcagagaatgagcccattgaaaatgaagctgccaaatatgatctaaaatacataggactagatgggaacattgcctgctttgtgaatggtgctgggctcgccatggctacttgtgatatcattttccttaatggtgggaagccagccaacttcttggatcttggaggtggtgtaaaggaagctcaagtatatcaagcattcaaattgctcacagctgatcctaaggttgaagccatccttgtcaatatatttggtggtatcgtcaactgtgccatcattgccaatgggatcaccaaagcctgccgggagctagaactcaaggtgcccctggtggtccggcttgaaggaaccaacgtccaagaggcccagaagatactcaacaacagcggactccccattacttcagccattgacctggaggatgcagccaagaaggctgtggccagtgtggccaagaagtgatgtctttgtcctgatccaatggagaaagaaagccatttttccataaaaagggatggttcatcattgtgaaagaaatggttatctcattggggaagaaaaggggagggggaaggcaagaatcactgaaaaatcttaaatctgtgttttctggaataagatatctagacagcctaaatctgattttagtttttataaaaataatgtcttgtgttctcatacttttctgtcactgtaagcctgcccagtaggcagtgttttgcagactttggggagtggtctatgtggccaaatattgtgtgtatagacagaatttgaaatcaagtcctgcttcatttacaagaattttggtgggcatctaatcctacataatgaaaaagaaaaacagaccatttaaaaactcagacaagattatatttaatatattaattactaaaaaggcacaagattacactgaacatattagctactaaaaaggcactgctaagacattcaagcaaatagctattacacactactgcagattttacaggtttctaattctaacatatgtttgaaaaatccgtgagtattccaaaatatatttaataatggaatatctgcattaatataccatccatgtgtttttaccatttgccttaatattgaatatactgtttacctcacactaaaaagaaaaccagaagccttatttgtgattttgggagtggaagcttccatttttgtgtcaaaaatgaatcctgattcttatggaaatctctgttattaagatatttcaagatgagacaacactgaagatcaaattgtgtttagtatcactatcttctctcctcgtttctctcttactcctcatcctcccagaatctaccagtttatggtagaaagatgggaaccttatttgaatgtgttttttttttccatgatgtccaattttgttgtgggaaaggatttggataaaatttttgtttaaattttggtagatttttatctatacaaatttaaataaaattatgttttgtaagctgtaaaaaaaaaaaaaaaaaaa

SEQ ID NO: 163 - DNA, 1876 bp, Homo sapiens
  ref <308>: DATABASE ACCESSION NUMBER: AF131753
  ref <309>: DATABASE ENTRY DATE: 2001-06-18
caaatgtgtaatggaaaatttttaattaagaaaaacttcagttttgccaagtgcaatggtgttgccttctttaaaaaatgccgttttcttacactaccagtggatgtccagacatgctcttagtctactagagaggtgctgccttttctaagtcataatgaggaacagtcccttaatttcttgtgtgcaactctgttttatcctagaactaagagagcattggtttgttaaagagctttcaatgtatattaaaaccttcaatactcagaaatgatggattcctccaaggagtcctttactagcctaaacattctcaaatgtttgagattcaagtgaatggaaggaaaaccacatgcctttaaaactaaactgtaataattacctggctaatttcagctaagccttcatcataatttgttccctcagtaataggagaaatataaatacagtaagtttagattattgaattggtgcttgaaatttattggttttgttgtaattttatacagattatatgagggataagatactcatcaaattgcaaattcttttttttacagaagtgtgggtaacagtcacagcagttttttttaccaacagcatacttaacagacttgctgtgtagcagtttttttctggtggagttgctgtaagtcttgtaagtctaatgtggctatcctactcttttgggcaatgcatgtattatgcattggaaaggtattttttttaagttctgttggctagctatggttttcagtacatttcctactttaagagtaattactgacaaatatgtatttcctatatgtttatactttgattataaaaaagtattttgttttgattttttaacttgctgcattgttttgatactttctatttttttggtcaaatcatgtttagaaactttggatgagttaagaagtcttaagtatgcaggcgtttacgtgattgtgccattccaaagtgcatcagaactgtcattcccttctaatatcttctcaggagtaatacaaatcaggtatttcatcatcatttggtaatatgaaaactccagtgaactcccaaggacatttacaacatttatattcacacgctgtatggaagggtgtgggtgtgtgtgaaggggcgagtggagacactgtgtgtatctctagataagaagatatgcaccacgttgaaaatactcagtgtagatctctatgtgtataggtatctgtatatctttccttttgtttacaactgttaaaaaacctcaaaatagttctcttcaaaagaagagagattccaagcaacccatctttcttcagtatgtatgttctgtacatacttatcggagcgcgccagtaagtatcaggcatatatatctgtctgttagcaatgattattacatcatcagatcagcatgtgctatactccctgcaagaaatatactgacatgaacaggcagttcttggagaagaaagagcatttctttaagtacctggggaatacagctctcagtgatcagcagggagtttatttgaggacatcagtcacctttggggttgccatgtacaatgagatttataatcatgatactcttcggtggtagtttcaaaagacactactaatacgcaggaagcgttccagctatttaatgctggcaactactgtttaatggtcagttaaatctgtgataatggttggaagtgggtggggttatgaaattgtagatgtttttagaaaaacttgtgaatgaaaatgaatccaagtgtttcatgtgaagatgttgagccattgctatcatgcattcctgtctcatggcagaaaattttgaagattaaaaaataaaataatcaaaatgtttcctctttctaaaaaaaaaaaaaaaaaa

SEQ ID NO: 164 - DNA, 1641 bp, Homo sapiens
  ref <308>: DATABASE ACCESSION NUMBER: AF131760
  ref <309>: DATABASE ENTRY DATE: 2001-06-18
ctggacacttcccctgtggggctgctggcacctctggtgccacagcctgctacctgcctgctgaccgctgcaactaccagactttctgtgctgatggagcagatgagagacgctgtcggcattgccagcctggcaatttccgatgccgggacgagaagtgcgtgtatgagacgtgggtgtgcgatgggcagccagactgtgcggacggcagtgatgagtgggactgctcctatgttctgccccgcaaggtcattacagctgcagtcattggcagcctagtgtgcggcctgctcctggtcatcgccctgggctgcacctgcaagctctatgccattcgcacccaggagtacagcatctttgcccccctctcccggatggaggctgagattgtgcagcagcaggcacccccttcctacgggcagctcattgcccagggtgccatcccacctgtagaagactttcctacagagaatcctaatgataactcagtgctgggcaacctgcgttctctgctacagatcttacgccaggatatgactccaggaggtggcccaggtgcccgccgtcgtcagcggggccgcttgatgcgacgcctggtacgccgtctccgccgctggggcttgctccctcgaaccaacaccccggctcgggcctctgaggccagatcccaggtcacaccttctgctgctccccttgaggccctagatggtggcacaggtccagcccgtgagggcggggcagtgggtgggcaagatggggagcaggcacccccactgcccatcaaggctcccctcccatctgctagcacgtctccagcccccactactgtccctgaagccccagggccactgccctcactgcccctagagccatcactattgtctggagtggtgcaggccctgcgaggccgcctgttgcccagcctggggcccccaggaccaacccggagcccccctggaccccacacagcagtcctggccctggaagatgaggacgatgtgctactggtgccactggctgagccgggggtgtgggtagctgaggcagaggatgagccactgcttacctgaggggacctgggggctctactgaggcctctcccctgggggctctactcatagtggcacaaccttttagaggtgggtcagcctcccctccaccacttccttccctgtccctggatttcagggacttggtggccctcccgttgaccctatgtagctgctataaagttaagtgtccctcaggcagggagagggctcacagagtctcctctgtacgtggccatggccagacaccccagtcccttcaccaccacctgctccccacgccaccaccatttgggtggctgtttttaaaaagtaaagttcttagaggatcataggtctggacactccatccttgccaaacctctacccaaaagtggccttaagcaccggaatgccaattaactagagaccctccagcccccaaggggaggatttgggcagaacctgaggttttgccatccacaatccctcctacagggcctggctcacaaaaagagtgcaacaaatgcttctattccatagctacggcattgctcagtaagttgaggtcaaaaataaaggaatcatacatctcaaaaaaaaaaaaaaaaaa

SEQ ID NO: 165 - DNA, 2586 bp, Homo sapiens
  ref <308>: DATABASE ACCESSION NUMBER: AF131784
  ref <309>: DATABASE ENTRY DATE: 2001-06-18
gtacattaaaaataatttaatagccacaatatgatgttctttaagctgcaaattgagtacactgggaatcaacaaatttgatgaagcctgtctgtctcttcaccagtggagtgagtgcagcagttagaaagagaagcaatattgtgcaactggtgcagtggtgagttaatcatagtgtataaccttgtgttcatgaaacaggttgttcattgttctgcatctctcttcatttaaaaaggatacacaattctttcctcattgcatattacaccaaacgtttgagggaaaaatcctcattcgtaaaggattttggatttataatctaaaactcaacaataaagaaataatattccaagtctctggtttcctaatatacataataactgtttataaagaaggtctaagagctgatatttgccaaagtgatagaagagttgttttttcctctctactaccaagctttaagacattaaaagaagtctagtgtatttgaatattttagagaaagctttatcattttttaagatgccaagatgctgcctacgtttgcaaaagttgtctaagaattcaccatgagctatattttcttctggatctttgaccaaggtgatgtcagcttatttctggggaaggtgttgagctcttatacatgaaaatggatataggctattctctgggatgagtgtcatttcaatgctttataaatccatgaagctgcttgtctcataaagtagaactgatacaaattttggttggatatatagagaattttataaatgtattgccttagaatttctgggtggagacccaactacaatgacattgtcatgcaagaactataaagataattagagttaaaagttgtttaaattgtgcccttaaatacagcagaacctggagaaggtcatacttcaaaggtcgattttgagtccgaataaagaaagacctagtaacagatagtttttttttgttcattttcttctaccaagtagaggtttatgccctcagaactaaactagtaaaaatatctgaacaaaaaacctttcgttgttggcataaaaatgtgatacacttagagacattttgtttattgcatataaatctaatttttccataaattagatttatgatattttcataaagcacttgattagtttttcaaggcgtaccatcacaaagatgctttcctgcagagttctttgtatcaacagcctatggttgagatgttttctcatttcctgtagagagagaataccactaacaaacaagcaaaaactttagtgccaaaatagtggaactattttgtcatcttttgagaaaaaaatatacaaagaagtcatcttttcattaagtggattccctggttcctttccagctggttgtggaagtaatggctaacatccttcagctgactttgtctacaaggattattagcaaattctgtaggagcaagcatgtctgaccttaacttaatggatcccttattcaatcagtggcttctgtctttatgtctgttggcatatcaaaatggtttctgttcctagaaaagtaataacatatgcttatctttattctttttccaggtgattttgttttcaaatgctccttgtgaaaacacctagtgttgtagaaaggaaagtggccagaaagaacaacttgggaccatgagtaggtcattaaatagcttagtgatttatcctcatatagggcttataaaccctgtatgtgtttatatgtgcttcacagagttcgtgtcaggctgaaaggagatatgtataagaaagtggtttgtaaattatgttccatttcataaatagacactattcacaaactaaaatctaataaaaaaccacagttgtaatttaaactgcttgatataaaaagaggtatcatagcagggaaaacacactaattttcatacagtagaggtattgaaaactgaaaatgggaaggcaacttgaagtcattgtatttgattgaaaatgtttaatacatctcattattgacaaaatatgtcatcttgtatttatttcaaggaaaccaatgaattctaggtagtatattacaagttggtcaaaatattccatgtacaaatagggcttctgtgtccatagccttgtaagagatactgattgtatctgaaattattttttaaaaaaataaattatcctgctttagtgtgttaaaagtagacgatgttctaatataacactgaagtgcttcattgtatcccaacagtttaccttcaagtaatattatctttatttttaggctaagcacgtttgattattttgtctgtctcctatatagatctgttttgtctagtgctatgaatgtaacttaaaactataaacttgaagtttttattctatatgccccttaatagactgtggttcctgacgcacactgttaggtcattattttgttgtaccaaagttctagtggcttcagaaatcatagcatccaatgattttttggtgtctggctatgaatactatggttgagaattgtattcagtgattgtttctgcacacttttcaaataaaaaatgaatttttatcaattaaaaaaaaaaaaaaaaaaaaa

SEQ ID NO: 166 - DNA, 1804 bp, Homo sapiens
  ref <308>: DATABASE ACCESSION NUMBER: AF131828
  ref <309>: DATABASE ENTRY DATE: 2001-06-18
gtcagggggtgggtgggtgtgtgtctctgttggacctgtctctcctcagtctattcctgtcatagatgtgggtgtccctggtagggaagtgcctgtgtggtctgtttacagtgcagaaggcggctcagcagtgcaatgggctgacagccttggaccgggagtcagaagcctgggttctggttgtagctctggcccctccctgtgatcttcaacaagccacttgctttctctcgtcttcagtttcctcaactagaaaatgaacagcagctgaaattatgttgaagatccttttatacctgaaagagtttcttcatagaaatttctgtggtggggagggggcaatctctgtgtgtctcagtatacctaaaggttggggtggggcggagttgtgtgtctctgtagaaaggcgaaggggcagttcctatcaggactgtgtatgtctgagcacatgtggctctgtttgggattacgtgtttgtctgtgaatgtgtgtgtgtgttggagggttgtctattgtgtgtggctgtatagggtgtctgtagatcaagatgtgtatacagctgcttctgctattgctggtttgggggaggggactggaaagctgagactgaaaatcaagagggaagaggtgaggaaggcccacccctggggctgggcagtgtagacctgccaccgtgtgaagaaaaatgaaagcacagatagcctaagactgcacaggcctgtgcccacataccttatagcacaggcccaggtggatcatctcatgctaacaccccacatgtgctggtggatccactcccatggatccactcacatgctgcaggcatgcagtagactcacccacagcccactctctggacaccaatcctgggaggtgggagctggaatggggagcaatgagaggagggagtgagactgttggcttaggaagggtggtacctctccctgcatcatacccaggaacttccagctccaaaatattggggtacagctcaccaccccccactccgccaacccattcctacctcctctagtgcagggacccaagttagatgatgagaaaatgccaaacaaagggaggcaaggacagagaaggtacctgcaggacccacaaggcccatactggcccccatctgaacccacctctcccacccagatcaacatccccccaacccctgtgcccccatcatctggaccccagagccagccctcccactaccaccaccaccaccccggggctccttggctcacctttctagaacatgggtacctcctctttttgggggctcatttagactgctgcctttgctgctgacttgcagtgtgactcgggcccattgttcaatctctgtggccctgagacaccagggaaaatctccccccccacaggacatactagttccctggcaggcaagggcttccaactgaggcagtgcatgtgtggcagagagaggcaggaagctggcagtggcagcttctgtgtctagggaggggtgtggctccctccttccctgtctgggaggttggagggaagaatctaggccttagcttgccctcctgccacccttccccttgtagatactgccttaacactccctcctctctcagctgtggctgccacccagccaggtttctccgtgctcactaatttatttccaggaaggtgtgtggaagacatgagccgtgtataatattttttttaacattttcattgcagtattgaccatcatccttggttgtgtatcgtgtaacacaaataatgatattaaaagcatcaaacaagccaaaaaaaaaaaaaaaaaaaa

SEQ ID NO: 167 - DNA, 3960 bp, Homo sapiens
  ref <308>: DATABASE ACCESSION NUMBER: AF135168
  ref <309>: DATABASE ENTRY DATE: 2001-06-18
gcgggggcgggctttgccgagcgcagagctgcagccgccgagccggacgtgtgcgcgaagatggcgggccggagcatgcaagcggcaagatgtcctacagatgaattatctttaaccaattgttcagttgtgaatgaaaaggatttccagtctggccagcatgtgattgtgaggacctctcccaatcacaggtacacatttacactgaagacacatccatcggtggttccagggagcattgcattcagtttacctcagagaaaatgggctgggctttctattgggcaagaaatagaagtctccttatatacatttgacaaagccaaacagtgtattggcacaatgaccatcgagattgatttcctgcagaaaaaaagcaatgactccaacccttatgacaccgacaagatggcagcagaatttattcagcaattcaacaaccaggcctactcagtgggacaacagcttgtctttagcttcaatgaaaagctttttggcttactggtgaaggacattgaatccatggatcctagcatcctgaagggagagcctgcgacagggaaaaggcagaagattgaagtaggactggttgttggaaacagtcaagttgcatttgaaaaagcagaaaattcgtcacttaatcttattggcaaagctaaaaccaaggaaaatcgccaatcaattatcaatcctgactggaactttgaaaaaatgggaataggaggtctagacaaggaattttcagatattttccgacgagcatttgccttccgagtatttcctccagagattgtggagcagatgggttgtatacatgttaaaggcatcctgttatatggacccccaggttgtggtaagactctcttggctcgacagattggcaagatgttgaatgcaagagagcccaaagtggtcaatgggccagaaatccttaacaaatatgtgggagaatcagaggctaacattcgcaaactttttgctgatgctgaagaggagcaaaggaggcttggtgctaacagtggtttgcacatcatcatctttgatgaaattgatgccatctgcaagcagagagggagcatggctggtagcacgggagttcatgacactgttgtcaaccagttgctgtccaaaattgatggcgtggagcagctaaacaacatcctagtcattggaatgaccaatagaccagatctgatagatgaggctcttcttagacctggaagactggaagttaaaatggagataggcttgccagatgagaaaggccgactacagattcttcacatccacacagcaagaatgagagggcatcagttactctctgctgatgtagacattaaagaactggccgtggagaccaagaatttcagtggtgctgaattggagggtctggtgcgagcagcccagtccactgctatgaatagacacataaaggccagtactaaagtggaagtggacatggagaaagcagaaagcctgcaagtgacgagaggagacttccttgcttctttggagaatgatatcaaaccagcctttggcacaaaccaagaagattatgcaagttacattatgaacggtatcatcaaatggggtgacccagttactcgagttctagatgatggggagctgctggtgcagcagactaagaacagtgaccgcacaccattggtcagcgtgcttctggaaggccctcctcacagtgggaagactgctttagctgcaaaaattgcagaggaatccaacttcccgttcatcaagatctgttctcctgataaaatgattggcttttctgaaacagccaaatgtcaggccatgaagaagatctttgatgatgcgtacaaatcccagctcagttgtgtggttgtggatgacattgagagattgcttgattacgtccctattggccctcgattttcaaatcttgtattacaggctcttctcgttttactgaaaaaggcacctcctcagggccgcaagcttcttatcattgggaccactagccgcaaagatgtccttcaggagatggaaatgcttaacgctttcagcaccaccatccacgtgcccaacattgccacaggagagcagctgttggaagctttggagcttttgggcaacttaaaggataaggaacgcaccacaattgcacagcaagtcaaagggaagaaggtctggataggaatcaagaagttactaatgctgatcgagatgtccctacagatggatcctgaataccgtgtgagaaaattcttggccctcttaagagaagaaggagctagcccccttgattttgattgaaaatgaactatttgaaacacacagtgaccaagggaagtgaccaaggtgaagatggcctaggatcttcactgtcttactcaagatactggactaagtggaacgttctctaccttcaacatgtgctcgctctgcatgattagtgcaataaaactcccttccttatgcatactgagatagcttagtgtctcgtggaaggtgtcaatttggtttagaatgctgcgcttaccttcccatgcaggctaaagtgattccttcttgctcagtccctctgggtgggaaccatccagtacttgtggacactacacgtttcaacctctctactagcaccatcacccttgaaaactctcagtcagtgtcatgaatgttgcatgacaacagttggccgattagaaggcagactttctacatgcaaatctggcttagtaaatcgaggtgtgggccagagatcctctgacagctgtcctgagctaacactaaaagtcactgggtatttggttaaaggtctcccacaagactggtattctctttgcctgaagaaacaaggcattgaatctctaaaatgctgttctcaatcattgtcagagatgttttcaagttgcagtcagaagatctttcttaatagaaagtcagatgactaccgtgttggttgtgacttccccttaagtataactaatttgctctgtggtaagagatatgctcattattaccacttagaagatgttgttaaaaacatgtgaaagataggtatggaaaaagcatacacccccaaacagaaaggagttattaaagtaatttacaaacctctcagcactaattagtgtccaactccaagtgggtcaattccttagtataatattaaggcttactagtatcactgctttttccttagcttaatgacttacttagaatttatcctttattttaaatgatctgtactatctagtgtctaaaacactattctccagaaaaatcaatcattttctagccctctccctcagtcctttattgtccattccaatacattgaacacatttcctttaccctccacacacttcttccaaaaggaagcacccgttgagtccttttgagggtgatttgtcttacaactgactgacttagcaggaatttaattaggtcatatttggtgatgagacttatggagtgtgcctctctctcccaactgctgcttaaaatgcaaggacaagcaattagaagccatcctaaggtgcttacctcacacgccacccatgaggcttgtggccacagtggcacttgggtgtggctcctctgttatttgtcctcatgtgagaaagcagatcatctccaaatcttgccatttgtatacttttggtggagacttggatgtcatatcttctttgttttgggttttcttccctagcttattttgtggcttttaaagaagtggattgtattgtgagatcctgtgattcctggtggccagtatcctggattcctctaagatcttgcctctttcctcctcatgaaagcagcacacattgtgttaacttatgtctcttgttaaatgagcttaatgtctttgtgttttgtccaaaactgtattgaaaaaatattgtttaatgcaaatgaaggaatgcaataaagagtaaatatacttgaaaaaaaaaaaaaaaaaaaaaaaaaaaa

SEQ ID NO: 168 - DNA, 660 bp, Homo sapiens
  ref <308>: DATABASE ACCESSION NUMBER: AF141882
  ref <309>: DATABASE ENTRY DATE: 2001-06-18
gatatgatgagaatatggccatcacctgaaaagttttcttatcttctgtgcttttggtccctggaaacaaatccgcctatgtatgaagctagttgatttccagttgcactatttccagttgcctctgaagttcacaggcaatacattgtctagtcctttgcgaatttctctgatttgtgggcacagttatgaagtttccccacatgtgaagacaggtacaaaatagcagagccaagcagacagtgggtctattcttcattagctcagtgacttgtccacactcgtcttagcacttacgtttcaaaagcttgtcacaaacccttggagtcattcccagataatagaactggaaaagataaatcccctaatgccaagggtctagtgtgttcttagtggttatactgggaagtgtgtggagatttaggtgctgctcttgctgctctggatggcttgaaggctcctgggccatcttcatgtgctgcttgaagagctcctattttgtactcctggctagaatgctggtggaacaaatacaaaagtgaaaaaagttctctgtagatttctgaagtgcatattcattgatgccaaggaaaaaaaaaaaaaaaaaaaaaaatttggtcgtctttcgcagccgtaaatcaagccttattccgataccgc

SEQ ID NO: 169 - DNA, 1780 bp, Homo sapiens
  ref <308>: DATABASE ACCESSION NUMBER: AF148505
  ref <309>: DATABASE ENTRY DATE: 2001-06-18
gcagtagaggcgcggggtgcggagctagggaggccgagagccatggcggcgctattggcggcggcggcagtgcgagcccggatcctgcaggtttcttccaaggtgaaatccagtcccacctggtattcagcatcttccttctcttcttcagtgccaactgtaaagctcttcattggtgggaaattcgttgaatccaaaagtgacaaatggatcgatatccacaacccagccaccaatgaggtcattggtcgggtccctcaggccaccaaggcagaaatggatgcagccattgcttcctgcaaacgtgcttttcctgcatgggcagacacttcagtattaagccgccagcaggtcttgctccgctatcaacaacttattaaagaaaacttgaaagaaattgccaagttaatcacattggaacaagggaagaccctagctgatgctgaaggagatgtatttcgaggccttcaggtggttgagcatgcctgtagtgtgacatccctcatgatgggagagaccatgccatccatcaccaaagacatggacctttattcctaccgtctgcctctgggagtgtgtgcaggcattgctccattcaattttcctgccatgatccccctttggatgtttcccatggccatggtgtgtggaaataccttcctaatgaaaccatctgagcgagtccctggagcaactatgcttcttgctaagttgctccaggattctggtgcccctgatggaacattaaacatcatccatggacagcatgaagctgtaaattttatttgcgatcatccggacatcaaagcaatcagctttgtgggatccaacaaggcaggagagtatatcttcgagagaggatcaagacatggcaagagggttcaagccaatatgggagccaagaaccatggggtagtcatgccagatgccaataaggaaaataccctgaaccagctggttggggcagcatttggagctgctggtcagcgctgcatggctctttcaacagcagtccttgtgggagaagccaagaagtggctgccagagctggtggagcatgccaaaaacctgagagtcaatgcaggagatcagcctggagctgatcttggccctctgatcactccccaggccaaagagcgagtctgtaatctgattgatagtggaacaaaggagggagcttccatccttcttgatggacgaaaaattaaagtgaaaggctatgaaaatggcaactttgttggaccaaccatcatctcgaatgtcaagccaaatatgacctgttacaaagaggagatttttggtccagttcttgtggttctggagacagaaacattggatgaagccatccagattgtaaataacaacccatatggaaatggaactgccatcttcaccaccaatggagccactgctcggaaatatgcccacttggtggatgttggacaggtgggagtgaatgtccccattccagtgcctttgccaatgttctcattcaccggctctcgatcctccttcaggggagacaccaatttctatggcaaacagggcatccaattctacactcagttaaagaccattacttctcagtggaaagaagaagatgctactctttcctcacctgctgttgtcatgcctaccatgggccgttagaaacaagtttgtttaagactgactccatcctgagtaatctccctttatttttgaccagcttcatttgtcagctttgctcagatcagatcgatgggattggaatacattgtaactaaaatcttaaaaaaaa

SEQ ID NO: 170 - DNA, 2785 bp, Homo sapiens
  ref <308>: DATABASE ACCESSION NUMBER: AF149785
  ref <309>: DATABASE ENTRY DATE: 2001-06-18
aattcgcggccggctcgacctgaacctcagccgcgccgggaggcagcccgttggcgaggggcggggcggatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcggggcacgccgtactggaggttgcgcctcggtggccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcggggggaaccctcctcctgggcattgcatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgtgacggcacccagcgctgtggctgtcattctcccagggcagaaccctgatgcttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacgggactccagtacacagtctgataagactaacgtccctaaccctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctacgtgtgccagcaggatgtgggaggtaacggatgagcaggacgctgcagctctctccagccctgttggacatcctcagtgcctgcaggcctctcgctgcctgttgggctgtctggggggtggccatttagggatcgtggggacggggtccaccccaagaagaaagaaaggccgacgtccacaggcccggctctggccacgtgccccggaagcaggtgtgtccagagtcagctgagggctctccccacaccaccagcaggcgctggtgctccttctgcctcatgggaccagtccagcttccagcgctctggctcgagggtggtctgagcacttccttctgagtgggcttctctgggagctctccagtggcactgctggacctgcccacgtttctgtaaaatcaggatacgtggctttagtaagcagaccaagcgcttcgtggcagggaaagcagcgtgtggggaagtcactgaaaagtgctgcctaaggaagtttggaaatagtccccgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactctgcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagatttcctaagtattttatagcgaccatcaaaattggactttgtattgtttattcataaaagacacttggtaatagacttcagtgaactctgtatgaatgcagtagtgtgcgtcgaaaatccgcttcctgagcgtagggtgctgcagtggcgctagggcctggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtgtttaaaaaaaaaaaaaaaaaa

SEQ ID NO: 171 - DNA, 1414 bp, Homo sapiens
  ref <308>: DATABASE ACCESSION NUMBER: AF151810
  ref <309>: DATABASE ENTRY DATE: 2001-06-18
cgattgaggaacccatttcctcattctgcaaattgcaaacctgagggcccaaagagggacaggggcttgccaggtctcagcaggctgtgagcaagagctaaagcctaatcctcctgcctttgggctggagccttccttgtaccccagggtcagtgtctttgttggatacaggcttagattgactgactgtaccctgagaacctaggggagtccctgttcccaattcttctcctacccccaccttggcctgatggaggaagaccctgctgtgttgagatgagcaccagagccaagaagctgaggaggatctggagaattctggaggaagaggagagtgttgctggagctgtacagaccctgcttctcaggtcccaggaaggtggcgtcacatctgcagccgcgtcgacgttgtcggagcctccgcggaggacccaggagagccggactaggaccagggccctgggcctccccacactccccatggagaagctggcggcctctacagagccccaagggcctcggccggtcctgggccgtgagagtgtccaggtgcccgatgaccaagactttcgcagcttccggtcagagtgtgaggctgaggtgggctggaacctgacctatagcagggctggggtgtctgtctgggtgcaggctgtggagatggatcggacgctgcacaagatcaagtgccggatggagtgctgtgatgtgccagccgagacactctacgacgtcctacacgacattgagtaccgcaagaaatgggacagcaacgtcattgagacttttgacatcgcccgcttgacagtcaacgctgacgtgggctattactcctggaggtgtcccaagcccctgaagaaccgtgatgtcatcaccctccgctcctggctccccatgggcgctgattacatcattatgaactactcagtcaaacatcccaaatacccacctcggaaagacttggtccgagctgtgtccatccagacgggctacctcatccagagcacagggcccaagagctgcgtcatcacctacctggcccaggtggaccccaaaggctccttacccaagtgggtggtgaataaatcttctcagttcctggctcccaaggccatgaagaagatgtacaaggcgtgcctcaagtaccccgagtggaaacagaagcacctgcctcacttcaagccgtggctgcacccggagcagagcccgttgccgagcctggcgctgtcggagctgtcggtgcagcatgcggactcactggagaacatcgacgagagcgcggtggccgagagcagagaggagcggatgggcggcgcgggcggcgagggcagcgacgacgacacctcgctcacctgagcgacgcaccgcttcagggacggagacaggaccggcggagccctggggcggcggccgc

SEQ ID NO: 172 - DNA, 2394 bp, Homo sapiens
  ref <308>: DATABASE ACCESSION NUMBER: AF152502
  ref <309>: DATABASE ENTRY DATE: 2001-06-18
atgaagaccagggggttcagctttccaagacaaaggcaagtcctgtttctttttcttttctggggagtgtccttggcaggttctgggtttggacgttattcggtgactgaggaaacagagaaaggatcctttgtggtcaatctggcaaaggatctgggactagcagagggggagctggctgcaaggggaaccagggtggtttccgatgataacaaacaatacctgctcctggattcacataccgggaatttgctcacaaatgagaaactggaccgagagaagctgtgtggccctaaagagccctgtatgctgtatttccaaattttaatggatgatccctttcagatttaccgggctgagctgagagtcagggatataaatgatcactcgccagtgtttcggcacaaagagatggtcttaaaaatatcagaaaatacagctgaagggacagcatttagactagaaagagcacaggatccagatgaaggtcataacagtatccaaaactacacgatcagctccaactcttttttccatattaaaattagtggcagtgatgaaggcatgatatatccagagctagtgttggacaaagcactggatcgggaggagcaggaagagctcagcttaaccctcacagcgctggatggtgggtctccatccaggtctgggacctccactatacgcattgtggtcttggatgtcaatgacaatgccccacagtttgcccaggctctgtatgagacccaggctccagaaaacagtccagtagggtcccttattgttaaagtgtctgcaggagatgcagactcaggagtcaatgcagaagtatcctattcattttttgatgcttctgaagatattttaacaacgtttcaaatcaatcctttttctggggaaatctttctcagagaattgcttgattatgagttagtaaattcttacaaaataaatatacaggcaatggacggcggaggcctttctgcaagatgtacagttttgataaaagtattagattccaatgacaatcctcctgaactgatcatatcatcactttccaactctgttgctgaaaactctcctgggatagtattggctgtttttaagattaaagacagagactccggagaaaatggaaagacaatttgctatgttcaagataatctgcctttttttctgaaaccgtctgttgacaatttttacatcctaatgactgaaggtgcactggacagagagagcaaagctgagtacaacatcaccatcaccgtcactgacttggggacacccaggctgaaaaccgagcacagcataaccctgcaggtctccgacgtcaatgacaacgcccccgccttcacccaaacctcctacaccctgttcgtccgggagaacaacagccccgccctgcacatcggcagtgtcagcgccacagacagagactcaggcaccaacgcccaggtcacctactcgctgctgccgccccaggacccacacctgcccctcgcctccctggtctccatcaacgcggacaatggccacctgtttgccctcaggtcgctggactacgaggccctgcaggctttcgacttccgcgtgggcgcctcagaccgcggctccccggctttgagcagcgaggcgctggtgcgcgtactggtgctggacgccaacgacaactcgcccttcgtgctgtacccgctgcagaacggctccgcgccctgcaccgagctggtgccccgggcggccgagccgggctacctggtgaccaaggtggtggcggtggacggcgactcgggccagaacgcctggctgtcgtaccagctgctcaaggccacggagcccgggctgttcggtgtgtgggcgcacaatggggaggtgcgcaccgccaggctgctgagcgagcgcgacgcagccaagcacaggctggtggtgcttgtcaaggacaatggcgagcctcctcgctcggccaccgccacgctgcacgtgctcctggtggacggcttctcccagccctacctgcctctcccggaggcggccccggcccaggcccaggccgacttgctcaccgtctacctggtggtggcgttggcctcggtgtcttcgctcttcctcctctcggtgctcctgttcgtggcggtgcggctgtgcaggaggagcagggcggcctcggtgggtcgctgctcggtgcccgagggtccttttccagggcatctggtggacgtgagcggcaccgggaccctgttccagagctaccagtacgaggtgtgtctgactggaggttcagagaccggcgagttcaagttcttgaagccgattaccccccacctcccgccccataggggtgggaaagaaatagaggaaaattctactctccccaatagctttggatttaattattga

SEQ ID NO: 173 - DNA, 2436 bp, Homo sapiens
  ref <308>: DATABASE ACCESSION NUMBER: AF155117
  ref <309>: DATABASE ENTRY DATE: 2001-06-18
gcccaacatggctggagcgcggcggaggtgagccggccgcccgcccgcagacgccccagcctactgcgcccgagtcccgcggccccagtggcgcctcagctctgcggtgccgaggcccaacggctcgatcgctgcccgccgccagcatgttgggcgccccggacgagagctccgtgcgggtggctgtcagaataagaccacagcttgccaaagagaagattgaaggatgccatatttgtacatctgtcacaccaggagagcctcaggtcttcctagggaaagataaggcttttacttttgactatgtatttgacattgactcccagcaagagcagatctacattcaatgtatagaaaaactaattgaaggttgctttgaaggatacaatgctacagtttttgcttatggacaaactggagctggtaaaacatacacaatgggaacaggatttgatgttaacattgttgaggaagaactgggtattatttctcgagctgttaaacacctttttaagagtattgaagaaaaaaaacacatagcaattaaaaatgggcttcctgctccagattttaaagtgaatgcccaattcttagagctctataatgaagaggtccttgacttatttgataccactcgtgatattgatgcaaaaagtaaaaaatcaaatataagaattcatgaagattcaactggagggaatttatactgtgggcgtttaccaacacgtactgtgaatacagaatcagagatgatgcagtgtttgaagttgggtgctttatcccggacaactgccagtacccagatgaatgttcagagctctcgttcacatgccatttttaccattcatgtgtgtcaaaccagagtgtgtccccaaatagatgctgacaatgcaactgataataaaattatttctgaatcagcacagatgaatgaatttgaaaccctgactgcaaagttccattttgttgatctcgcaggatctgaaagactgaagcgtactggagctacaggcgagagggcaaaagaaggcatttctatcaactgtggacttttggcacttggcaatgtaataagtgccttgggagacaagagcaagagggccacacatgtcccctatagagattccaagctaacaagactactacaggattccctcgggggtaatagccaaacaatcatgatagcatgtgtcagcccttcagacagagactttatggaaacgttaaacaccctgaaatacgccaatcgagctagaaatatcaagaataaggtgatggtcaatcaggcagagctagtcagcaaatcaatgcacttcgtagtgaaatcacacgacttcagatggagctcatggagtacaaaaccaggtaaaagaataattgacgaagagggtgtggaaagcatcaatgacatgtttcatgagaatgctatgctacagactgaaaataataacctgcgtgtaagaattaaagccatgcaagagacggttgatgcattgaggtccagaattacacagcttgttagtgatcaggccaaccatgttcttgccagagcaggtgaaggaaatgaggagattagtaatatgattcatagttatataaaagaaatcgaagatctcagggcaaaattattagaaagtgaagcagtgaatgagaaccttcgaaaaaacttgacaagagccacagcaagagcgccatatttcagcggatcatcaactttttctcctaccatactatcctcagacaaagaaaccattgaaattatagacctagcaaaaaaagatttagagaagttgaaaagaaaagaaaagaggaagaaaaaaagtgtggctggtaaagaggataatacagacactgaccaagagaagaaagaagaaaagggtgtttcggaaagagaaacccaatgaattagaagtggaagaaagtcaagaagtgagtgatcatgaggatgaagaagaggaggaggaggaggaggaagatgacattgatgggggtgaaagttctgatgaatcagattctgaatcagatgaaaaagccaattatcaagcagacttggcaaacattacttgtgaaattgcaattaagcaaaagctgattgatgaactagaaaacagccagaaaagactgcagactctgaaaaagcagtatgaagagaagctaatgatgctgcaacataaaattcgggatactcagcttgaaagagaccaggtgcttcaaaacttaggctcggtagaatcttactcagaagaaaaagcaaaaaaagttaggtctgaatatgaaaagaaactccaagccatgaacaaagaactgcagagacttcaagcagctcaaaaagaacatgcaaggttgcttaaaaatcagtctcagtatgaaaagcattgaagaaattgcagcaggatgtgatggaaatgaaaaaaacaaaggttcgcctaatgaaaa

SEQ ID NO: 174 - DNA, 2222 bp, Homo sapiens
  ref <308>: DATABASE ACCESSION NUMBER: AF155120
  ref <309>: DATABASE ENTRY DATE: 2001-06-18
gctgggcggtcattgggcggcgtgatctcgccgcggttccgcggccctgccgccgccgccgccagcagagcgcaccgggccgatcgggcgagtggccatggcgggcgccgaggactggccgggccagcagctggagctggacgaggacgaggcgtcttgttgccgctggggcgcgcagcacgccggggcccgcgagctggctgcgctctactcgccaggcaagcgcctccaggagtggtgctctgtgatcctgtgcttcagcctcatcgcccacaacctggtccatctcctgctgctggcccgctgggaggacacacccctcgtcatactcggtgttgttgcaggggctctcattgctgacttcttgtctggcctggtacactggggtgctgacacatggggctctgtggagctgcccattgctttcatccgacccttccgggagcaccacattgacccgacagctatcacacggcacgacttcatcgagaccaacggggacaactgcctggtgacactgctgccgctgctaaacatggcctacaagttccgcacccacagccctgaagccctggagcagctatacccctgggagtgcttcgtcttctgcctgatcatcttcggcaccttcaccaaccagatccacaagtggtcgcacacgtactttgggctgccacgctgggtcaccctcctgcaggactggcatgtcatcctgccacgtaaacaccatcgcatccaccacgtctcaccccacgagacctacttctgcatcaccacaggctggctcaactaccctctggagaagataggcttctggcgacgcctggaggacctcatccagggcctgacgggcgagaagcctcgggcagatgacatgaaatgggcccagaagatcaaataacttctccgagcctgctacctggttgccaaccttccctagcccccaaaccgaagccatctgccaaattccagcctctttgagctggcccctccagatggagaggacatctcctgggctgggcccaggtaccccagcccacccctcatgacacagaatacttgagccactgatttttcatttcttttttttttttttcctcggcccctcctcagccacctgagttgctctatctgcaagcctgactctgccagcctcccctggtagagaggaggtttacccactccctgcacgcctgccgtccctgccccgctgggcagcccttcagtgtggctggcgttggggccagtgagttgcctctttccctccttgtctggccccagtggtctggggagcccccaggcacacctaagcgtcgtggagcattgttctgccacagccctgcatactgaccccgggaggctgggcaggtggacagccccagccaccaccttcagcctagcctgtcccccaaggatggtgaagctcagcaggggtctgagggtagccggccagaagaggctggaacctcctgctcaagtctagacccctacttctctgctgcccccaccctgccagagctgatgtttccaataccaagatgtcttcacagggcacagcccctgcagagcatcttggtcatttggaagaggacacggtatcccctctggccagagtatgtcagagaaggaagagtagggcttttttgttttgtttttttttaaaggtgcttgcttgtttaatgtaaataatagaaagccttaatatcttttctgtaacacggagtaatattttaatgtcatgttttggatgtacataatatatttataacaaagcagcaagagtctacttaaccttggctgcctcgtggtgtttcctggctgggtggggtggggggtatcaaggagcctgggacgtgaggccccactctcgccccattcccagctccccccaaccctggcctcaggatgagagctgtcacctgagacagtgaattaatgttgacatctgctccaaagccttttggaggggattgggtgaggacagtggtctttcctgttgatcatgatgataaagtaatgatggctgatccctatttgtgacttccttcagcaaatattcactggcacctggtgtgtgccaggctctgtcctgtacacaggtacagcggtgaaagaaccaacaaagacctatcctggtggagctgacctcctgggaaaagagtcaataaacaaataaatgcacatggaaattcaggtggtgatttgtgaagaaaatcaaacag

SEQ ID NO: 175 - DNA, 2024 bp, Homo sapiens
  ref <308>: DATABASE ACCESSION NUMBER: AF159092
  ref <309>: DATABASE ENTRY DATE: 2001-06-18
cgggacgcagcaaagagaggagagaccccaagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccccttaggactctgaagggtatggacctacgtgaatgtgtgtcagggggagacttgctggtgggttagtggtcctcaggatgtgataaaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctaaagtgggactggggagggagctaagcttgggctgggctgcttggggcttggcatagggtggaaagggctaccctggggcttctgacccccctgtagtatgtgtggagggtgccctcccgtctcccacaacttctgctataacaataaactgtagaggaatcggaaaaaaaaaaaaaaaaaaaaaaaaaaaaaa

SEQ ID NO: 176 - DNA, 782 bp, Homo sapiens
  ref <308>: DATABASE ACCESSION NUMBER: AF161407
  ref <309>: DATABASE ENTRY DATE: 2001-06-18
aggcgtgcgaggagggggcatggcggatactgtgttgtttgagtttcttcacacagagatggtggctgagctgtgggctcacgaccccgaccccggcccggggggacagaagatgagcctgtcggtcctggagggtatggggttccgtgtgggccaggctctaggcgagaggctgccccgggagacgctggccttcagggaggagctggatgtcctcaagttcttgtgcaaagacctgtgggtggcggtgttccagaagcagatggacagcctgcgcaccaatcaccaggggacctacgtcctgcaagacaacaagctttcccctcctcctcccgatggcctctggcctgcagtatctggaggaagcacccaagttcctggccttcactgcggcctcctgcgcggcgccctctataccctgggcattgagagcgtggtcaccgcctccgtggcagccctgcccgtctgtaagttccaggtggtgattccgaaatcctaagcctgcctcgcacctgctgagccgcactgctgcccctggcctcaccggcctcaggagacggtggggccgctgcatttcggggtggtcttgggaatcccaggccctaggggtcacatttgctcaggaagtgggtatcaaattgaggtgggggtgtcagaggaggcaaaggggtcccagctgcggtcaggactgtggtgggattcccgcctcggcagcgtcactgcccagtagctgctcaataaaggctgtgtgtgtggaaaaaaaaaaaaaaaaaaaaaaaaaa

SEQ ID NO: 177 - DNA, 2801 bp, Homo sapiens
  ref <308>: DATABASE ACCESSION NUMBER: AF161553
  ref <309>: DATABASE ENTRY DATE: 2001-06-18
gcagtgtctcccggtcgcgcgtggaggtcggtcgctcagagctgctgggcgcagtttctccgcctgctgcttcggcgcggctgtatcggcgagcgagcgagttcccgcgagttctcggtggcgctcccccttcctttcagtctccacggactggcccctcgtccttctacttgaccgctcccgtcttccgccgccttctggcgctttccgttgggccgattcccgcccgcttcctcctgcttcccatcgaagctctagaaatgaatgtttccatctcttcagagatgaaccagattatgatgcatcattatcacagaagaaattcgtgtctatagcttttaaggacttgattacatcattttcaagcctgatagttttggaatcaccattagagcttaagacacacctgccttcatttcaaccacctgtcttcataccctgacgaagtgcaccttttaacactcctttgtccttggattacttaagagttcccagaaatacatttgccaccaacagagtagccaaatttataaggaaaaatgattcccaatggatatttgatgtttgaggatgaaaattttattgagtcttctgttgccaaattaaatgccctgaggaaaagtggccagttctgtgatgttcgacttcaggtctgtggccatgaaatgttagcacacagagcagtgctagcttgctgcagtccctatttatttgaaatctttaatagtgatagtgatcctcatggaatttctcacgttaaatttgatgatctcaatccagaagctgttgaagtcttgttgaattatgcctacactgctcagttgaaagcagataagaattgtaaagatgtttattctgcagcaaaaaagctgaagatggatcgagtaaagcaggtttgtggtgattatttactgtctagaatggatgttaccagctgcatctcttaccgaaattttgcaagttgtatgggagactcccgtttgttgaataaggttgatgcttatattcaggagcatttgttacaaatttctgaagaggaggagtttcttaagcttccaaggctaaagttggaggtaatgcttgaagataatgtttgcttgcccagcaatggcaaattatatacaaaggtaatcaactgggtgcagcgtagcatctgggagaatggagacagtctggaagagctgatggaagaggttcaaaccttgtactactcagctgatcacaagctgcttgatgggaacctactagatggacaggctgaggtgtttggcagtgatgatgaccacattcagtttgtgcagaaaaagccaccacgtgagaatggccataagcagataagtagcagttcaactggatgtctctcttctccaaatgctacagtacaaagccctaagcatgagtggaaaatcgttgcttcagaaaagacttcaaataacacttacttgtgcctggctgtgctggatggtatattctgtgtcatttttcttcatgggagaaacagcccacagagctcaccaacaagtactccaaaactaagtaagagtttaagctttgagatgcaacaagatgagctaatcgaaaagcccatgtctcctatgcagtacgcacgatctggtctgggaacagcagagatgaatggcaaactcatagctgcaggtggctataacagagaggaatgtcttcgaacagtcgaatgctataatccacatacagatcactggtcctttcttgctcccatgagaacaccaagagcccgatttcaaatggctgtactcatgggccagctctatgtggtaggtggatcaaatggccactcagatgacctgagttgtggagagatgtatgattcaaacatagatgactggattcctgttccagaattgagaactaaccgttgtaatgcaggagtgtgtgctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatggaaaactgtttgtatgtggtggctttgatggttctcatgccatcagttgtgtggaaatgtatgatccaactagaaatgaatggaagatgatgggaaatatgacttcaccaaggagcaatgctgggattgcaactgtagggaacaccatttatgcagtgggaggattcgatggcaatgaatttctgaatacggtggaagtctataaccttgagtcaaatgaatggagcccctatacaaagattttccagttttaacaaatttaagaccctctcaaactaacaggcttagtgatgtaattatggttagtagaggtacacttgtgaataaagagggtgggtgggtatagatgttgctaacagcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggcacatcatttcaagaagtccctctcctccacatttgttttgccaatttgcacattaatgactcttcccctcgt

SEQ ID NO: 178 - DNA, 2579 bp, Homo sapiens
  ref <308>: DATABASE ACCESSION NUMBER: AF164104
  ref <309>: DATABASE ENTRY DATE: 2001-06-18
aagctggccgaccagtacccgcacctgcacaacgccgagctcagcaagacgctgggcaagctgtggcgcttgctgagcgagagcgagaagcggcccttcgtggaggaggcagagcgccttcgcgtgcagcacaagaaggaccaccccgactacaagtaccagccacggcgcaggaagagcgccaaagccggccacagcgactccgactcgggcgcggagctgggaccccaccctggcggcggtgccgtgtacaaggctgaagcagggcttggagatgggcaccaccatggcgaccacacagggcagacccacgggccgcccaccccgcccaccacccccaagacggagctgcagcaggcgggcgccaagccggagctgaagctggagggacgccggccggtggacagcgggcgccagaacatcgacttcagcaacgtggacatctcggagctcagcagcgaggtcatgggcaccatggacgccttcgacgtccacgagttcgaccagtacctgcccctgggcggccccgccccacccgagccgggccaggcctatgggggcgcctacttccacgccggggcgtcccccgtgtgggcccacaagagtgccccgtcggcctccgcgtcgcccaccgagacgggtcccccacggccgcacatcaagacggagcagccgagccccggccactacggcgaccagccccgaggctcgcccgactacggttcctgcagcggccagtccagcgccaccccggccgcccccgccggccccttcgccggctcacagggcgactatggcgacctgcaggcctccagctactatggtgcctaccctggctacgcacccggcctctaccagtacccctgcttccactcgccgcgccggccctacgcctcacccctgctcaacggcctggccctgccgcccgcccacagccccaccagtcactgggaccagccggtgtacaccaccctgaccaggccctgagggcccagccgcggggagggactcgcaggcgtcagggggcagccttgtcccggcccagtgtgtgtgaccagggcgggaggggccccagtggctgagctccaagtgcctgctgaagtctgcagggaaacacgcttgctgcccgtggccctcggcctccagatggccacacctctgccgacgacggaccagctccctctcccttctatctttctttttgaggtggtgggattattccacaaagaagggctgccgtttggtccctcttccgtgaggactggcggcaccagcaccttcgctttgcatctcggtagaggagaaacggcagcacagcccaaggaccaaaggagggggtggcaggggccttgcagggcgctgtgaggtccaggccggtcttggcgccgagagcccctgcactcaaggccacattccctcgacaacggctgcacgggctgtccgggatccggggtgtctgtccgcagactgggatgagtctactcgagcatctccgggacctgcctgtcagatctgaggtgtctccttgctggcagagtgcgctcacgcgagggctggctgtgatgaacacatctctcttttatttttatgtttttgataatttttatttttgaagcttaaatgtgtttcttctgaaagctgttaaagatgtatttatgttctgtgttattttatctttaattaatgaggtaattcgggcaaagagtagaatttaagacaaaacggaagctgggaagcttcccttgagggcaggcaggaggtggagttgcagctgttggccggcatcacgttgctcgttgctcggcttatgggaggccgccctggagggcccggaggtcccaaggtccctgggaggactgggcccctcatgcctcgagcttggcaaccgaaaacccgagggaggagaagggacctgccttgtgacatctctgatcaggttggggtgccccagcacccagtaccagtttggggtttgggaagcaggactccgtccctgtccccgactgtgccacgtggtaggacacataggacacaggaattcctgggtccttgcccatgactgtgccatgtggtaggacacaggacacaggaattcctggaaagtggtggcttcagaagtgatcttggctcgcaggcaccagtgccacctaccaagctgtgaaactaaaccttctccactaaacgtcgttagggcctcagttctagacgagtcatacctgattcacctgcactgcttcccctgtgtgctgagcatagagcatacaatagcgcctacttcacggaaacttgtgcctttaaactttgtaaacttaaacacagccgagaagttgcttctttgtactttttctacttttcctacttttttgtagaaaaaaaagataatgcctctgcttctatttctctgggggtgggggtgggggccgggagccgtcgcagacccgtttcatgcagcgtctccctyggcaccgcgttcggaggacgcaccctcactcccctgctgccttcactcctttctgaccaagcaacgctaacttttgtacagatcgatttgataaaattaaacaaagtgctttttatgg

SEQ ID NO: 179 - DNA, 5601 bp, Homo sapiens
  ref <308>: DATABASE ACCESSION NUMBER: AF167706
  ref <309>: DATABASE ENTRY DATE: 2001-06-18
ggcccggctgcgaggaggaggcggcggcggcgcaggaggatgtacttggtggcgggggacagggggttggccggctgcgggcacctcctggtctcgctgctggggctgctgctgctgctggcgcgctccggcacccgggcgctggtctgcctgccctgtgacgagtccaagtgcgaggagcccaggaactgcccggggagcatcgtgcagggcgtctgcggctgctgctacacgtgcgccagccagaggaacgagagctgcggcggcaccttcgggatttacggaacctgcgaccgggggctgcgttgtgtcatccgccccccgctcaatggcgactccctcaccgagtacgaagcgggcgtttgcgaagatgagaactggactgatgaccaactgcttggttttaaaccatgcaatgaaaaccttattgctggctgcaatataatcaatgggaaatgtgaatgtaacaccattcgaacctgcagcaatccctttgagtttccaagtcaggatatgtgcctttcagctttaaagagaattgaagaagagaagccagattgctccaaggcccgctgtgaagtccagttctctccacgttgtcctgaagattctgttctgatcgagggttatgctcctcctggggagtgctgtcccttacccagccgctgcgtgtgcaaccccgcaggctgtctgcgcaaagtctgccagccgggaaacctgaacatactagtgtcaaaagcctcagggaagccgggagagtgctgtgacctctatgagtgcaaaccagttttcggcgtggactgcaggactgtggaatgccctcctgttcagcagaccgcgtgtcccccggacagctatgaaactcaagtcagactaactgcagatggttgctgtactttgccaacaagatgcgagtgtctctctggcttatgtggtttccccgtgtgtgaggtgggatccactccccgcatagtctctcgtggcgatgggacacctggaaagtgctgtgatgtctttgaatgtgttaatgatacaaagccagcctgcgtatttaacaatgtggaatattatgatggagacatgtttcgaatggacaactgtcggttctgtcgatgccaagggggcgttgccatctgcttcactgcccagtgtggtgagataaactgcgagaggtactacgtgcccgaaggagagtgctgcccagtgtgtgaagatccagtgtatccttttaataatcccgctggctgctatgccaatggcctgatccttgcccacggagaccggtggcgggaagacgactgcacattctgccagtgcgtcaacggtgaacgccactgcgttgcgaccgtctgcggacagacctgcacaaaccctgtgaaagtgcctggggagtgttgccctgtgtgcgaagaaccaaccatcatcacagttgatccacctgcatgtggggagttatcaaactgcactctgacagggaaggactgcattaatggtttcaaacgcgatcacaatggttgtcggacctgtcagtgcataaacaccgaggaactatgttcagaacgtaaacaaggctgcaccttgaactgtcccttcggtttccttactgatgcccaaaactgtgagatctgtgagtgccgcccaaggcccaagaagtgcagacccataatctgtgacaagtattgtccacttggattgctgaagaataagcacggctgtgacatctgtcgctgtaagaaatgtccagagctctcatgcagtaagatctgccccttgggtttccagcaggacagtcacggctgtcttatctgcaagtgcagagaggcctctgcttcagctgggccacccatcctgtcgggcacttgtctcaccgtggatggtcatcatcataaaaatgaggagagctggcacgatgggtgccgggaatgctactgtctcaatggacgggaaatgtgtgccctgatcacctgcccggtgcctgcctgtggcaaccccaccattcaccctggacagtgctgcccatcatgtgcagatgactttgtggtgcagaagccagagctcagtactccctccatttgccacgcccctggaggagaatactttgtggaaggagaaacgtggaacattgactcctgtactcagtgcacctgccacagcggacgggtgctgtgtgagacagaggtgtgcccaccgctgctctgccagaacccctcacgcacccaggattcctgctgcccacagtgtacagatcaaccttttcggccttccttgtcccgcaataacagcgtacctaattactgcaaaaatgatgaaggggatatattcctggcagctgagtcctggaagcctgacgtttgtaccagctgcatctgcattgatagcgtaattagctgtttctctgagtcctgcccttctgtatcctgtgaaagacctgtcttgagaaaaggccagtgttgtccctactgcatagaagacacaattccaaagaaggtggtgtgccacttcagtgggaaggcctatgccgacgaggagcggtgggaccttgacagctgcacccactgctactgcctgcagggccagaccctctgctcgaccgtcagctgcccccctctgccctgtgttgagcccatcaacgtggaaggaagttgctgcccaatgtgtccagaaatgtatgtcccagaaccaaccaatatacccattgagaagacaaaccatcgaggagaggttgacctggaggttcccctgtggcccacgcctagtgaaaatgatatcgtccatctccctagagatatgggtcacctccaggtagattacagagataacaggctgcacccaagtgaagattcttcactggactccattgcctcagttgtggttcccataattatatgcctctctattataatagcattcctattcatcaatcagaagaaacagtggataccactgctttgctggtatcgaacaccaactaagccttcttccttaaataatcagctagtatctgtggactgcaagaaaggaaccagagtccaggtggacagttcccagagaatgctaagaattgcagaaccagatgcaagattcagtggcttctacagcatgcaaaaacagaaccatctacaggcagacaatttctaccaaacagtgtgaagaaaggcaactaggatgaggtttcaaaagacggaagacgactaaatctgctctaaaaagtaaactagaatttgtgcacttgcttagtggattgtattggattgtgacttgatgtacagcgctaagaccttactgggatgggctctgtctacagcaatgtgcagaacaagcattcccacttttcctcaagataactgaccaagtgttttcttagaaccaaagtttttaaagttgctaagatatatttgcctgtaagatagctgtagagatatttggggtggggacagtgagtttggatggggaaatgggtgggagggtggtgttgggaagaaaaattggtcagcttggctcggggagaaacctggtaacataaaagcagttcagtggcccagaggttatttttttcctattgctctgaagactgcactggttgctgcaaagctcaggcctgaatgagcaggaaacaaaaaaggccttgcgacccagctgccataaccaccttagaactaccagacgagcacatcagaaccctttgacagccatcccaggtctaaagccacaagtttcttttctatacagtcacaactgcagtaggcagtgaggaagccagagaaatgcgatagcggcatttctctaaagcgggttattaaggatatatacagttacactttttgctgcttttattttcttccaagccaatcaatcagccagttcctagcagagtcagcacatgaacaagatctaagtcatttcttgatgtgagcactggagcttttttttttttacaacgtgacaggaagaggagggagagggtgacgaacaccaggcatttccaggggctatatttcactgtttgttgttgctttgttctgttatattgttggttgttcatagtttttgttgaagctctagcttaagaagaaactttttttaaaaagactgtttggggattctttttccttattatatactgattctacaaaatagaaactacttcattttaattgtatattattcaagcacctttgttgaagctcaaaaaaaatgatgcctctttaaactttagcaattataggagtatttatgtaactatcttatgcttcaaaaaacaaaagtatttgtgtgcatgtgtatataatatatatatatacatatatatttatacacatacaatttatgttttcctgttgaatgtatttttatgagattttaaccagaacaaaggcagataaacaggcattccatagcagtgcttttgatcacttacaaattttttgaataacacaaaatctcattctacctgcagtttaattggaaagatgtgtgtgtgagagtatgtatgtgtgtgtgtgtgtgtgtgtgtgtgcgcgcgcacgcacgccttgagcagtcagcattgcacctgctatggagaagggtattcctttattaaaatcttcctcatttggatttgctttcagttggttttcaatttgctcactggccagagacattgatggcagttcttatctgcatcactaatcagctcctggattttttttttttttttttcaaacaatggtttgaaacaactactggaatattgtccacaataagctggaagtttgttgtagtatgcctcaaatataactgactgtatactatagtggtaacttttcaaacagcccttagcacttttatactaattaacccatttgtgcattgagttttcttttaaaaatgcttgttgtgaaagacacagatacccagtatgcttaacgtgaaaagaaaatgtgttctgttttgtaaaggaactttcaagtattgttgtaaatacttggacagaggttgctgaactttaaaaaaaattaatttattattataatgacctaatttattaatctgaagattaaccatttttttgtcttagaatatcaaaaagaaaaagaaaaaggtgttctagctgtttgcatcaaaggaaaaaaagatttattatcaaggggcaatatttttatcttttccaaaataaatttgttaatgatacattacaaaaatagattgacatcagcctgattagtataaattttgttggtaattaatccattcctggcataaaaagtctttatcaaaaaaaattgtagatgcttgctttttgttttttcaatcatggccatattatgaaaatactaacaggatataggacaaggtgtaaatttttttattattattttaaagatatgatttatcctgagtgctgtatctattactcttttactttggttcctgttgtgctcttgtaaaagaaaaatataatttcctgaagaataaaatagatatatggcacttggagtgcatcatagttctacagtttgtttttgttttcttcaaaaaagctgtaagagaattatctgcaacttgattcttggcaggaaataaacattttgagttgaaatcaaaaaaaaaaaaaaaaaa

SEQ ID NO: 180 - DNA, 1547 bp, Homo sapiens
  ref <308>: DATABASE ACCESSION NUMBER: AF175387
  ref <309>: DATABASE ENTRY DATE: 2001-06-18
ggtggcttcctcacctccacctgtaatgcaggagggagaattggctatttctcctataagccctgtggcagccatgcctcccctaggcacccacgtgcaagccacatgtgaagctcaaattaacctgctgggtgaaggggggatctgcaagctgccaggaagactccgcatccagcccgcactgtggagcagggaggacgtgctgcactggctgcgctgggcagagcaggagtactctctgccatgcaccgcggagcacgggttcgagatgaacggacgcgccctctgcatcctcaccaaggacgacttccggcaccgtgcgcccagctcaggtgacgtcctgtatgagctgctccagtacatcaagacccagcggcgagccctggtgtgtgggcccttttttggagggatcttcaggctgaagacgcccacccagcactctccagtccccccggaagaggtgactggcccctctcagatggacacccgaaggggccacctgctgcagccaccagacccagggcttaccagcaacttcggccacctggatgaccctggcctggcaaggtggacccctggcaaggaggagtccctcaacttatgtcactgtgcagagctcggctgcaggacccagggggtctgttccttccccgcgatgccgcaggcccccattgacggcaggatcgctgactgccgcctgctgtgggattacgtgtatcagctgctccttgatacccgatatgagccctacatcaagtgggaagacaaggacgccaagatcttccgaggtgtggatccaaatgggctcgccagactctggggaaatcacaagaaccgggtggacatgacctacgagaagatgtctcgtgccctgcgccactattataagcttaatatcattaagaaggaaccggggcagaaactcctgttcagatttctaaagactccgggaaagacggtccaggacaagcacagccacctggagccgctggagagccaggagcaggacagaatagagttcaaggacaagaggccagaaatctctccgtgaggggcaggtggactccaggcacccggtaccgatggggcagggaccgagtctcccatgaaggcagactcctcctcccagcagagcagcaggatccccagccagactctgtacccacaggattacagccattgcttgggaagcctgggaggcctcccatccaggacactgggggcaggagtgtcatcttttggggcagggcaatcctggggctaaatgaggtacaggggaatggactctttggggggtacttgcaacccccttgggaggagggaaagccaaggcaacgatagagcacccagccccacccctgtaaatggaatttaccagatgagggaatgaagtccctcactgagcctcagattctcctcacctgtgcaaatgggctgaggcaggaaatgggaaaaagtgttagtgcttccaggcggcactgacagcctcagtaacaataaaaacaatggtagctgaaaaaaaaaaaaaaaaaaaaaaaaaaaaaaaa

SEQ ID NO: 181 - DNA, 1203 bp, Homo sapiens
  ref <308>: DATABASE ACCESSION NUMBER: AF176012
  ref <309>: DATABASE ENTRY DATE: 2001-06-18
catctggtgtattgactgtggccagtcttaaagctagtttttgctatgtggaacatgctgctctaattcagatttaaagagtttcttcctgttaattcgaagctcactgtgcctcttgtttccgagggaagaaggactgattaagtcatctaaatggatgcaatactgaattacaggtcagaagatactgaagattactacacattactgggatgtgatgaactatcttcggttgaacaaatcctggcagaatttaaagtcagagctctggaatgtcacccagacaagcatcctgaaaaccccaaagctgtggagacttttcagaaactgcagaaggcaaaggagattctgaccaatgaagagagtcgagcccgctatgaccactggcgaaggagccagatgtcgatgccattccagcagtgggaagctttgaatgactcagtgaagacgtcaatgcactgggttgtcagaggtaaaaaagacctgatgctggaagaatctgacaagactcataccaccaagatggaaaatgaggaatgtaatgagcaaagagaaagaaagaaagaggagctggcttcaaccgcagagaaaacggagcagaaagaacccaagcccctagagaagtcagtctccccgcaaaattcagattcttcaggttttgcagatgtgaatggttggcaccttcgtttccgctggtccaaggatgctccctcagaactcctgaggaagttcagaaactatgaaatatgaaatatctctgcttcaaaaaatgaggaagagcaagactgtcccctatgctgccaacatgcagtctttgtttatgtcttaaaaatgtcatgtttatgtcatgtctgtgaattgctgagtactaattgattcctccatccttgaatcagttctcataatgctttttaaataagaaaaattcagaagatgaatttcttccaatatttgaataaattaaagctcttagatacagagtagattgtattatatgctttttcctattaatactacttatagaaatccattaaaaagcaatctctgtacagtgtatttaaatatttcattgacatactgtgatctctattagtgatggatgtacaaaaaatgttttcttacccttgacttacaatgaaatgtgaaattacttgtctgaaccccgtggggagaaataaataattttcccaaagttcaaaaaaa

SEQ ID NO: 182 - DNA, 5111 bp, Homo sapiens
  ref <308>: DATABASE ACCESSION NUMBER: AF186780
  ref <309>: DATABASE ENTRY DATE: 2001-06-18
ctgcggtccagtctagggggtctcagattggcggggatgggcagcagcggcaggtggccttggcttttgctgcagccgtcaacgacctatcatcggggtcctgcgtaaggtccggctggctgggacttggctgtgggtgggatggactggctgccggaccgagtgccctgcagttggtaggagtatgaggcagagtgatgcacacccgggcgcccagcatcgttctaattgccggagacattgcctcagactgtgcgctgctagaggctgcgttcctgagcaggaagcccgtttcctgggattggaactacccttcttggccagcgggaagtccccaaggacggagtcgaaaggtcaaatcttatctgtcagtgctgtgtgacagcatcgcaacgggatctgcagaacctgaactcgatccgtaatgcctcctgcctgcctctttcaagatggaggtgaaacctgtgggagaacctactcaagaggtgtctaaattcaaactttccaccaaggtagaaagcacgggacactggctggtggaagatcatgttcgaatatgggaagttttaaagacagaggagagctcgattcaggactggggtgaagaggtagaggaaggagctgtttaccatgtcaccctcaaaagagtccagattcaacaggctgccaataaaggagcaagatggctaggggttgaaggggaccagctgcctccaggacacacagtcagtcaatatgaaacctgtaagatcaggaccataaaagctggcaccttggagaagcttgtggagaacctgctgacagcttttggggacaatgactttacctatatcagcatctttctttcaacgtacagaggctttgcctccactaaagaagtgctggaactactgctggacaggtatggaaacctgacaagcccaaactgtgaagaagatggaagccaaagttcatcagagtccaaaatggtgatcaggaatgcaatcgcttccatactaagggcctggcttgaccagtgtgcagaagacttccgagagccccctcacttcccttgcttacagaaactgctggattatctcacacggatgatgccgggctctgacccagaaagaagagcacaaaatcttcttgagcagtttcagaagcaagaagtggaaactgacaatgggcttcccaacacgatctccttcagcctggaagaggaagaggaactggagggtggagagtcagcagaattcacgtgcttctcagaagatctcgtggcagagcagctgacctacatggatgcacaactcttcaagaaagtagtgcctcaccactgcctgggctgcatttggtctcgaagggataagaaggaaaacaaacatttggctcctacgatccgtgccaccatctctcagtttaataccctcaccaaatgtgttgtcagcaccatcctggggggcaaagaactcaaaactcagcagagagccaaaatcattgagaagtggatcaacatcgctcatgaatgtagactcctgaagaatttttcctccttgagggccatcgtttcggcactgcagtctaattccatctatcggttaaaaaagacttgggctgccgtcccaagggaccgaatgctgatgtttgaagaactttcagatatcttctcagaccataataaccatttgaccagccgagaactactgatgaaggaaggaacctcaaaatttgcaaacctggacagcagtgtgaaagaaaaccagaagcgtacccagaggcggctgcagctccagaaggacatgggtgtgatgcagggaactgtgccctacctgggcaccttcctgactgacctgaccatgcttgacactgcccttcaggactacatcgagggtggactgataaactttgagaaaaggagaagggaatttgaagtgattgcccagataaagctcttacagtctgcctgcaacagctattgcatgaccccagaccaaaagttcatccagtggttccagaggcagcagctcctgacagaggaggagagctatgccctgtcatgtgagattgaagcagctgctgacgccagcaccacctcgcccaagcctcggaagagcatggtgaagagactcagcctactgtttctagggtctgacatgatcaccagtcccactcccaccaaagagcagcccaagtccactgccagcgggagctctggtgaaagcatggactctgtcagcgtgtcatcctgcgagtcgaaccactcagaggctgaggagggctccattactcccatggacacccctgatgagcctcaaaaaaagctctctgagtcctcctcatcctgttcttctatccattccatggacacaaattcctcagggatgtcttccttaatcaaccccctctcctcccctccgtcctgcaacaacaaccccaaaatccacaagcgctctgtctcggtgacgtccattacctcgactgtgctgcctcctgtttacaaccaacagaatgaagacacctgcataatccgcatcagtgtggaagacaataacggcaacatgtacaagagcatcatgttgacgagccaggataaaacccccgctgtgatccagagagccatgctgaagcacaatctggactcagaccccgccgaggagtacgagctggtgcaggtcatctcggaggacaaagaacttgtgattccagactcagcaaatgtcttttatgccatgaacagccaagtgaactttgacttcattttgcgcaaaaagaactccatggaagaacaagtgaaactgcgtagccggaccagcttgacgttgcccaggacagctaaacggggctgctggagttacagacacagcaaaatcaccctctgaagggagggmccagtggccccttgtttgccaaaggcagagtggggctgagaaacaggctgcggtgattgcaattaccatccggtgttcgaggatcattggtgaagtcagcagatatttattgagttcctgtggtgtgcaaagcattatgataggcaccgtggggaaactggaaatgaatttgacatgaaaaggatgaacgattcactgattctctttgactcatttgagactaaaatgcagaattaccaacatttaaaacatatatatgcacatgtatttggtatgcatgtgtatctatataaaaatatataagagggactttatgggatagtatggactatggaaaaacaaatttgcacaatggcctgggaagttgaggtcactttttacagggaaatagaagaaactgagaacctagtctcgtatattctgagtaaatggaatcagtcctgggaatagagagtgtcctttgtgccagtattacaagaagcccaaactttatttttataaagggagaggatgactttctcaatcaagtgccaccagataaaaacaactgcagaggctggaactgccacaggctgtatgaaaggccactttggaaagggtttggatgagctggtggccttcaacctctgcctgcatctgccactttctgctaccctagggaggccaggaggagcttcggaggaccatcgccccactggtctagccatcatgacacctctggaggtgtcaagctcctgaaacaagctcatttcagtttctggcaaccccgtgtatttccgttttccccctaaagaacatatcataatcattgcacaaataaccatgttctttggtaatgaagccagaaaagaaagcgcaaaagaatggtgactcatttggactcttatctgtcttggaatgtcactgcttcattgccttctctgattgccttttgcatgtaaaactatgtgtctggagtcttttgccatctggatcttagtacctctttattatgtgcaatttattcctcaggtgtggaaatttctactgcaattgactgacgtktgattattttgagcttgtgaaagatttctgaacagtgattgtcccgttaatagcccctcagaagatgttccctgctgataacagcatcctattttacttacttttatagcattactgtgcctagtcgtggggaaagagatggggctgtatagattatctgaatcatttgtctaagaggtacattcttccagatggaatcaataacttttttttttccaggttcccgtgcttgctatcacagtatcattgttaagtgacacttttgtctctcataacaccatcacactcttccttccaagtctgagctgtgctggggtttgaactaaaagccatatgtggaatattgacatgtgtaagaagcactttcagaatgttgtcctttttaagaaatgattctcaaaataccagtttttattccaaaaatttagagaacaaacccggaatatgaagtgcagattgtaacatggagctatttttttttcctaatcccataatacagctcctaaaagttgtgtgggatttgcgttgcataaatagccatgtgaattccacaagaagcaccagggaaagtttagagatttgcggcaatggaccgaagaacgggccaggaagtcctccaatttcctttggtctttccaggagattggactacacattgtaaagactgactgggtttcaactagtcaaaaagcactttcttctgttttcaatccctgttcgatttgtgcttctgtgcttgtaggagagatggccagggtggcagccctcatgcaggttgaagtatatgtagcctcagcctgatattcttggtgcgaaggtaaaaaaaaaaaaaataaataaaaccattggcctggttgagggcgtgaccaccaagacatatatgttgtgcccgtgttcatcctgtgtatttatactgtatatgtagagtctagatttatatactgcaatgtaaaatatatatatatttaccttttttaaagacaatggaaattccaagtagctaaaacttagcttcatttatttaatgccactttaaatgtcttaaatttgtttcctggtggacagccgggtaatgcttttagctgctcgcatgcttgtctttctgcatctccatcatctgtttaccttttggttaaactaataaactagtttgggacttggctggcatgtgctgccagacccaaagggaaaaaaaaa

SEQ ID NO: 183 - DNA, 969 bp, Homo sapiens
  ref <308>: DATABASE ACCESSION NUMBER: AF201951
  ref <309>: DATABASE ENTRY DATE: 2001-06-18
acggaacagccagtgggaggttccagctgagcgctccccagaggtgagctgatccccagccacagcacacaggaccaggctgcgagaacagcatcatcagcatcatgctattacaatcccaaaccatgggggtttctcacagctttacaccaaagggcatcactatccctcaaagagagaaacctggacacatgtaccaaaacgaagattacctgcagaacgggctgccaacagaaaccaccgttcttgggactgtccagatcctgtgttgcctgttgatttcaagtctgggggccatcttggtttttgctccctacccctcccacttcaatccagcaatttccaccactttgatgtctgggtacccatttttaggagctctgtgttttggcattactggatccctctcaattatctctggaaaacaatcaactaagccctttgacctgagcagcttgacctcaaatgcagtgagttctgttactgcaggagcaggcctcttcctccttgctgacagcatggtagccctgaggactgcctctcaacattgtggctcagaaatggattatctatcctcattgccttattcggagtactattatccaatatatgaaatcaaagattgtctcctgaccagtgtcagtttaacaggtgtcctagtggtgatgctcatcttcactgtgctggagctcttattagctgcatacagttctgtcttttggtggaaacagctctactccaacaaccctgggagttcattttcctcgacccagtcacaagatcatatccaacaggtcaaaaagagttcttcacggtcttggatataagtaactcttggcctcagaggaaggaaaagcaactcaacactcatggtcaagtgtgattagactttcctgaaatctctgccattttagatactgtgaaacaaactaaaaaaaaaaaagcttttgttttgtaaaaaaaaaaaaa

SEQ ID NO: 184 - DNA, 1581 bp, Homo sapiens
  ref <308>: DATABASE ACCESSION NUMBER: AF217508
  ref <309>: DATABASE ENTRY DATE: 2001-06-18
gagagatggttggtgccatgtggaaggtgattgtttcgctggtcctgttgatgcctggcccctgtgatgggctgtttcgctccctatacagaagtgtttccatgccacctaagggagactcaggacagccattatttctcaccccttacattgaagctgggaagatccaaaaaggaagagaattgagtttggtcggccctttcccaggactgaacatgaagagttatgccggcttcctcaccgtgaataagacttacaacagcaacctcttcttctggttcttcccagctcagatacagccagaagatgccccagtagattctctggctacagggtgggccgggaggttcatccatgtttggactctttgtggaacatgggccttatgttgtcacaagtaacatgaccttgcgtgacagagacttcccctggaccacaacgctctccatgctttacattgacaatccagtgggcacaggcttcagttttactgatgatacccacggatatgcagtcaatgaggacgatgtagcacgggatttatacagtgcactaattcagtttttccagatatttcctgaatataaaaataatgacttttatgtcactggggagtcttatgcagggaaatatgtgccagccattgcacacctcatccattccctcaaccctgtgagagaggtgaagatcaacctgaacggaattgctattggagatggatattctgatcccgaatcaattatagggggctatgcagaattcctgtaccaaattggcttgttggatgagaagcaaaaaaagtacttccagaagcagtgccatgaatgcatagaacacatcaggaagcagaactggtttgaggcctttgaaatactggataaactactagatggcgacttaacaagtgatccttcttacttccagaatgttacaggatgtagtaattactataactttttgcggtgcacggaacctgaggatcagctttactatgtgaaatttttgtcactcccagaggtgagacaagccatcccacgtggggaatcagacttttaatgatggaactatagttgaaaagtacttgcgagaagatacagtacagtcagttaagccatggttaactgaaatcatgaataattataaggttctgatctacaatggccaactggacatcatcgtggcagctgccctgacagagcgctccttgatgggcatggactggaaaggatcccaggaatacaagaaggcagaaaaaaaagtttggaagatctttaaatctgacagtgaagtggctggttacatccggcaagtgggtgacttccatcaggtaattattcgaggtggaggacatattttaccctatgaccagcctctgagagcttttgacatgattaatcgattcatttatggaaaaggatgggatccttatgttggataaactaccttcccaaaagagaacatcagaggttttcattgctgaaaagaaaatcgtaaaaacagaaaatgtcataggaataaaaaaattatcttttcatatctgcaagatttttttcatcaataaaaattatccttgaaaaaaaa

SEQ ID NO: 185 - DNA, 2687 bp, Homo sapiens
  ref <308>: DATABASE ACCESSION NUMBER: AF220492
  ref <309>: DATABASE ENTRY DATE: 2001-06-18
ccagttagagctcgggtctcctcgccacagctccgagtctttcgttctgggaggcccaggcggcttcgcgttctgagaataaacagaacctctgttgctctgcgacttgcaggcactgggagattcgtagctaagacgccagggcatcccggaagctgggaaatgggactgttgacattcagggatgtggccgtagaattctctttggaggagtgggaacacctggaaccagctcagaagaatttgtatcaggatgtgatgttagaaaactacagaaacctggtctctctgggtcttgttgtctctaagccggacctgatcacctttttggaacaaaggaaagagccttggaatgtgaagagtgaggagacagtagccatccagccagatgtgttttcgcattataacaaggacctgttgacagagcactgcacagaagcttcattccaaaaagtgatatcgaggagacatgggagctgtgatcttgagaatttacatttaagaaaaaggtggaaaagggaggagtgtgaagggcacaatggatgttatgatgaaaagacttttaaatatgatcaatttgatgaatcctctgttgaaagtttgtttcaccagcaaatactttcttcttgtgccaaaagctataactttgatcaatataggaaggtctttactcattcatcattgcttaatcaacaagaggaaatagatatttggggaaaacatcacatatatgataaaacttcagtgttatttaggcaggtctctactctaaatagttaccgaaatgtttttattggagagaaaaattatcattgcaataattctgaaaaaaccttgaaccaaagctcaagccctaaaaatcatcaggaaaattattttctagaaaaacaatacaaatgtaaagaatttgaggaagtctttcttcagagtatgcatgggcaagagaaacaagaacagtcttacaaatgtaataaatgtgtagaagtttgtacccagtcattaaaacatattcaacatcagaccatccatatcagagaaaactcatatagctataacaaatatgataaagatcttagtcagtcatcaaatcttagaaagcagataatccataatgaagagaaaccatacaaatgtgaaaaatgtggggatagcttaaaccatagtttgcaccttactcaacatcagatcattcctaccgaagagaaaccctataaatggaaagaatgtggcaaggtctttaaccttaactgtagtttataccttactaaacagcagcaaattgatactggagaaaacctttacaaatgtaaagcatgtagcaaatcttttactcgttcctccaatcttattgtgcatcagagaattcacactggagagaaaccatacaaatgtaaagaatgtggcaaagcctttcgctgtagttcataccttactaaacataagcgaattcatactggagagaaaccttataaatgtaaagaatgtggaaaagcttttaaccgtagttcatgccttactcaacatcagacaactcatacaggagaaaaactttacaaatgtaaagtatgtagcaaatcttatgctcgttcttcaaatcttattatgcatcagagagttcatactggagagaagccttataaatgtaaagaatgtggcaaagtctttagccgtagttcttgccttactcaacatcggaaaattcatactggagaaaatctttacaaatgcaaagtatgtgctaaaccttttacttgtttctcaaatcttattgtgcatgagagaattcatactggagagaaaccctataaatgtaaagaatgtggcaaagcctttccttatagttcacaccttattcgacattatcgaattcatactggagaaaaaccatacaaatgtaaagcatgtagcaaatcttttagtgactcctcaggtctttctgtgcatcggcgaactcatactggagagaaaccctatacatgtaaagaatgtggcaaagcctttagttatagttcagatgttattcagcatcggagaattcatactggccagagaccctacaaatgtgaagaatgtggcaaagccttcaactataggtcatacctcactacacatcagagaagtcatactggagagagaccctacaaatgtgaagaatgtggcaaagccttcaactctaggtcatacctcactacacatcggagaagacatactggagagagaccctacaaatgtgatgaatgtggtaaagccttcagctataggtcatacctcactacacatcggagaagtcatagtggagagagaccctacaaatgtgaagaatgtggcaaagcctttaactctaggtcatacctcattgcacatcagagaagtcatactagagaaaaactttaaaaatgtaaaacatggagcagattttttacttgttacccatgtcttattgtgcatcagataatttatatgggagtgaaaccctacaaatgttaagaatgtggcataacctttaactattttcaagccttacacaatagcagagaatataaactgaaaaaatccatacaaatattaaaaatgtggcaaattattttaaactgtgctcaacccttactcaagataatccatactagagaaacactatagatgtaaaaatgtgaaaagttttattcaaaatatcaaacttatgagtc

SEQ ID NO: 186 - DNA, 926 bp, Homo sapiens
  ref <308>: DATABASE ACCESSION NUMBER: AF224266
  ref <309>: DATABASE ENTRY DATE: 2001-06-18
ctttgaattcctagctcctgtggtctccagatttcaggcctaagatgaaagcctctagtcttgccttcagccttctctctgctgcgttttatctcctatggactccttccactggactgaagacactcaatttgggaagctgtgtgatcgccacaaaccttcaggaaatacgaaatggattttctgacatacggggcagtgtgcaagccaaagatggaaacattgacatcagaatcttaaggaggactgagtctttgcaagacacaaagcctgcgaatcgatgctgcctcctgcgccatttgctaagactctatctggacagggtatttaaaaactaccagacccctgaccattatactctccggaagatcagcagcctcgccaattcctttcttaccatcaagaaggacctccggctctgtcatgcccacatgacatgccattgtggggaggaagcaatgaagaaatacagccagattctgagtcactttgaaaagctggaacctcaggcagcagttgtgaaggctttgggggaactagacattcttctgcaatggatggaggagacagaataggaggaaagtgatgctgctgctaagaatattcgaggtcaagagctccagtcttcaatacctgcagaggaggcatgaccccaaaccaccatctctttactgtactagtcttgtgctggtcacagtgtatcttatttatgcattacttgcttccttgcatgattgtctttatgcatccccaatcttaattgagaccatacttgtataagatttttgtaatatctttctgctattggatatatttattagttaatatatttatttattttttgctattaatgtatttaattttttacttgggcatgaaactttaaaaaaaattcacaagattatatttataacctgactagagca

SEQ ID NO: 187 - DNA, 3348 bp, Homo sapiens
  ref <308>: DATABASE ACCESSION NUMBER: AF230904
  ref <309>: DATABASE ENTRY DATE: 2001-06-18
cgcaatttccactcgcggggagcaggaaacccggcgcagccgggcgcattgggccgcgatgcaacagcagcagcaggagtcgccccggggcagcagcggcagcagcagcagaggcagcagcgggcggcgctgagccgccgccgccgccactgaggaagaagccggcccagccgccgccgcgtccggaccctcgcgcctggatcccagcgccccgatcccggcgccccaacccccacgcccgcctccgccaactttcacgctgcctcggcggcccggcccggctcgacgccaatggtggaggccatagtggagtttgactaccaggcccagcacgatgatgagctgacgatcagcgtgggtgaaatcatcaccaacatcaggaaggaggatggaggctggtgggagggacagatcaacggcaggagaggtttgttccctgacaactttgtaagagaaataaagaaagagatgaagaaagaccctctcaccaacaaagctccagaaaagcccctgcacgaagtgcccagtggaaactctttgctgtcttctgaaacgattttaagaaccaataagagaggcgagcgacggaggcgccggtgccaggtggcattcagctacctgccccagaatgacgatgaacttgagctgaaagttggcgacatcatagaggtggtaggagaggtagaggaaggatggtgggaaggtgttctcaacgggaagactggaatgtttccttccaacttcatcaaggagctgtcaggggagtcggatgagcttggcatttcccaggatgagcagctatccaagtcaagtttaagggaaaccacaggctccgagagtgatgggggtgactcaagcagcaccaagtctgaaggtgccaacgggacagtggcaactgcagcaatccagcccaagaaagttaagggagtgggctttggagacattttcaaagacaagccaatcaaactaagaccaaggtcaattgaagtagaaaatgactttctgccggtagaaaagactattgggaagaagttacctgcaactacagcaactccagactcatcaaaaacagaaatggacagcaggacaaagagcaaggattactgcaaagtaatatttccatatgaggcacagaatgatgatgaattgacaatcaaagaaggagatatagtcactctcatcaataaggactgcatcgacgtaggctggtgggaaggagagctgaacggcagacgaggcgtgttccccgataacttcgtgaagttacttccaccggactttgaaaaggaagggaatagacccaagaagccaccgcctccatccgctcctgtcatcaaacaaggggcaggcaccactgagagaaaacatgaaattaaaaagatacctcctgaaagaccagaaatgcttccaaacagaacagaagaaaaagaaagaccagagagagagccaaaactggatttacagaagccctccgttcctgccataccgccaaaaaagcctcggccacctaagaccaattctctcagcagacctggcgcactgcccccgagaaggccggagagaccggtgggtccgctgacacacaccaggggtgacagtccaaagattgacttggccggcagttcgctatctggcatcctggacaaagatctctcggaccgcagcaatgacattgacttagaaggttttgactccgtggtatcatctactgagaaactcagtcatccgaccacaagcagaccaaaagctacagggaggcggcctccgtcccagtccctcacatcttcatccctttcaagccctgatatcttcgactccccaagtcccgaagaggataaggaggaacacatttcacttgcgcacagaggagtggacgcgtcaaagaaaacttccaagactgttaccatatcccaagtgtctgacaacaaagcatccctgccgcccaagccggggaccatggcagcaggtggcggtgggccagcccctctgtcctcagcggcgccctcccccctgtcatcctctttgggaacagctggacacagagccaactccccgtctctgttcggcacggaaggaaaaccaaagatggagcctgcggccagcagccaggcggccgtggaggagctaaggacacaggtccgcgagctgaggagcatcatcgagaccatgaaggaccagcagaaacgagagattaaacagttattgtctgagttggatgaagagaagaaaatccggcttcggttgcagatggaagtgaacgacataaagaaagctctacaatcaaaatgaatacttgatcaatgaaatgtcacattattcatcctgagtccgagactcaaattttctgccccagccaaaataatcttgtgccaaaagattaaaggtttgcctcaaaatgtccctgtttgaaagattagcacaaaagtcttgatagcacaacacaaattccatccaagaggagaatcttccccagggtttagtcctggggctggcactcgttgtgacttacacagagcaaaattgtgctaaaggcttttctactctgagatctcaatgcgaaatgaaaactcaggcagtttagtccatagtggtactattttgatgatattttccattaataaaatgtaatttcagattattcgtttacaagctttataattttatgattttttaatcgtgttttgtcacagacttccctagtgtttgtactacacgtagtcagaagcgagtgtccttttcttttgcttcaggctaagagctgcctcgctctttgtccccccattaggattctattacatatgcaattgtaggttcaacctgtccctttccctgccagcaaaccccaccaccctaagagaaattttagcttatatatgacggtatatttacaaaaagagaaagagaaaatctggtatttgcaatgatctgtgccttctttttaccaccctcttgattggagcttttgtgatgcagctaccatgattcaaaaaaattaaaaattaaaaaaaaaaaatctgccacttatccaagtccactagaggccactgtcttcaaagcttctctcaccctagccaaaggtcctaagaggagacagctgtgaagttgggcgtgctctgtggtaccagctgtgacttttctatttctcctagttttaggttgttcatgaaactagaaatgtcatcctgcttgatttttcatcagccaagttaaacccctgctttctgtcctttgcaccttttgcgtgaacagaatatgcattattaaagcaaaaataaataaaagtaaaatgcaaatgaaaacaaggaaaaaaaaaaaaaaaaaaaaaaaaaaaaaaaaaaaaaaaaaaaa

SEQ ID NO: 188 - DNA, 7787 bp, Homo sapiens
  ref <308>: DATABASE ACCESSION NUMBER: AF234532
  ref <309>: DATABASE ENTRY DATE: 2001-06-18
gagacaaaggctgccgtcgggacgggcgagttagggacttgggtttgggcgaacaaaaggtgagaaggacaagaagggaccgggcgatggcagcaggggagccccgcgggcgcgcgtcctcgggagtggcgccgtgacacgcatggtttccccggacccgcggcggcgctgacttccgcgagtcggagcggcactcggcgagtccgggactgcgctggaacaatggataacttcttcaccgagggaacacgggtctggctgagagaaaatggccagcattttccaagtactgtaaattcctgtgcagaaggcatcgtcgtcttccggacagactatggtcaggtattcacttacaagcagagcacaattacccaccagaaggtgactgctatgcaccccacgaacgaggagggcgtggatgacatggcgtccttgacagagctccatggcggctccatcatgtataacttattccagcggtataagagaaatcaaatatatacctacatcggctccatcctggcctccgtgaacccctaccagcccatcgccgggctgtacgagcctgccaccatggagcagtacagccggcgccacctgggcgagctgcccccgcacatcttcgccatcgccaacgagtgctaccgctgcctgtggaagcgctacgacaaccagtgcatcctcatcagtggtgaaagtggggcaggtaaaaccgaaagcactaaattgatcctcaagtttctgtcagtcatcagtcaacagtctttggaattgtccttaaaggagaagacatcctgtgttgaacgagctattcttgaaagcagccccatcatggaagctttcggcaatgcgaagaccgtgtacaacaacaactctagtcgctttgggaagtttgttcagctgaacatctgtcagaaaggaaatattcagggcgggagaattgtagattatttattagaaaaaaaccgagtagtaaggcaaaatcccggggaaaggaattatcacatattttatgcactgctggcagggctggaacatgaagaaagagaagaattttatttatctacgccagaaaactaccactacttgaatcagtctggatgtgtagaagacaagacaatcagtgaccaggaatcctttagggaagttattacggcaatggacgtgatgcagttcagcaaggaggaagttcgggaagtgtcgaggctgcttgctggtatactgcatcttgggaacatagaatttatcactgctggtggggcacaggtttccttcaaaacagctttgggcagatctgcggagttacttgggctggacccaacacagctcacagatgctttgacccagagatcaatgttcctcaggggagaagagatcctcacgcctctcaatgttcaacaggcagtagacagcagggactccctggccatggctctgtatgcgtgctgctttgagtgggtaatcaagaagatcaacagcaggatcaaaggcaatgaggacttcaagtctattggcatcctcgacatctttggatttgaaaactttgaggttaatcactttgaacagttcaatataaactatgcaaacgagaaacttcaggagtacttcaacaagcatattttttctttagaacaactagaatatagccgggaaggattagtgtgggaagatattgactggatagacaatggagaatgcctggacttgattgagaagaaacttggcctcctagcccttatcaatgaagaaagccattttcctcaagccacagacagcaccttattggagaagctacacagtcagcatgcgaataaccacttttatgtgaagcccagagttgcagttaacaattttggagtgaagcactatgctggagaggtgcaatatgatgtccgaggtatcttggagaagaacagagatacatttcgagatgaccttctcaatttgctaagagaaagccgatttgactttatctacgatctttttgaacatgtttcaagccgcaacaaccaggataccttgaaatgtggaagcaaacatcggcggcctacagtcagctcacagttcaaggactcactgcattccttaatggcaacgctaagctcctctaatcctttctttgttcgctgtatcaagccaaacatgcagaagatgccagaccagtttgaccaggcggttgtgctgaaccagctgcggtactcagggatgctggagactgtgagaatccgcaaagctgggtatgcggtccgaagaccctttcaggacttttacaaaaggtataaagtgctgatgaggaatctggctctgcctgaggacgtccgagggaagtgcacgagcctgctgcagctctatgatgcctccaacagcgagtggcagctggggaagaccaaggtctttcttcgagaatccttggaacagaaactggagaagcggagggaagaggaagtgagccacgcggccatggtgattcgggcccatgtcttgggcttcttagcacgaaaacaatacagaaaggtcctttattgtgtggtgataatacagaagaattacagagcattccttctgaggaggagatttttgcacctgaaaaaggcagccatagttttccagaagcaactcagaggtcagattgctcggagagtttacagacaattgctggcagagaaaagggagcaagaagaaaagaagaaacaggaagaggaagaaaagaagaaacgggaggaagaagaaagagaaagagagagagagcgaagagaagccgagctccgcgcccagcaggaagaagaaacgaggaagcagcaagaactcgaagccttgcagaagagccagaaggaagctgaactgacccgtgaactggagaaacagaaggaaaataagcaggtggaagagatcctccgtctggagaaagaaatcgaggacctgcagcgcatgaaggagcagcaggagctgtcgctgaccgaggcttccctgcagaagctgcaggagcggcgggaccaggagctccgcaggctggaggaggaagcgtgcagggcggcccaggagttcctcgagtccctcaatttcgacgagatcgacgagtgtgtccggaatatcgagcggtccctgtcggtgggaagcgaattttccagcgagctggctgagagcgcatgcgaggagaagcccaacttcaacttcagccagccctacccagaggaggaggtcgatgagggcttcgaagccgacgacgacgccttcaaggactcccccaaccccagcgagcacggccactcagaccagcgaacaagtggcatccggaccagcgatgactcttcagaggaggacccatacatgaacgacacggtggtgcccaccagccccagtgcggacagcacggtgctgctcgccccatcagtgcaggactccgggagcctacacaactcctccagcggcgagtccacctactgcatgccccagaacgctggggacttgccctccccagacggcgactacgactacgaccaggatgactatgaggacggtgccatcacttccggcagcagcgtgaccttctccaactcctacggcagccagtggtcccccgactaccgctgctctgtggggacctacaacagctcgggtgcctaccggttcagctctgagggggcgcagtcctcgtttgaagatagtgaagaggactttgattccaggtttgatacagatgatgagctttcataccggcgtgactctgtgtacagctgtgtcactctgccgtatttccacagctttctgtacatgaaaggtggcctgatgaactcttggaaacgccgctggtgcgtcctcaaggatgaaaccttcttgtggttccgctccaagcaggaggccctcaagcaaggctggctccacaaaaaaggggggggctcctccacgctgtccaggagaaattggaagaagcgctggtttgtcctccgccagtccaagctgatgtactttgaaaacgacagcgaggagaagctcaagggcaccgtagaagtgcgaacggcaaaagagatcatagataacaccaccaaggagaatgggatcgacatcattatggccgataggactttccacctgattgcagagtccccagaagatgccagccagtggttcagcgtgctgagtcaggtccacgcgtccacggaccaggagatccaggagatgcatgatgagcaggcaaacccacagaatgctgtgggcaccttggatgtggggctgattgattctgtgtgtgcctctgacagccctgatagacccaactcgtttgtgatcatcacggccaaccgggtgctgcactgcaacgccgacacgccggaggagatgcaccactggataaccctgctgcagaggtccaaaggggacaccagagtggagggccaggaattcatcgtgagaggatggttgcacaaagaggtgaagaacagtccgaagatgtcttcactgaaactgaagaaacggtggtttgtactcacccacaattccctggattactacaagagttcagagaagaacgcgctcaaactggggaccctggtcctcaacagcctctgctctgtcgtccccccagatgagaagatattcaaagagacaggctactggaacgtcaccgtgtacgggcgcaagcactgttaccggctctacaccaagctgctcaacgaggccacccggtggtccagtgccattcaaaacgtgactgacaccaaggccccgatcgacacccccacccagcagctgattcaagatatcaaggagaactgcctgaactcggatgtggtggaacagatttacaagcggaacccgatccttcgatacacccatcaccccttgcactccccgctcctgccccttccgtatggggacataaatctcaacttgctcaaagacaaaggctataccacccttcaggatgaggccatcaagatattcaattccctgcagcaactggagtccatgtctgacccaattccaataatccagggcatcctacagacagggcatgacctgcgacctctgcgggacgagctgtactgccagcttatcaaacagaccaacaaagtgccccaccccggcagtgtgggcaacctgtacagctggcagatcctgacatgcctgagctgcaccttcctgccgagtcgagggattctcaagtatctcaagttccatctgaaaaggatacgggaacagtttccaggaaccgagatggaaaaatacgctctcttcacttacgaatctcttaagaaaaccaaatgccgagagtttgtgccttcccgagatgaaatagaagctctgatccacaggcaggaaatgacatccacggtctattgccatggcggcggctcctgcaagatcaccatcaactcccacaccactgctggggaggtggtggagaagctgatccgaggcctggccatggaggacagcaggaacatgtttgctttgtttgaatacaacggccacgtcgacaaagccattgaaagtcgaaccgtcgtagctgatgtcttagccaagtttgaaaagctggctgccacatccgaggttggggacctgccatggaaattctacttcaaactttactgcttcctggacacagacaacgtgccaaaagacagtgtggagtttgcatttatgtttgaacaggcccacgaagcggttatccatggccaccatccagccccggaagaaaacctccaggttcttgctgccctgcgactccagtatctgcagggggattatactctgcacgctgccatcccacctctcgaagaggtttattccctgcagagactcaaggcccgcatcagccagtcaaccaaaaccttcaccccttgtgaacggctggagaagaggcggacgagcttcctagaggggaccctgaggcggagcttccggacaggatccgtggtccggcagaaggtcgaggaggagcagatgctggacatgtggattaaggaagaagtctcctctgctcgagccagtatcattgacaagtggaggaaatttcagggaatgaaccaggaacaggccatggccaagtacatggccttgatcaaggagtggcctggctatggctcgacgctgtttgatgtggagtgcaaggaaggtggcttccctcaggaactctggttgggtgtcagcgcggacgccgtctccgtctacaagcgtggagagggaagaccactggaagtcttccagtatgaacacatcctctcttttggggcacccctggcgaatacgtataagatcgtggtcgatgagagggagctgctctttgaaaccagtgaggtggtggatgtggccaagctcatgaaagcctacatcagcatgatcgtgaagaagcgctacagcacgacacgctccgccagcagccagggcagctccaggtgaaggcgggacagagcccacctgtctttgctacctgaacgcaccaccctctggcctaggctggctccagtgtgccatgcccagccaaaacaaacacagagctgcccaggctttctggaagcttctggtctgagggaggtgtctccgaggatccttttgcctgccgccttcattgatcctgtattaagctgtcaactttaacagtctgcacagtttccaaagctttactactcttagaggacacatgccttaaaaaaggaggggaggaaccacgctgccaccaaagcagccggaagtgccttaacttgtggaaccaacactaatcgaccgtaactgtgctactgaagggaactgcctttcccccttctgggggagacttaacagagcgtggaaggggggcattctctgtcaatgatgcactaacctcccaacctgatttccccgaatctgagggaaggtgagggagtgggaagggggatggagagctcgaggggacagtgtgtttgagctggagtgctgcgggcagcctttctcatggaatgacatgaatcaacttttttctttgtttcatcttttaagtgtacgtgcttgcctgttcgtgcatgtgttcataaactcaacactttaatcatggtttcatgagcattaaaaagcaaagggaaaaaggatgtgtaatggtgtacacagtctgtatattttaataatgcagagctatagtctcaattgttactttataaggtggttttattaacaaacccaaatcctggattttcctgtctttgctgtattttgaaaaacacgtgttgactccattgttttacatgtagcaaagtctgccatctgtgtctgctgtattataaacagataagcagcctacaagataactgtatttataaaccactcttcaacagctggctccagtgctggttttagaacaagaatgaagtcattttggagtctttcatgtctaaaagatttaagttaaaaacaaagtgttacttggaaggttagcttctatcattctggatagattacagatataataaccatgttgactatgggggagagacgctgcattccagaaacgtcttaacacttgagtgaatcttcaaaggaccctgacattaaatgctgaggctttaatacacacatattttatcccaagtttataatggtggtctgaacaaggcacctgtaaataaatcagcatttatgaccagaagaaaaataatctggtcttggactttttatttttatatggaaaagttttaaggacttgggccaactaagtctacccacacgaaaaaagaaatttgccttgtccctttgtgtacaaccatgcaaaactgtttgttggctcacagaagttctgacaataaaagatactagct

SEQ ID NO: 189 - DNA, 2125 bp, Homo sapiens
  ref <308>: DATABASE ACCESSION NUMBER: AF257175
  ref <309>: DATABASE ENTRY DATE: 2001-06-18
tggcgatggcgtacttggcttggagactggcgcggcgttcgtgtccgaggtcactagtttcccggtagttcagctgcacatgaatagaacagcaatgagagccagtcagaaggactttgaaaattcaatgaatcaagtgaaactcttgaaaaaggatccaggaaacgaagtgaagctaaaactctacgcgctatataagcaggccactgaaggaccttgtaacatgcccaaaccaggtgtatttgacttgatcaacaaggccaaatgggacgcatggaatgcccttggcagcctgcccaaggaagctgccaggcagaactatgtggatttggtgtccagtttgagtccttcattggaatcctctagtcaggtggagcctggaacagacaggaaatcaactgggtttgaaactctggtggtgacctccgaagatggcatcacaaagatcatgttcaaccggcccaaaaagaaaaatgccatacacactgagatgtatcatgaaattatgcgtgcacttaaagctgccagcaaggatgactcaatcatcactgttttaacaggaaatggtgactattacagtagtgggaatgatctgactaacttcactgatattccccctggtggagtagaggagaaagctaaaaataatgccgttttactgaggtaagagttactgacctttgtctgatcccagagggcccgttcttagtcatcaaagtggtatttagttgagcaaaagtgcaatatctgcttctctgtgtcagtgcagttaattgtgactttggacaagcatatttctctaaactggctccatccataggtgggcattcattctttctctttgacctctgttacctgttcatcctgctggtctcatgagatttgactggaaaacataaaagtgagctatagttgtaaacaaaattatcttgcattgaggcagaggaatttagcaaattctcatccagccagaggaatgggagatttccatgaacgctgaaggtaggagactcggaggagtcttgtaaacacaggaggaggtcatgaaggcttttctctttattcctgccaaatctgtaattcccacttgctgtgatattgcagcatgtgctcagtcacccaacctaatctctaagactgcggctggtttacagccctgaactcactgtccagaatacaagattcaaaccagggttgacccataggtctcactggttggtcttccatccactgccattcagacggatgccctggatgaatctggtgcggaagaccagggaagtggcaggacaaggaggcactgctggtggtggctgtggaaacacccagcctgacagaaggctttatctcagagtcagactgtcttgcccatgcttcagtcatgctgctttggcacatttaatgattttgtgtttccatttctgtagggaatttgtgggctgttttatagattttcctaagcctctgattgcagtggtcaatggtccagctgtgggcatctccgtcaccctccttgggctattcgatgccgtgtatgcatctgacagggcaacatttcatacaccatttagtcacctaggccaaagtccggaaggatgctcctcttacacttttccgaagataatgagcccagccaaggcaacagagatgcttatttttggaaagaagttaacagcgggagaggcatgtgctcaaggacttgttactgaagttttccctgatagcacttttcagaaagaagtctggaccaggctgaaggcatttgcaaagcttcccccaaatgtcttgagaatttcaaaagaggtaatcaggaaaagagagagagaaaaactacacgctgttaatgctgaagaatgcaatgtccttcagggaagatggctatcagatgaatgcacaaatgctgtggtgaacttcttatccagaaaatcaaaactgtgatgaccactacagcagagtaaagcatgtccaaggaaggatgtgctgttacctctgatttccagtactggaactaaataagcttcattgtgccttttgtagtgctagaatatcaattacaatgatgatatttcactacagctctgatgaataaaaagttttgtaaaccaaaaaaaaaaaaaaaaaaaaa

SEQ ID NO: 190 - DNA, 891 bp, Homo sapiens
  ref <308>: DATABASE ACCESSION NUMBER: AF257659
  ref <309>: DATABASE ENTRY DATE: 2001-06-18
aagcctacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaatgattgtagataaaatagacgcggataaagatgggtttgtgacggagggggagctgaaatcctggattaagcacgcccagaagaaatacatatatgacgatgttgaaaaccaatggcaggagtttgatatgaatcaagacggcttaatctcctgggatgagtacagaaacgtgacttatggcacttacctggatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacgacacgatgagttctaa

SEQ ID NO: 191 - DNA, 1371 bp, Homo sapiens
  ref <308>: DATABASE ACCESSION NUMBER: AF272357
  ref <309>: DATABASE ENTRY DATE: 2001-06-18
gctgctcccgacgcggagcccggagcccgcgccgagcccctggcctcgcggtgccatgctgccccggcggcggcgctgaaggatggcgacgccgctgcctccgccctccccgcggcacctgcggctgctgcggctgctgctctccggcctcgtcctcggcgccgccctgcgtggagccgccgccggccacccggatgtagccgcctgtcccgggagcctggactgtgccctgaagaggcgggcaaggtgtcctcctggtgcacatgcctgtgggccctgccttcagcccttccaggaggaccagcaagggctctgtgtgcccaggatgcgccggcctccaggcgggggccggccccagcccagactggaagatgagattgacttcctggcccaggagcttgcccggaaggagtctggacaatcaactccgcccctacccaaggaccgacagcggctcccggagcctgccaccctgggcttctcggcacgggggcaggggctggagctgggcctcccctccactccaggaacccccacgcccacgccccacacctccctgggctcccctgtgtcatccgacccggtgcacatgtcgcccctggagccccggggagggcaaggcgacggcctcgcccttgtgctgatcctggcgttctgtgtggccggtgcagccgccctctccgtagcctccctctgctggtgcaggctgcagcgtgagatccgcctgactcagaaggccgactacgccactgcgaaggcccctggctcacctgcagctccccggatctcgcctggggaccagcggctggcacagagcgcggagatgtaccactaccagcaccaacggcaacagatgctgtgcctggagcggcataaagagccacccaaggagctggacacggcctcctcggatgaggagaatgaggacggagacttcacggtgtacgagtgcccgggcctggccccgaccggggaaatggaggtgcgcaaccctctgttcgaccacgccgcactgtccgcgcccctgccggcccccagctcaccgcctgcactgccatgacctggaggcagacagacgcccacctgctccccgacctcgaggcccccggggaggggcagggcctggagcttcccactaaaaacatgttttgatgctgtgtgcttttggctgggcctcgggctccaggccctgggaccccttgccagggagacccccgaacctttgtgccaggacacctcctggtcccctgcacctctcctgttcggtttagacccccaaactggagggggcatggagaaccgtagagcgcaggaacgggtgggtaattctagagacaaaagccaattaaagtccatttcagaaaaaaaaaa

SEQ ID NO: 192 - DNA, 8743 bp, Homo sapiens
  ref <308>: DATABASE ACCESSION NUMBER: AF279865
  ref <309>: DATABASE ENTRY DATE: 2001-06-18
cagacggaagccgaacgagttcctcggcggctgcaggatgggggactccaaagtgaaagtggcggtgcggatacgacccatgaaccggcgagagactgacttgcataccaaatgtgtggtggatgtggatgcaaacaaggttattcttaatcctgtaaatacgaatctttccaaaggagatgcccggggccagccgaagtgttttgcttatgatcattgtttctggtctatggatgaatctgtcaaagaaaagtatgcaggtcaagatattgttttcaagtgccttggagagaatatcctgcagaatgcttttgatggctacaatgcatgtatctttgcctatggacagactggctctggaaaatcttataccatgatgggcacagctgaccaacctggattaatcccaagactttgcagtggactctttgaacgaactcagaaagaggaaaatgaagaacagagttttaaagtagaagtgtcctacatggaaatttataatgaaaaagttcgagaccttcttgatcccaaaggaagccgtcagacgttgaaagtcagagagcatagtgtgttgggaccttatgtcgacggactttctaaactggctgccacaagctacaaggatattgagtcgttgatgtctgagggtaacaaatctcgcactgttgctgcaaccaacatgaacgaggagagtagccgatcccatgcagttctcaaaatcaccctcacacatactctctacgatgcgaagtctgggacatctggagagaaagtgggcaaactcagcctggtggatttagctggcagtgaacgagcaacgaagacaggcgctgcaggggacaggctgaaggaagggagcaacattaacgagtccctcacaaccctcggtctggttatctcagctcttgcagatcagagtgctggcaaaaacaagaataaatttgttccatatcgtgactcagttctcacctggctgctcaaagacagcctcgggggtaacagcaagaccgccatggtggctactgtgagtcctgcagctgataactatgatgaaaccctctcaactctgcggtatgcagatcgagccaagcacattgtaaacaacgctgtggtgaatgaggaccctaatgcccgaattatccgggacctccgggaagaagttgagaaactccgggagcagctgaccaaagcagaggcaatgaaatctccagagctaaaggaccggctggaagaatctgagaagctaatccaggaaatgactgtgacctgggaggagaaattaaggaaaacggaggagattgcacaggaacgacagaaacagcttgagagtcttggaatatctcttcagtcttcgggaatcaaagttggggatgataaatgcttccttgtgaatctgaatgctgacccagctctgaatgagcttctggtgtactatttaaaggaacatacattgatagggtcagcaaattcccaagatatccaactgtgcggcatgggaattcttcctgaacactgtattatagacatcacgtcagaaggccaggttatgctgactcctcagaagaacaccagaacatttgtaaatgggtcatctgtctccagtccaatacagctacaccatggggacaggatattatggggaaacaatcatttcttcagactcaatttgcctaaaaagaaaaagaaagcagaacgagaggatgaggaccaggatccctccatgaagaacgagaatagttctgagcagctggatgtagacggagactcctccagcgaggtgtccagtgaagttaactttaattacgaatacgcacagatggaggtcaccatgaaggccctgggcagcaatgatccgatgcagtccatattaaacagcctagaacaacagcatgaagaagaaaaacgatctgcactggagcgccagaggcttatgtatgagcacgaattggagcagctccggagaaggctgtctcctgagaagcagaactgccggagcatggacaggttttctttccactcgcccagcgctcagcaacgcttaagacagtgggctgaggagagagaagcaacgttgaataacagcctgatgaggctgagggaacaaattgttaaggccaatctattggtgagagaagctaattacattgctgaggagctggataaaagaacagaatacaaagttaccctacagattccagcctccagcctggatgccaacaggaagcgaggctctcttcttagtgagcctgcaatccaggtgagaagaaaaggaaaaggaaagcagatttggtctttggaaaaactggacaacaggctgttggatatgagagacctttatcaggagtggaaagagtgtgaagaagataacccagtaatacgatcatacttcaaacgtgctgatccattctatgatgagcaggaaaatctcagtctcattggggtggccaatgtcttcctcgagtcacttttctatgatgtgaagttacaatacgctgttcccatcatcaaccagaaaggagaggtggcaggtcggctgcacgtggaggtgatgcgactcagtggtgatgttggggagaggatcgcaggaggcgatgaggtggcagaggtcccctttgagaaggagacccaggagaacaaactggtgtgcatggttaaaatcctgcaagctactgggttgccacagcatctgtcccactttgtgttctgcaaatacagcttctgggatcaacaggagccggtgattgtcgctcctgaagtggacacctcctcctcttccgtcagcaaggagccgcactgcatggttgtctttgatcattgcaatgagttttctgttaacatcaccgaagactttatcgagcatctttccgaaggagcattggcaattgaagtatatggacataaaataaacgatccccggaaaaaccccgccctgtgggatttgggaatcatccaagcaaagacacgtagtcttcgggacagatggagtgaagtgaccaggaaattggaattctgggttcaaatcttggaacagaatgagaatggtgaatactgccctgtagaagtgatttctgcaaaggatgtcccaacaggaggaatcttccagctccggcaggggcagtcccggagagttcaagtcgaagtgaagtcagtgcaggaatctgggactttaccactgatggaagaatgtatactgtctgttggcattggatgtgtcaaagttagaccgctcagagcccccagaacacatgagaccttccatgaggaagaggaagacatggacagctaccaggatcgagatttagagagacttcgtagaaaatggctaaatgcattaacaaaacgtcaggagtacttggatcaacaattgcaaaagcttgtcagtaaacgtgataaaacagaggatgatgctgaccgtgaagcgcagcttctggagatgcggttgaccctaactgaggagaggaacgcggtgatggtcccctctgctggcagtggtattccaggggccccagcagaatggaccccagtacctgggatggagacacacattcctgttatattcctggacttaaatgctgatgatttcagctctcaggataatcttgatgacccagaagctggtggatgggatgcgaccttgactggggaagaagaagaggagttctttgaattgcagattgtgaagcagcatgatggggaggtgaaagcagaagcctcctgggactccgcggtgcatggctgccctcagctcagcaggggcacgcccgtggacgagcggttgttcctgatcgtgcgcgtgacggtccagctcagccaccctgctgacatgcaactggtgttacgcaagagaatctgtgtcaatgttcacggccgccagggttttgcacagagtctcctaaaaaagatgtctcatcgaagttctattcctggctgtggagtgacttttgaaattgtctccaatattccagaggatgcccagggagtggaagaacgggaagcattagcaagaatggcagccaatgttgaaaacccagcttctgctgactcggaggcttatattgaaaagtacctcaggagcgtgctggctgtagaaaacctcctgactttagatcgtctgcgccaggaagttgcagtgaaggaacagttaacaggaaaaggaaagttgagcaggaggagtatcagttctccaaatgtgaacagattgtctggaagccgacaagatctcattccatcatacagtctaggcagcaacaagggccggtgggaaagtcagcaggatgtatcccaaaccacagtttccagaggaatagctcctgcccccgccctctctgtttctccccaaaataaccattctccagatccaggactcagtaaccttgcagcatcctacttgaatcctgtcaaatccttcgtgccgcaaatgccaaagctcctcaagtctctctttcccgtccgcgatgagaagaggggcaagcggccgtctcccctcgcacaccagcccgtgccccgcatcatggtgcagtcagccagcccggacatcagggtgaccaggatggaggaggctcagccggagatgggccctgacgtgctggtgcagacgatgggggccccggccttgaagatctgcgacaaacctgccaaagtgccttccccaccgcctgtcatagctgtcacagcggtcaccccggctccggaggcacaggacgggccccccagccccctgagtgaagcctctagcgggtacttctcccacagcgtctccaccgcgaccctgtcggacgccctgggccccggcctggacgctgcggccccgccggggtccatgcccaccgcccctgaggccgagcccgaggcgcccatcagccaccccccaccgcccacggccgtccccgccgaggagccccctggcccccagcagctcgtgagccccggtcgggagcgccccgacctcgaggccccggcgcccggctccccgttccgcgtccggagggtgcgggcctcggagttgcgctccttctcgcgcatgctggctggggaccccggctgctccccgggggccgaggggaatgcgccggccccgggcgccgggggacaggccctggcctctgattccgaggaagctgacgaggtcccggagtggctccgagagggcgagttcgtcaccgtgggcgcccacaaaacgggcgtggtgagatacgtggggcctgccgacttccaagagggcacgtgggtcggcgtggagctcgacctgccctcaggtaagaatgacggttccatcggcgggaagcagtacttcaggtgtaaccctggctacgggctgctggtcaggcccagccgggtccgcagggccacgggccctgtgcggcggcgcagcacaggactccggctgggtgcccccgaggcccgccggagcgccaccctctcgggctccgccaccaacctggcctcgctgacagctgccctggccaaggccgacaggagccacaagaaccctgagaaccggaaatcctgggccagctgagccgctgccttagggcgaacttttctgggggtgcccggccccttttgagccctgccagtgacagccctgaggagccaggagcccggtggccccttccccaggggcagggcgatgaatgctttttgcacgacacagggctggtgacctccctgggcctctggaagctttgtttcttctgtacccgggtaaagtgggggcctcaactgtgcctcctccggtggatggaaggttctgggtgcccgcaggggctgggggatgctaggactgagaccctgggtggtgcagcgcctggtgatcttgctgtgtgcctgtgcctggggccttatgttgctctttctatcatttccattctggtggccccactaatgtcttaacctaaaccataattgtaaccagtgcctttcctccccactggagggcaagcccccccacccacccaggatgtcctggctcactccgcaagccccccagcctcccaccctggtcccagtttcccgcaaagtgcctctgggggaccccccagcctcccaccctggtcccaggttccacaagtgcctctggagggccctgggctctggcagatggtcctggtgccccagacgggggccgagggcctgagcccccccatccctcctctgccagggtttcttagcggtttctctgtggatgttttggcatctttagacacctggaaagtctcttatgtttgccgtttattcccttcacagaaggcttggaatgtatttatttatatttattttttcaaaatccgaaatcatttgcgagccgcaatcgtcgtctgcctgtgtgggggggcccagggcctgccttgcacgttgcagcctctctggccattgcagagctgctggcctcctgcccaggtggagggtcctggggacggcagaggataaagccccctcctcacatccctctattgcggatccacagtggccttactcttaacttggatgagagcaaaaacctgggagaatgatgtgcttctgtagtcggtgacaaaggaagaggcattgctactttatttggtgcacttttggtttctaggaaggtctttgggtcattttaacttctcggcaactcccagactctcagagtgtggggctggggcctggcggctgggctggtgcagggagtgtgctggttagtctccagaccctcacagcagccacgcccccaggcccaccgtgcatggtgtgggcgggacagccggaagcttccggggtggcctccacctcctggctggggcacttatgctcccagagcctttggtgccaggtttgtgggatgggggttagcgtctatgtgtggaaggccaccaatctagggacaggagtcctgggtcaagattcacacagccacccttggagctggtttctagttctcacatttagtcaacatctagaaagcgctgcggaaggctctggttctctagggacttgaaggcgccaacagagtagtctccatggtgggcctgtcccagccctggctgcgaggacaggttgtctttctctccccagttggcgagggacacgaaggctgcggccgggctggcagagggcccggcccctggggggaggcactcctccagggctctccctgtccttagccgattttgagggaaccctgtggcacctgtccctggatgaagagctgtcacctctgccttgccctttaactcaacccgcttcccagcacagcggctttctttttaaaacctgtttcactgagaagtttgtttttgggtccgctggtgtcactatggcctgggtgagaggccagcactgctgctgccctgaggggaaacgcctgggccgtgtagtggggacgctctgggaatggtggcggacgggcagcgtgggtgggacctggcacttcgtggtggctgagccatccacccagcagcggcctcctgtagcaccatattgggaaagtcctgggggacgtgtgtgtcgtgctttttaccatcggtttgacttacagtggagtagaacgagccagagttcctgacttgagcaggtggatttgggcccaggccctgttcactcttgcttctcggtgcggactaatgtcagcttgtggctgggaaagagggatgtgcagtgacgtggtcaccaaggcagtgagccccgctgaccccgggccagcacttggcaggcaggaggtgcggtctccagagtggtgggccagggcgggctggcctccgtcttctatcttcttttcttgcctccctgaccagcagactcacctcccaagaacgcctgcccgcccacccgccttaggactcccgatgcgctcctggaaggccccaggagtggcaccttagtgtgggtcggcccgcagatggcacccaaggccgggaagggcagtaactgcacacgcggcgctgtcagagatgggggtgggggatgcttctgggggccctgcctccccattgtgtgcccagaacatccctggccccaccccgccacttccctcgggcccttatgaaggactgaggctccagggtgagaaggctcacttctgccccaggcactgcgtccagcagcagaggggacagggggcaggtgtgtgactgggttcctgggtacccaggcctgaccagagggagcgggagggcagaggtgaggagggggaagatgtttctgggcctaccaaggttcaacaagagaacggagctgggaatgtgactgctggagcctgagaggtggaggagttctgatcccccgttacttcctagcattttctcctcttgccttaaaagttccctgtatgtgaaacgggaagtcctgagagtgtgtgttggtggctgtgcgcacgcacacaagacgggagtcaccctgtgcttcctgcccaagatactgacccattgaacccccaaagcatctttctctccacaaagtccgtggtgccttcctggtgggctgcagacactaatggtgttggggggtcttggaacagcttctctatgtgtggattcgtgtaaatgcgaagagttcacatataaagaagtgactttgattctgtgattatattgatttggtacacagtaaatgggagtttaaaaaatccaaagactctaatgacttgtaaagactctaatgatttgtatcatgtaatgaactaaaccacctgtaattttgtaccatatgtgtctttccatcaaatgaccaacagcttctcaataaaaccagaccatttctcacctgc

SEQ ID NO: 193 - DNA, 400 bp, Homo sapiens
  ref <308>: DATABASE ACCESSION NUMBER: AI497657
  ref <309>: DATABASE ENTRY DATE: 2001-06-18
tttttttttttgcacttatggtatttattgttggaagattgagtaccttaatgcacaccaatgctcagatgacttgggggcacataggggactgctgtcaccatgcctcactcctgcagggaaggggctgccctactaaaaccccagcgggcccagtgctgtgtccagaacaggtccttatattactgcagcccacaatggaactactgagtaggagccaaaagaggagggagcaggaagaggtggcatttggagaggggagaccgcacccacaggtctgccacagcgcgtcaacggtatggggtacttttacagtcaagttgacttcggtgtccgcccaccatctacctttgtaggaccactgaaacaagggacatccaccacggcccacagccggggc

SEQ ID NO: 194 - DNA, 4413 bp, Homo sapiens
  ref <308>: DATABASE ACCESSION NUMBER: AJ012755
  ref <309>: DATABASE ENTRY DATE: 2001-06-18
agatccttccttctctcctccttcttcattctacaccacccccaacacatatccctgcaccccgcccattctttgctctctctcctttcttacacttaactccttcttgctccacagcctaacatgctgattaacaggaccccaaaggtttgggtgggtattaggggccttctcaacaaaagcagcacactcttgagcttgttcttccttttgttgccatctcagataaaaaggccccatgagggaggagacagataagtatagacttggtattctgataactctgtgttacatgggatcagatgtaaatgagttgtaccctgtggtgtttcatgctctgctgtgttgtcttctcatggtgagcttttctgtgcccttatttcatccagctctggtttctgtgtttcatgttatttctcctagcctctgtaaactctgcagcatactaataatgctctggctttctgattaaagataaatggcttactatcatcacccctggcttgagggccagctcacatgtaatcccttataggattccaaagttgttaaataaatgcagttctttttgtcattttgaagcattcaaaaatttttcaagaaaagctatgatcatataaatagaaattttatccagaatgttacagtgtagcatttgtgaataaatgtgtaggtgctgtatttgctcagactctagtttgggttgtgttttcttttccctttttttttttgagacggggtctctctctgtcatctgggctgcagtgcagtggtgtaatcacagctcactgcaacctctactcccaggctcaagcaatcctcctgagtagctgggactggagacatgcgccacaacgcccagctaatttttaggtttttctttcacatagacggggtctcactctgttggccaggctggtttcgaactcctggactcaagcagttccccccacctcagcctcctaaagtgctgggattacaggcctgagccaccatacccagcaagttatattttctttttccttatatagagtaaaataagggtgagtgaccgagaggttgatgcatagctagatcaccagtttaaatgccttcccacacacccctttcctcctgttccctccacctacaggttgtagatgagcatgagagtgtggagcagagttggcgagtgcaagtcgagcccatcaacctggacagctgtctccgtgctttcaccagtgaggaagagctaggggaagatgagatatactactgttccaagtgtaagacccactgctttagcaacaaagaagctggatctctggaggcttccacccttcctgattattcaccttaagcgatttcaatttgtaaatgatcagtggataaaatcacagaaaattgtcaaatttcctcgggaaagttttgatccgagtgcttttttggtaccacgagacccggctctctgccagcatcaaccactcacaccccagggggatgagctctccaagcccaggattctggcaagagaggtgaagaaagtggatgtgcagagtttggctggggaagaggacatgctcctgagcaaaagcccatcctcactcagcgctaacatcagcagcagcccaaaaggttctccttcttcatcaagaaaaagtggaaccagctgtccctccagcaaaaacagcagccctaatagctgcccacggactttggggaggagcaaagggaggctccggctgccccagattggcagcaaaaataaactgtcaagtagtaagaagaacttggatgccagcaaagagaatggggctgagcagatctgtgagctggctgatgccttgagtcgagggcatatgcgggggggcagccaaccagagctggtcactcctcaggaccacgaggtagctttgggcaatggattcctttatgagcatgaagcatatggcaatggctacagcaatggtcagcttggaaaccacagtgaagaagacagcactgatgaccaaagagaagacactcatattaagcctatttataatctatatgcaatttcatgccattcaggaattctgagtgggggccattacgtcacttatgccaaaaacccaaactgcaagtggtactgctacaatggcagcatctgtgaggaacatcaccctgatgaaattgacaccgactctgcctacattcttttctatgagcagcagaggatagactacgcacaatttctgccaaagattgatggcaaaaagatggcagacacaagcagtatggatgaagactttgagtctgattacgaaaagtactgtgtgttacagtaaagctaccactctggctgctagatagcttggtggggagggagatgactccttgtagctgatacttggcaaaagtgtcactgagaggcaagctaaatgtagttattttatcctgttagaatacaaattctaattaaaatagttaactttaagagtagtagtaattttattttgaagtctcatgcaagttgtctgatagagaactttcaggcagatcccaccattagcctgtaaacaaaaagtttggcaccagccacctgggaccaaataagaattcaattgtgcttgtccagatatgaacaaatatgtagtgagtatagagtttatcaataatcataacaaatattaaagatttccttggagtcaaagtaaaaaacaaaaaattgtaatgttgtctagggatgacatgatatgctacctcctttttcctgaagttttattccattctgttgacaagatggagaaagcaagatcatgaaggtgtgcaaatgattcttacggcatgggcgaggatttttcaatttattttttaaagtttccataccctttctttgtctttcttgctttttgtttttgccgttgtgtttatgtttgagatacaaccagtcattggtggcaggggcatagagtggtcagtctgaaagggaggctctcttaagagctatgtgccttccacccagagggagacccagtagaaagaaaaacatcctgggaaatccagctaccatggccctcccagtggaggcatcttacatttaggatacttcaggtatcctcagaaatgtattctgcaccccccggccccgcccatgctgagggaaggggagcagttgccaatatttgcaccatcttcacatgcacatgttgcaacaagagcttctgggaaggtaagcggcatcggagctagatcacgtttcacaattagtggtggttcttttccatgtttgttttgcactttaaaaaagagagaacacatgcaaatgaacttgcttgtgtgtatttgatggctccaagggctataaattacaaacaaaacacatcccagacattaggagttcataagtatatttaatgaaattggtggttttaggaagtcaactttagttttgctttgtttgcatgtccactaatttttttattttgatattagtcttttttaaaaaattttacagtagtcattgaaagttatgtttctttgtttacttcattttttcctctaaatattcaagactgggacaaaagtataaatattatttatttcaggtagaatttttttggtgtagttttttaatatatacttgaaggaaatgtttcaccttatttttggtctttgtttattcatttagaccctgcaagttgattctcattaattgtcagattccactacactttcttcctcataggtagtaattaccagtgtaactaagcatttgtgttctgatatctgaggccagtaactattaatatctagttctcagagcatttggaaaggttatcttaaatggctacctaaattgaaatccttttcagaaaaaatataattgcaaataggtaggagtggcctaaattatctaatgtaataaagtcagacaaaatgcatactttatagttcaagattttcggtatataaaatctgtcctttcctacctggacatgtcccattaaaaagtggaagattttaaataatttctttacagatgttttatttaagcaggtagcacaatctactaatgttgtttgatctgtgtttgttatactggttgtaattaatttttttaattcatgaactagcggaaaatttattaaattaactattaaccacattcaccttgtaaatgactgtataaaacttgttgacaatgcactgactttagaaagatgttaatgtgcataaatagagtgtaaataaaatagtgttgatgtactgaaatatgaactgtataaaaagtattagtaattgtatatggggtgtacctgtttatctgtaactgttatccaaacaaattaaatactgtggatgcctttaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 195 - DNA, 808 bp, Homo sapiens
  ref <308>: DATABASE ACCESSION NUMBER: AJ223353
  ref <309>: DATABASE ENTRY DATE: 2001-06-18
ggggagtgtgctaactattaacgctacgatgcctgaacctaccaagtctgctcctgccccaaagaagggctccaagaaggcggtgactaaggctcagaagaaggacgggaagaagcgcaagcgcagccgcaaggagagctattcagtgtatgtgtacaaggtgctgaagcaggtccatcccgacaccggcatctcttccaaggcaatggggatcatgaattccttcgtcaacgacatcttcgagcgcatcgcaggcgaggcttcccgcctggcgcattacaacaagcgctcgaccatcacctccagggagatccagacggccgtgcgcctgctgcttccgggggagctggccaagcacgccgtgtcggagggcaccaaggccgtcaccaagtacaccagttccaagtaactttgccaagggagagacatgaagacagaggagaaatgaatgcataaaataactgataatatgaatctatacatagaacttaggaagtctcatctgcctgaaaatgactgtgtggatcccacccaaatccaactcatcctggtttgctgcacactggttcatcaaaagaaggttaccgaggggaaggaactaaaggtgtttgcacttcatgttactttttgagtttataaacataaaaacagaatttacttctgttacagacctagttactgggaattcattacttgccatggactacctttgctaagaaaagtctgaatgagaagatggcaggacgtctgaaaaaaaaagttataattaataaaatctgcggagaattgtaaaaaaaaaaaaaaaaaa

SEQ ID NO: 196 - DNA, 2478 bp, Homo sapiens
  ref <308>: DATABASE ACCESSION NUMBER: AJ224741
  ref <309>: DATABASE ENTRY DATE: 2001-06-18
ggcccacggagcccaccatgccgcgcccggcccccgcgcgccgcctcccgggactcctcctgctgctctggccgctgctgctgctgccctccgccgcccccgaccccgtggcccgcccgggcttccggaggctggagacccgaggtcccgggggcagccctggacgccgcccctctcctgcggctcccgacggcgcgcccgcttccgggaccagcgagcctggccgcgcccgcggtgcaggtgtttgcaagagcagacccttggacctggtgtttatcattgatagttctcgtagcgtacggcccctggaattcaccaaagtgaaaacttttgtctcccggataatcgacactctggacattgggccagccgacacgcgggtggcagtggtgaactatgctagcactgtgaagatcgagttccaactccaggcctacacagataagcagtccctgaagcaggctgtgggtcgaatcacacccttgtcaacaggcaccatgtcaggcctagccatccagacagcaatggacgaagccttcacagtggaggcaggggctcgagagccctcttctaacatccctaaggtggccatcattgttacagatgggaggccccaggaccaggtgaatgaagtggcggctcgggcccaagcatctggtattgagctctatgctgtgggcgtggaccgggcagacatggcgtccctcaagatgatggccagtgagcccctagaggagcatgttttctacgtggagacctatggggtcattgagaaactttcctctagattccaggaaaccttctgtgcgctggacccctgtgtgcttggaacacaccagtgccagcacgtctgcatcagtgatggggaaggcaagcaccactgtgagtgtagccaaggatacaccttgaatgccgacaagaaaacgtgttcagctcttgataggtgtgctcttaacacccacggatgtgagcacatctgtgtgaatgacagaagtggctcttatcattgtgagtgctatgaaggttataccttgaatgaagacaggaaaacttgttcagctcaagataaatgtgctttgggtacccatgggtgtcagcacatttgtgtgaatgacagaacagggtcccatcattgtgaatgctatgagggctacactctgaatgcagataaaaaaacatgttcagtccgtgacaagtgtgccctaggctctcatggttgccagcacatttgtgtgagtgatggggccgcatcctaccactgtgattgctatcctggctacaccttaaatgaggacaagaaaacatgttcagccactgaggaagcacgaagacttgtttccactgaagatgcttgtggatgtgaagctacactggcattccaggacaaggtcagctcgtatcttcaaagactgaacactaaacttgatgacattttggagaagttgaaaataaatgaatatggacaaatacatcgttaaattgctccaatttctcacctgaaaatgtggacagcttggtgtacttaatactcatgcattcttttgcacacctgttattgccaatgttcctgctaataatttgccattatctgtattaatgcttgaatattactggataaattgtatgaagatcttctgcagaatcagcatgatttttccaaggaaatacatatgcagatacttattaagagcaaactttagtgtctctaagttatgactgtgaaatgattggtaggaaatagaatgaaaagtttagtgtttctttatctactaattgagccatttaatttttaaatgtttatattagataaccatattcacaatggaaactttaggtctagtttcttttgatagtatttataatataaatcaatcttattactgagagtgcaaattgtacaaggtatttacacatacaacttcatataactgagatgaatgtaattttgaactgtttaacactttttgttttttgcttattttgttggagtattattgaagatgtgatcaatagattgtaatacacatatctaaaaatagttaacacagatcaagtgaacattacattgccatttttaattcattctggtctttgaaagaaatgtactactaaagagcactagttgtgaatttagggtgttaaactttttaccaagtacaaaaatcccaaattcactttattattttgcttcaggatccaagtgacaaagttatatatttataaaattgctataaatcgacaaaatctaatgttgtctttttaatgttagtgatccacctgcctcagcctcccaaagtgctgggattacaggcttgaaagtctaacttttttttacttatatatttgatacatataattcttttggctttgaaacttgcaactttgagaacaaaacagtcctttaaattttgcactgctcaattctgtttttcgtttgcattgtctttaatataataaaagttattacctttacatatt

SEQ ID NO: 197 - DNA, 1857 bp, Homo sapiens
  ref <308>: DATABASE ACCESSION NUMBER: AJ224864
  ref <309>: DATABASE ENTRY DATE: 2001-06-18
gacccacgcgtccggctacggagtcactacagggagaggtctcatcactagaaatagccgaagaacctgcagcctcaaccagcgttaaggaggacgtgccgtttctagggagtcttagtcggggctcaccagcttcctgcattttctgaccggctccaggaatagaaccaaaagaagctgaacaaggaagcagcgcggcaccaagaaaagcagaagtcggggccttggaggcgtgactttcccctcgggtccaggtagggcctggagctgctgcaagtgccgcctgtgctggggaagggaccatgtggctgccttgggctctgttgcttctctgggtcccaggatgttttgctctgagcaaatgcaggaccgtggcgggccccgtggggggatccctgagtgtgcagtgtccctatgagaaggaacacaggaccctcaacaaatactggtgcagaccaccacagattttcctatgtgacaagattgtggagaccaaagggtcagcaggaaaaaggaacggccgagtgtccatcagggacagtcctgcaaacctcagcttcacagtgaccctggagaatctcacagaggaggatgcaggcacctactggtgtggggtggatacaccgtggctccgagactttcatgatcccgttgtcgaggttgaggtgtccgtgttcccggcatcaacgtcaatgacacctgcaagtatcactgcggccaagacctcaacaatcacaactgcatttccacctgtatcatccactaccctgtttgcagtgggtgccacccacagtgccagcatccaggaggaaactgaggaggtggtgaactcacagctcccgctgctcctctccctgctggcattgttgctgcttctgttggtgggggcctccctgctagcctggaggatgtttcagaaatggatcaaagctggtgaccattcagagctgtcccagaaccccaagcaggctgccacgcagagtgagctgcactacgcaaatctggagctgctgatgtggcctctgcaggaaaagccagcaccaccaagggaggtggaggtggaatacagcactgtggcctcccccagggaagaacttcactatgcctcggtggtgtttgattctaacaccaacaggatagctgctcagaggcctcgggaggaggaaccagattcagattacagtgtgataaggaagacataggcttttgtcctgcctcgccatcggagctctcatgggccccaggaagtccagggacagctcccttatacctggcccacgtccttctcagcctgccctcgacaacagtgaccaacagacaggcagctgggtttcccaggccatccctctgttgccatcagcttgattggcttccccgagggccagcagggctgggggctccggagagcagcaggaagcactcccagccaccagtgcctgtcgcctctttcccctttgcccctgcttcatcccagctctgtgtgtggaggacaaagcttcttcctgcgtggctccaggaaaagatgtggctcacgtaggtggcacctgccaatagctttgtcaatcacagccccataggaacgtctggaattgcttgggagttggggagaactgtcaagaagagtgaagagagtgccaaagcggagatctgttcacctgggggccatggaggggggacccactaaagatcaagatcaaagattctccccatctcacagacaaggaaactgaggccagagggaggagagaattgctcatggctccagaactggtggcaagtttctctggactcttaggtttatttttaatatgaaatataaaaacagtttcaaatatcttaaaaaaaaaaaaaaaaaaa

SEQ ID NO: 198 - DNA, 819 bp, Homo sapiens
  ref <308>: DATABASE ACCESSION NUMBER: AJ225092
  ref <309>: DATABASE ENTRY DATE: 2001-06-18
atggccgaggtgcagctggtggagtctgggggaggcctggtcaagcctggggggtccctgagactctcctgtgcagcctctggattcaccttcagtaactatagcatgaactgggtccgccaggctccagggaaggggctggagtgggtctcatccattagtagtagtagtagttacatatactacgcagacttcgtgaagggccgattcaccatctccagagacaacgccaagaactcactgtatctgcaaatgaacagcctgagagccgaggacacggctgtttattactgtgcgagatccagtattacgatttttggtggcggtatggacgtctggggcagaggcaccctggtcaccgtctcctcaggtggaggcggttcaggcggaggtggcagcggcggtggcggatcgcagtctgtgctgactcagcctgcctccgtgtctgggtctcctggacagtcgatcaccatctcctgcgctggaaccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgcagctcatatacaaccaggagcactcgagttttcggcggagggaccaagctggccgtcctaggtgcggccgcagaacaaaaactcatctcagaagaggatctgaatggggccgcacatcaccatcatcaccattaa

SEQ ID NO: 199 - DNA, 807 bp, Homo sapiens
  ref <308>: DATABASE ACCESSION NUMBER: AJ225093
  ref <309>: DATABASE ENTRY DATE: 2001-06-18
atggcccaggtgcagctgcaggagtcgggcccaggactggtgaagccttcggagaccctgtccctcacctgcactgtctctggtggttccatcagtagttatcactggagctggatccggcagcccccagggaagggactggagtggattgggtatatctattacagtgggagcaccaactacaacccctccctcaagaatcgagtcaccatatctgtagacacgtccaagaaccagttctccctgaacctgaggtctgtgaccgctgcagacacggccgtgtattactgtgcgcgaggaacgtatggcccagccggagatgcttttgatatctgggggcaagggaccacggtcaccgtctcgagtggtggaggcggttcaggcggaggtggcagcggcggtggcggatcggacatccagatgacccagtctccttccaccctgtctgcatctattggagacagagtcaccatcacctgccgggccagtgagggtatttatcactggttggcctggtatcagcagaagccagggaaagcccctaaactcctgatctataaggcctctagtttagccagtggggccccatcaaggttcagcggcagtggatctgggacagatttcactctcaccatcagcagcctgcagcctgatgattttgcaacttattactgccaacaatatagtaattatccgctcactttcggcggagggaccaagctggagatcaaacgtgcggccgcagaacaaaaactcatctcagaagaggatctgaatggggccgcacatcaccatcatcaccattaa

SEQ ID NO: 200 - DNA, 331 bp, Homo sapiens
  ref <308>: DATABASE ACCESSION NUMBER: AJ249377
  ref <309>: DATABASE ENTRY DATE: 2001-06-18
cagtctgccctgactcagcctgcctccgtgtctgggtctcctggacagtcgatcaccatctcctgcactggaaccagcagtgacgttggtggttataaccatgtctcctggtaccaacaacacccaggcaaagcccccaaactcatgatttatggtgtcagtaatcggccctcaggggtttctaatcgcttctctggctccaagtctggcaacacggcctccctgaccatctctgggctccaggctgaggacgaggctgattattactgcagctcatatacaagcagcagcactcgggtgttcggcggagggaccaagctgaccgtcctag

SEQ ID NO: 201 - DNA, 2073 bp, Homo sapiens
  ref <308>: DATABASE ACCESSION NUMBER: AJ250475
  ref <309>: DATABASE ENTRY DATE: 2001-06-18
ggcgccaggttatgtaccagcaaagtagcgggcgcaacagccgcgccctgctctcctacgacgggctcaaccagcgcgtgcgggtgctggacgagaggaaggcgctgatcccctgcaagagattatttgaatatattttgctgtataaggatggagtgatgtttcagattgaccaagccaccaagcagtgctcaaagatgaccctgacacagccctgggatcctcttgacattcctcaaaactccacctttgaagaccagtactccattggggggcctcaggagcagatcaccgtccaggagtggtcggacagaaagtcagctagatcctatgaaacctggattggcatctatacagtcaaggattgctatcctgtccaggaaacctttaccataaactacagtgtgatattgtctacgcggttttttgacatccagctgggtattaaagacccctcggtgtttaccccttcaagcacgtgccagatggcccaactggagaagatgagcgaagactgctcctggtgagcctgtgcatagggaagcggcagcatcggatgtcagccccctgcggccccagctggagatggatatgagactagtcaagatgtgaatgctaattggagagaaatataattttaggaagatgcacattgatgtggggttttgatgtgtctgattttgactactcaagctctgtttacagaagaaaattgaatggcgagggtgtggccatatgaactgactagatggctaatatggacactttgggtatttctaatgcctgttcagggctggttttctgcatgcacgggtatacacataatgcagtgccatgcacatagggaagggtcagtaagagaagtttgccttggcagcaagtatttattgttgacattattcagaattagtgataataaaaagcagagtgattttggtcaattttattattaattcttaaattccctgcagagaatgccccctttattgctgcaccagggtgggcattgctcccactgagccctactccaccctgtccctgcactcccttggttgccaaaaaaatgataacttaaatcccttccagacttaagaattttatggcatggcccaattgatataaacatttagaaggaaatgaaaagctaaaataggaagtaattattcctctaaagaaacattttgagcaaggcagtttagagaatcctaatgtctacactggcatagcacgagccatgtaagcttcttttttttctatgcaagagtattgatgtatgtgctgaatcttcacagacttgtcaatacacaggcagtattctaaaatagccctgaacagggagtcaggagactattgtctcctaaacccaggactagagttccctcgtactgtcactcctttggtcattaaatgcactgggcttgcccgcactttggccttcctagaacgctgcttcataacctctctgtctgacttctgcatctccttccaggtcagctcattcacaagagttgctcccaagcctggatgagttgcaccttgcatcttgagcatgcatttctcacaataattattaagctgtgtgataatttctgctttcaggacactcatccattatcttggctgtgagctccttgggtacgggtaccttgtatgtttaattttatatccctagcacaaagcaagtgcctggcacatagtcagtgccctaagtatttgtagagtgaagaatgccagcctctcttgtccctggtttccttatgtgttgaatgtggttgagtttgtccattgctagggagagacttccagtaataaaatttactattctagatgcttctactgttatgttttatctacccatttatctttcttagttaccaggagaaatgtgtgacacctatattataatgaaaacaatcttattacttatagtttatctatattaaacaaatttaattgcatttaaagcattctttgatattgttgcttttgcaataaatatggataatcttggttataagggagttaaaacaatgctgtaataaataaagtgtttcatgtgatcaaaaaaaaaaa

SEQ ID NO: 202 - DNA, 3919 bp, Homo sapiens
  ref <308>: DATABASE ACCESSION NUMBER: AJ270996
  ref <309>: DATABASE ENTRY DATE: 2001-06-18
cccggaagccccggggatgctgaagaccggcgggagctgggcttgcacaggggcgaggtcaactttggagggtctgggaagaagcgaggcaagtttgtacgggtgccgagcggagtggccccgtctgtgctctttgacctgctgcttgctgagtggcacctgccggcccccaacctggtggtgtccctggtgggtgaggagcagcctttcgccatgaagtcctggctgcgggatgtgctgcgcaaggggctggtgaaggcggctcagagcacaggagcctggatcctgaccagtgccctccgcgtgggcctggccaggcatgtcgggcaggccgtgcgcgaccactcgctggccagcacgtccaccaaggtccgtgtggttgctgtcggcatggcctcgctgggccgcgtcctgcaccgccgcattctggaggaggcccaggtgcacgaggattttcctgtccactaccctgaggatgacggcggcagccagggccccctctgttcactggacagcaacctctcccacttcatcctggtggagccaggccccccggggaagggcgatgggctgacggagctgcggctgaggctggagaagcacatctcggagcagagggcgggctacgggggcactggcagcatcgagatccctgtcctctgcttgctggtcaatggtgatcccaacaccttggagaggatctccagggccgtggagcaggctgccccgtggctgatcctggtaggctcggggggcatcgccgatgtgcttgctgccctagtgaaccagccccacctcctggtgcccaaggtggccgagaagcagtttaaggagaagttccccagcaagcatttctcttgggaggacatcgtgcgctggaccaagctgctgcagaacatcacctcacaccagcacctgctcaccgtgtatgacttcgagcaggagggctccgaggagctggacacggtcatcctgaaggcgctggtgaaagcctgcaagagccacagccaggagcctcaggactatctggatgagctcaagctggccgtggcctgggaccgcgtggacatcgccaagagtgagatcttcaatggggacgtggagtggaagtcctgtgacctggaggaggtgatggtggacgccctggtcagcaacaagcccgagtttgtgcgcctctttgtggacaacggcgcagacgtggccgacttcctgacgtatgggcggctgcaggagctctaccgctccgtgtcacgcaagagcctgctcttcgacctgctgcagcggaagcaggaggaggcccggctgacgctggccggcctgggcacccagcaggcccgggagccacccgcggggccaccggccttctccctgcacgaggtctcccgcgtactcaaggacttcctgcaggacgcctgccgaggcttctaccaggacggccggccaggggaccgcaggagggcggagaagggcccggccaagcggcccacgggccagaagtggctgctggacctgaaccagaagagcgagaacccctggcgggacctgttcctgtgggccgtgctgcagaaccgccacgagatggccacctacttctgggccatgggccaggaaggtgtggcagccgcactggccgcctgcaaaatcctcaaagagatgtcgcacctggagacggaggccgaggcggcccgagccacgcgcgaggcgaaatacgagcggctggcccttgacctcttctccgagtgctacagcaacagtgaggcccgcgccttcgccctgctggtgcgccggaaccgctgctggagcaagaccacctgcctgcacctggccaccgaggctgacgccaaggccttctttgcccacgacggcgttcaggccttcctgaccaggatctggtggggggacatggccgcaggcacgcccatcctgcggctgctaggagccttcctctgccccgccctcgtctataccaacctcatcaccttcagtgaggaagctcccctgaggacaggcctggaggacctgcaggacctggacagcctggacacggagaagagcccgctgtatggcctgcagagccgggtggaggagctggtggaggcgccgagggctcagggtgaccgaggcccacgtgctgtcttcctgctcacacgctggcggaaattctggggcgctcccgtgactgtgttcctggggaacgtggtcatgtacttcgccttcctcttcctgttcacctacgtcctgctggtggacttcaggccgcccccccagggcccctcagggcccgaggtcaccctctacttctgggtctttacgctggtgctggaggaaatccggcagggcttcttcacagacgaggacacacacctggtgaagaagttcacactgtatgtgggggacaactggaacaagtgtgacatggtggccatcttcctgttcatcgtgggtgtcacctgcaggatgctgccgtcggcgtttgaggctggccgcacagtcctcgccatggacttcatggtgttcacgctgcggctgatccatatctttgccatacacaagcagctgggccccaagatcatcgtggtagagcgcatgatgaaggacgtcttcttcttcctcttctttctgagcgtgtggctcgtggcctacggtgtcaccacccaggcgctgctgcacccccatgacggccgcctggagtggatcttccgccgggtgctctaccggccctacctgcagatcttcggccagatcccactggacgagattgatgaagcccgtgtgaactgctccacccacccactgctgctggaggactcaccatcctgccccagcctctatgccaactggctggtcatcctcctgctggtcaccttcctgttggtcaccaatgtgctgctcatgaacctgctcatcgccatgttcagctacacgttccaggtggtgcagggcaacgcagacatgttctggaagttccagcgctacaacctgattgtggagtaccacgagcgccccgccctggccccgcccttcatcctgctcagccacctgagcctgacgctccgccgggtcttcaagaaggaggctgagcacaagcgggagcacctggagagagacctgccagaccccctggaccagaaggtcgtcacctgggagacagtccagaaggagaacttcctgagcaagatggagaagcggaggagggacagcgagggggaggtgctgcggaaaaccgcccacagagtggacttcattgccaagtacctcgggggtctgagagagcaagaaaagcgcatcaagtgtctggagtcacagatcaactactgctcggtgctcgtgtcctccgtggctgacgtgctggcccagggtggcggcccccggagctctcagcactgtggcgagggaagccagctggtggctgctgaccacagaggtggtttagatggctgggaacaacccggggctggccagcctccctcggacacctgagctgcttggcctgccacgtgtggggccacctctcctcagctggccaccctgcacgttgtgcactgacctttgccgacctccagcggaaccccccagggggcaccagccccccagcagacaatggccctcctggtgcctcaccacagaccctcacccaaaggaaccgctccttgtccctcctggcctccccggaggcacagcagtgtcatggggctgtctcccctgacaggcacaactccccgggcagaaaacgtgccccaccgcatccctacctggaaactgaccagcctgcactgtggaaaagctggccctgtggcgtgacgggggagcacccccatccagactgcgaagctgctctggggtctgcacccacccctgccctgacttgtgttgcctgacaagagactcatctttttttgaaaaaaaaaaaaaaaaaaaa

SEQ ID NO: 203 - DNA, 1956 bp, Homo sapiens
  ref <308>: DATABASE ACCESSION NUMBER: AJ272057
  ref <309>: DATABASE ENTRY DATE: 2001-06-18
ggtggccctgagcgccggcgacacctttcctggactataaattgagcacctgggatgggtagggggccaacgcagtcaccgccgtccgcagtcacagtccagccactgaccgcagcagcgcccttgcgtagcagccgcttgcagcgagaacactgaattgccaacgagcaggagagtctcaaggcgcaagaggaggccagggctcgacccacagagcaccctcagccatcgcgagtttccgggcgccaaagccaggagaagccgcccatcccgcagggccggtctgccagcgagacgagagttggcgagggcggaggagtgccgggaatcccgccacaccggctatagccaggcccccagcgcgggccttggagagcgcgtgaaggcgggcatccccttgacccggccgaccatccccgtgcccctgcgtccctgcgctccaacgtccgcgcggccaccatgatgcaaatctgcgacacctacaaccagaagcactcgctctttaacgccatgaatcgcttcattggcgccgtgaacaacatggaccagacggtgatggtgcccagcttgctgcgcgacgtgcccctggctgaccccgggttagacaacgatgttggcgtggaggtaggcggcagtggcggctgcctggaggagcgcacgcccccagtccccgactcgggaagcgccaatggcagctttttcgcgccctctcgggacatgtacagccactacgtgcttctcaagtccatccgcaacgacatcgagtggggggtcctgcaccagccgcctccaccggctgggagcgaggagggcagtgcctggaagtccaaggacatcctggtggacctgggccacttggagggtgcggacgccggcgaagaagacctggaacagcagttccactaccacctgcgcgggctgcacactgtgctctcgaaactcacgcgcaaagccaacatcctcactaacagatacaagcaggagatcggcttcggcaattggggccactgaggcgtggcgcccgtggctgcccagcaccttcttcgacccatctcaccctctctcattcctcaaagctttttttttttttcctggctggggggcgggaagggcagactgcaaactggggggctgcgtacgtgcaggaggcgcggtggggctgcgtggaggagggggccacgtgtgagagagaagaaaatggtggccggagatgggagggcccaaggaacctcctgggagggggcctgcattctatgttggtgggaatgggactgggctgacgccctgcattcagcctgtgcctttcctggggtttcttttctgttcttttcggaggagagggcccgagaaggggccataccagggcgcggcgctgggttgccacacttgggaaagcagcccggagctgggtgctggggaaggcggggcgcgtagcctcccgccgccctgcggttgggccggtggaggcccaggcgttgctaggattgcatcagttttcctgtttgcactatttctttttgtaacattggccctgtgtgaagtatttcgaatctcctccttgctctgaaacttcagcgattccattgtgataagcgcacaaacagcactgtctgtcggtaatcggtactactttattaatgattttctgttacactgtatagtagtcctatggcacccccaccccatccctttcgtgccactcccgtccccacccccaccccagtgtgtataagctggcatttcgccagcttgtacgtagcttgccactcagtgaaaataataacattattatgagaaagtggacttaaccgaaatggaaccaactgacattctatcgtgttgtacatagaatgatgaagggttccactgttgttgtatgtcttaaatttatttaaaactttttttaatccagatgtagactatattctaaaaaataaaaaagcaaatgtgtcaact

SEQ ID NO: 204 - DNA, 873 bp, Homo sapiens
  ref <308>: DATABASE ACCESSION NUMBER: AJ275978
  ref <309>: DATABASE ENTRY DATE: 2001-06-18
ccagggggcaatgctggcggcccaggagaggcgggtgccacgggcggcagaggtccccggggcgcaggggcagcaagggcctcggggccgggaggaggcgccccgcggggtccgcatggcggcgcggcttcagggctgaatggatgctgcagatgcggggccagggggccggagagccgcctgcttgagttctacctcgccatgcctttcgcgacacccatggaagcagagctggcccgcaggagcctggcccaggatgccccaccgcttcccgtgccaggggtgcttctgaaggagttcactgtgtccggcaacatactgactatgtcagttcaggaccaggacagggatggggcctgggtgggtggcggtcacagcgtggcagggtgggggctgggatccgcctacaccccacggtcaggctgctagaaacctgggaacaccccagcacagggtctcagaacagagacctggtacaccaggcccgccgccacccgagggagcccagggagatgggtgcagaggtgtcgcctttaacgtgatgttctctgcccctcacatttagccgactgactgctgcagaccaccgccaactgcagctctccatcagctcctgtctccagcagctttccctgttgatgtggatcacgcagtgctttctgcccgtgtttttggctcagcctccctcagggcagaggcgctaagcccagcctggcgccccttcctaggtcatgcctcctcccctagggaatggtcccagcacgagtggccagttcattgtgggggcctgattgtttgtcgctggaggaggacggcttacatgtttgtttctgtagaaaataaaactgagctacgaaaaaaaaaaaaaaaaaa

SEQ ID NO: 205 - DNA, 1111 bp, Homo sapiens
  ref <308>: DATABASE ACCESSION NUMBER: AJ276429
  ref <309>: DATABASE ENTRY DATE: 2001-06-18
gcggccgcgaattcggcacgagcagagagcaatatggctggttccccaacatgcctcaccctcatctatatcctttggcagctcacagggtcagcagcctctggacccgtgaaagagctggtcggttccgttggtggggccgtgactttccccctgaagtccaaagtaaagcaagttgactctattgtctggaccttcaacacaacccctcttgtcaccatacagccagaagggggcactatcatagtgacccaaaatcgtaatagggagagagtagacttcccagatggaggctactccctgaagctcagcaaactgaagaagaatgactcagggatctactatgtggggatatacagctcatcactccagcagccctccacccaggagtacgtgctgcatgtctacgagcacctgtcaaagcctaaagtcacattgggtctgcagagcaataagaatggcacctgtgtgaccaatctgacatgctgcatggaacatggggaagaggatgtgatttatacctggaaggccctggggcaagcagccaatgagtcccataatgggtccatcctccccatctcctggagatggggagaaagtgatatgaccttcatctgcgttgccaggaaccctgtcagcagaaacttctcaagccccatccttgccaggaagctctgtgaaggtgctgctgatgacccagattcctccatggtcctcctgtgtctcctgttggtgcccctcctgctcagtctctttgtactggggctatttctttggtttctgaagagagagagacaagaagagtacattgaagagaagaagagagtggacatttgtcgggaaactcctaacatatgcccccattctggagagaacacagagtacgacacaatccctcacactaatagaacaatcctaaaggaagatccagcaaatacggtttactccactgtggaaataccgaaaaagatggaaaatccccactcactgctcacgatgccagacacaccaaggctatttgcctatgagaatgttatctagacagcagtgcactgcccctaagtctctgctcaaaaaaaaaacaattctcggcccaaagaaaacatacagg

SEQ ID NO: 206 - DNA, 4670 bp, Homo sapiens
  ref <308>: DATABASE ACCESSION NUMBER: AK000004
  ref <309>: DATABASE ENTRY DATE: 2001-06-18
ggctctactttgaacctgctgggcaaggaagagattttcaaggaaaccatctaccgtgtgcaagctcctgccggccaaccccagaccccagcacggagccaggcgcctgtgcccgccgaccctcagcatcctcctcagaaaggctggtggcatcaggaagcccctggccagcctccacctgagcccagtgagctcagctttaaggatggagtcaggcagggggtcctcaacccctccaggacccattgctgccctagggatgccagacactgggcctggcagttcctccctagggaagcttcaggcgctccctgttgggcccagagcccactgtggggaccctgtcagcctggctgcagcaggggacggctctccagacataggccccacgggagagctgagtggtagcttaaagatccccaaccgggacagcgggatcgacagtccctcctccagtgtggctggagagaactttccctgcgaggagggcttggaggctggcccaagccccactgtactgggggcgcacgcagagatggccctggacagccaggtcccgaaggtcaccccccaggaggaggcggacagcgacgtgggtgaggaacctgactctgagaacaccccccagaaggctgacaaggatgccggcctggcccagcactctggcccccagaagcttctccacattgcccaggagctcctgcacaccgaggagacctatgtgaagcggctgcacctgctggaccaggttttctgcaccaggctgacggatgcggggatccctccagaagtcatcatgggcatattctctaacatctcctccatccaccgcttccacgggcagttcctgctgccggagctgaagacgcggatcacggaggagtgggacacaaacccacggctcggggacatcctgcagaagctggccccattcctgaagatgtacggcgagtatgtcaagaactttgaccgagccgtagggctggtgagcacgtggacccagcgctccccactgtttaaagacgtcatccacagcatccagaagcaggaggtatgcgggaacctgacgctgcagcaccacatgctggagcccgtgcagagggtcccccggtacgagctgctgctcaaggactatctgaagaggctcccgcaggacgccccagaccggaaggatgcggagaggtccttggagctcatctccacagccgccaaccactccaatgctgccattcggaaagtggagaaaatgcacaagctcttggaggtgtacgagcagctgggtggggaagaagacattgtcaacccggccaatgaactgatcaaggagggccaaatccagaaactgtcagccaagaacggcaccccccaggaccgccacctcttcctgttcaacagcatgatcctttactgtgtgcccaagctgcggctcatgggccagaagttcagcgtccgggagaagatggacatctcaggcctccaggtgcaggatatcgtcaagccaaacacagcacatacattcatcataacgggaagaaaaaggtccctggagctgcagacgcggacagaggaagagaagaaagaatggattcagatcatccaggccaccatcgagaagcacaaacagaacagcgaaaccttcaaggcttttggtggcgcctttagccaggatgaggaccccagcctctctccagacatgcctatcacgagcaccagccctgtggagcctgtggtgaccaccgaaggcagttcgggtgcagcagggctcgagcccagaaaactatcctctaagaccagacgtgacaaggagaagcagagctgtaagagctgtggtgagaccttcaactccatcaccaagaggaggcatcactgcaagctgtgtggggcggtcatctgtgggaagtgctccgagttcaaggccgagaacagccggcagagccgtgtctgcagagattgtttcctgacacagccagtggcccctgagagcacagaggtgggtgctcccagctcctgctcccctcctggtggcgcggcagagcctccagacacctgctcctgtgccccagcagctctagctgcctctgctttcggagtgtccctgggaccaggatagatgtgggtgtgtctcagtggggcccccaggctgggaacacactcggaagatcccgtgtgtgcacgctggcttctcgggaccagccagggccaaggcttgggaaccatttgcatccaggagttagatgggaacaagtgtcactcctggtcacctggttggagggcatggattgaagctgccctcaagtccaggccttgaggcccacctgaggggagatactgcccttctctctgcctgcctcacctccagctgtcagagggtgagcagggccctggaggcaggcaccccctcctcctcctccccgtccccttctcctcctcctccccgtccccttctcctcttcctctccctccttcctctccctccgcctcgctgtctttctccttctcctctccctcctcctcctgctccttctcctccccgtaccctttttctactcttccctctccttctcctcctcctttctctccctcctcctccccctccccttctcctcctctctttctcttcctcttttcctcctccactcctctttctgagagtagctgctgctttccctgccttccttcctcaagaatacagtctattctggggggttgcaggacagctgaaaaagaaaacgtgagtttccagaaaagcacatcgccctttctctccactcgacacagcctgcggtttgcagtgccagctgcacgttggagtctcctgggaagcttctagtgttgatctccctcctagaggctcagtgaggtgatcggggggtcagtgtgttttcagagtcccagctgctctgacttacagctgtggttggagccctgacctaggtccttggtctaagaagtcaaggatgtaagtctattaggactgagtgttgaatggtcttgatggtgaagaaggaccttgcactgcctaccgagctccctcatgcctgcaatttaaataccgaggtgtgttctgagagccccaggtccttggggcacgggcctccagggccctgtaaggtggactctggcctcgaaggggggcccaggtctgaggggtccagctctggcagggggtgtctaagccacgtccaaatggtggacagtagctccaacagtgacatgacagagggagggcctgtgtgtgtggtgtgtgtgtgtgtgctgtgtgtgcacgcacgtgcatgtatatggtgtgtgtagaactgacacgcttgaagtccctgtcccgtgacccaccctcaggtacttgctgttgggttttcctatgattttgatgtgtcctgacccagcatatggatgccctccccttggagggcccagcctgcaaaccccatctgataccacacatgcctatgtcctgcaggcttctagtgacccttgcaagccgggtgaggctggtcccagtctctgtgcagatcttggccatgtctccacagccagctccccccaagcagtggccctggccctaccccagcctcctcagaacaggggtgaccactgcaggggagactgcccctaacctgtgtctttgtgtccccagaagacacccactgcagacccccagcccagcctgctctgcggccccctgcggctgtcagagagcggtgagacctggagcgaggtgtgggccgccatccccatgtcagatccccaggtgctgcacctgcagggaggcagccaggacggccggctgccccgcaccatccctctccccagctgcaaactgagtgtgccggaccctgaggagaggctggactcggggcatgtgtggaagctgcagtgggccaagcagtcctggtacctgagcgcctcctccgcagagctgcagcagcagtggctggaaaccctaagcactgctgcccatggggacacggcccaggacagcccgggggccctgcagcttcaggtccctatgggcgcagctgctccgtgagctgagtctcccactgccctgcacaccaccacattggacctgtgctgtcctgggaggtggtgttggaggccccatgaagagcgccctggactgctgagggtgggccaacagcccagagctcaggacatttggctttggggggaaggaaactgaggcccagagaggggcaaccactggccaagggtcacccagcaagttttggctaagagcctggcctccagccccagcagtgtggcccagagcaggggccgactgccaaagtaaccatcatccatatgggccgtgtggtgatgctggcccggaaggcagaaagaggcagcatgggcactgccagggacagccacatcctgctggtctgcagcgtggtccaccccgcctctgcccagcctgtctacaccgtgtgagctgaatcgtgacttgcttcccacctcctttctctgtcctctcctgaggttctgcctgcagcccccaggaggtgggcctgccccatcctagctggactcatggttcctaaataaccacgctcagaagctctgctaggacttaccccagccactgagtggcaggcgcatgagatttgtggctgttcctgatgctagtggcacacagtgcttatctgcataaataaacactggccaccagc

SEQ ID NO: 207 - DNA, 4706 bp, Homo sapiens
  ref <308>: DATABASE ACCESSION NUMBER: AK000005
  ref <309>: DATABASE ENTRY DATE: 2001-06-18
cgaccgcggagcccagcgggcgcgcgttgcggttgtctaccccgggaccccggcccagcggggctcgggaccgcgcgccgggagctgcggggccaccctccgggcagatcggtaatagagccctccgtctgggggagcgcacccccgcggccgtggaaaagcgggggccatacatggtgacgcgcgcaccctccattcaagccaagctgcagaagcaccgggacctggccaaggccgttctgcggagaaaaggcatgctgggggcctcgccgaaccgcccagactcttcagggaaaaggtctcagcaggcgccacctcctctgtgccagcagctttagagaaggctttaatccccaggacggaggcagggtgctctggtttaaggccgagctagcgattcccctgatgcaacctgtcaggttcactatctttaaaatgggaagaggaacaatctctcttttcctttaaggatgtgataggatcagataaagggcttcggaataagggagttctgtgagtgcacaggctcattcactatcattctcctcctctgttagggaggagaatggtggctggagtccccagcaatgaggacgaagagcagtgtgggaatggctagacctgtttttgtttgtttgtttttaacagaatagtaaactcggagctgcatagaaccttattcagtgcctccttttacagatgagggttgaaactcggagaagtgaaggttaaccctaaccttttacccaaagacttgcagtttttgtgtcctctgattaaataagtggggagagggtgcttttcctagatcaggcaaggggaggtgtgcttttttccaagacctatgggaggagtagaatacaggccgggcgtggtggctcacgactgtaattccagcactttgggaagccgaggcgggtggatcacttgaagtcaggagttcgagaccagcctggccaacatggtgaaagcccgtctctattaaaaatacaaaattagctgggcacgcctgtagtcccagctactcaagaggctgaggcaggaaaatcacttgagcatggtaggcggagattgcagtgagccgagatcgcgccactgcactgcagcctgggtgacagggccagactctgtctccaaaaaaagaaaaaaagaatgagaacatacacattctgaggcactgtagccaggtacatggagctgcaggcagtggtggctgtgaccagggagaaggcaagtcagtagtgcagtcaattctttctccttcagggcgaggactctgcctatccctgtgaaatgcctatgctttcatctatgtttggtctcttctcccccgtctcccctcaggtcagtgaagtttaacaagggctatactgctcttagccagagtccagatgaaaacctggtgtccctcgactctgacaggtgagtgctccccttggaaatacccccttgggaagcaacttggctgggactgaagatcgcctgatgcctttgcttgttccctgtctcctccaaggcccttcatgtacattccagggccgttctcttctgaacaatatcccttcccaggatggcttggttagaagactcataggtaatcgtgctgctctagaattcggagcaccaatgtccgggggatcatcctgccctgttatgtttgcattgttagtgagagtgaccctgtccctgccagaaccaattgagggaaccagtattattcaaggcctgttcggacttgagttctgttgtgtgtggcctttgcttcaaaagtcttccagatgcccttgcatgctctccgcctgatgatttacagctgtgcaccacaggtacctcccggaactgactgttttcctcttctcctagtgatggggagctgggatccagatactcctccgggtattcatctgcagagcaggtgaaccaggatgtgagccggcagctgcttcaggatgggtatcacctggatgagattccagatgacgaggacttggacctcatcccccctaagcccatggcctcttcaacatgctcctgctgctggtgctgtcttggggactcttcttcctgtaccctccagtagacattaccctccaaggtgggccctgctcaccatgaggcctacagagccctgttggccactcatagctcacacagtgcagtgagcactgaagtcactgacccctagaaagtgacctgcaggtagcccttacctgttgcttctcaggccagaggcccccatctgggctgtgggctgataggtagaattctgtagttttcctctgctgttggagcagagtttggagaagtcactttaataagggcaagacagaaaattctggttcttatggtgggtgacaaaggtggctaaggaaaacacttgcagacagcttgattggtatttgtcatagtgcttcagggaggcaaaaagggagctcttgtgcccaggctgtgctagatagtgttgaatggaggcagaaaatagcactttatggtttattatagctggcaatccaaaaaagaaactgtttgagaccagttcgagaaattccatttgctctattcttcctagctctaagatggtttgcaggcttgaccttcaagacagcataaagtgagtccttttgtccctcttcaggttgcacctgtctaactatgacagggatcatagcaggttgcttaatgatacagcaggatcctggcttccagaatccctggacctggggcatccccaactggtccaaccgtccgggtgagtttagtgattctggtttgcccttccctagttagagaaaaactgctctgacatgttcatatttatttatttgtatttccttggtctgggtgagtttcttcacccagtctttgagctaaagattaggtcgaaggtactggggctggccccagaagcctgcagtttttattattaccagcagagggagctacagggagcagtccggtgccttcctattgtttactttttaaacttttgagaagtagcaatggactcgtgagagtgggtatacagctgtgtgggctttgtcctagactgaggcttacagacaggaagggtaagagagacctaagccagctcctagacccttgcctgaggaaatcagtccaccagtgtagagggcctcccttcactccagcatggaccattctattgccagattcttctggtcacagcatgggccttactggatactcaggattgggctttaagcagacctctgggtgtgacacagcctctttcagcccccagcccaaacagcagaaataggcataatttctgctgtgacaccccctacccacaaattggagagtatatcttgctatactctataccaagcctctttctagaatttttccaacaggttttgttttgttttttggcttaactcagaaccatggtgagcgttctgctttgttttgttggagacagggtctctgtcacccaggctggagtgcagtggtgtaatcacagctcactgcagcctcaacctcccaggcccaagcagtcctcccacatggtgagctttgaatgggcatagacagggttcccagcccaatagtcgggattggggtataggttctacatgggaaagtatccagtctcttgctttactcagtgtcctgtgaccaccagaggcatgagagggacaacacactcttttcgctctaccacaaggggtgactagaagatgagcaagtctaataaaaagatacggccttatttgttatttgtctgacaaccatccttacgatggtaatcctgtgagtgcctgatggacatctatctttgtgtttttctcaaaccatggaaggttgagaggaatatacagtatctgggggctgacttactctactagctaggagcatcacagcagagagataggacagagaccagagtcatgccagcttggggtcttgggaagagaggcagatggttactctgttctggaatgggactctgcagctctatgcagtggccaacattctgagcactttgtgcaaatgcttgtagagctcaagaacgtctccatccagaaccccttccccatctgcagagaccatgtccaggcctttcttgtgtctgcagaggtgaagtgcacatgtggaaagggatcaaatgtagcacagtgtaaagaaagacagcaacacaggtagagggacccagtgtgtgctgggaggtggctgtggaaggtaagtatagacctacatctctgttggggaggtggtcagggcagaatggcctgggtgtttagcagcttctaggggtgagggtggcaggaccccaaaaccaaggccctctgcatcgttgttgtaataatcagctctggcatattcagctgcaactgtccctgaagaagaggtttctgagctggctgaccccatgtaggagggtgttaccttgtagaaaaagctggagggacctggtgggacagtgcagtgaggcagggtagaaatggtcagttgtttagggccagtggccacataccaaaataccaccaatgtgcccagggccaaactgccttaattctgagtgctgtgtgttctgcaggtgacagtttcctgaggagaggggtgtatccaggcttacctcccagcaggagtggtaccatatggtgtttatgtactactctatagaactcttggcttgcacttctacagctctgtacatttataagaataaatgcaatcacact

SEQ ID NO: 208 - DNA, 2127 bp, Homo sapiens
  ref <308>: DATABASE ACCESSION NUMBER: AK000106
  ref <309>: DATABASE ENTRY DATE: 2001-06-18
aagtcatgtttatatattgctgcaaatactcggaatggggatctcttgttccctgcttaagaccacatcacattacttggttttgtacgctagtggctgaaccaaaaaaagtaggagatgattttttttcttttttcttaaagcagtagcttttgaaccttgaccatgctttctaaccagctgaggggcttttgaaaaagagggtgccttactgtgccccagaccaggacaatcagtatttctggggaatggagcctggcacacacacatttcttaaagctcccttggcaattctgaggagtggattacatgttgtatgtagctcgtaacgaaagaaatcttgtctttgctctcagacccccatttcttactcatctcatgagctccttcgagatccagaaacagttgcatatttcattagtaaatcagttccagagtcacattttatttcacaagttagtccattaaaagtttcctgcagtgaggaaatagccagaaagaacactccacccctcctcctttttataactatagggtctggctcgacagagcaggagcatcgccatcttggacaagcccctcattctaaagttcaccttaataaaaaactgcctaaattcaaactgcatcagcctaatggctaaggtcagcatgaccataaaccacaaataacatctccaaccggaaacattcgaaactcctcctcgaccagagacatgctagtcccgagataacccccctccagcagggaggatgccagtctcgggataacctctctctggccagaaagatgcctgccccaagataaacttgcctcctcccagagatattccaaccctgccataaaacttctccctcaaacaggaacattccaaaattctgataatctccctcaccctaaaaccaatatatactcctagtctgtaagagaaagcgctcttgaccaaaattcaccaggagtgcctcccaggttttaactaaagaaaacctctctttaactgccaaaaaaaaaaagggaaaaaaaaaagctttctgcagtggctttcagcgggcccagcatggcagcagcacctgagaacctgttggagatgcacactcttggaccccaccctggcctctgagtaagacactggaagggcaggccccggtctgtgcacacaagtcctcagggagattctgactgatgcatgccagattttgagaactgctgatatactccaggcacatcgcatgctgggatctagatacaccaagggaacaaaataactgcacttgtcctctggggaccgacttaccttttggaagggctgagaaagagagacacatacaagatcactccctgtaatgcaatgttttataacagatgtgatttgggatttcagtgggagcccaaaagagggactgactaattcagcctctgtgacaaggggagtttctcagaaacagaatgcttagctgggcctccaggcacagggacaggaatgaggaaatacttgtaggccctgtgctccttcagcaaaaccctcagtttcttgttatttttataaatgcaaacatcttattaaagtagatgctaaggcattagaatttcctgctttatttttctaaatgaccatgaggaaacctggaatgtcaaaggtaaagtgcaacacattctgcatttaaaaattaaaatgatcctttttaaaagtagcaaccagatgtgaaaaattggactggagtccaggttatagttgatagctttaactttctccccaacagcaacagcacaattttccctaaaatgtgttatgaataagtaaaatgactacttcacatcctttaactcttcctacagaaatctaagagagaaatgaaacaaaagtttgcacagttctagacacgataaatacatgtgaaatcacacaactcagaaaatgtcccttaaattaattgagccattggtacttgtgaattagaagagacatctatgttctgatccactgttgaaagctgtacaatgttacctatttatttgcagacatcctttggaaacaaataggtagatttgcaacaaataaagagtggagtacagctgctgacattaccttgtatattcatgcctttatgtaaaaaaaaaaaaaaaaa

SEQ ID NO: 209 - DNA, 2260 bp, Homo sapiens
  ref <308>: DATABASE ACCESSION NUMBER: AK000142
  ref <309>: DATABASE ENTRY DATE: 2001-06-18
acttatggatgcgggcaatatcaaccggaccaccgcagcgactgggatgaacgacgtcagtagcaggtctcatgccatcttcaccatcaagttcactcaggctaaatttgattctgaaatgccatgtgaaaccgtcagtaagatccacttggttgatcttgccggaagtgagcgcgcagatgccaccggagccaccggggttaggctaaaggaagggggaaatattaacaagtccctcgtgactctggggaacgtcatttctgccttagctgatttatctcaggatgctgcaaatactcttgcaaagaagaagcaagttttcgtgccttacagggattctgtgttgacttggttgttaaaagatagccttggaggaaactctaaaactatcatgattgccaccatttcacctgctgatgtcaattatggagaaaccctaagtactcttcgctatgcaaatagagccaaaaacatcatcaacaagcctaccattaatgaggatgccaacgtcaaacttatccgtgagctgcgagctgaaatagccagactgaaaacgctgcttgctcaagggaatcagattgccctcttagactcccccacagctttaagtatggaggaaaaacttcagcagaatgaagcaagagttcaagaattgaccaaggaatggacaaataagtggaatgaaacccaaaatattttgaaagaacaaactctagccctcaggaaagaagggattggagttgttctggattctgaactgcctcatttgattggcatcgatgatgaccttttgagtactggaatcatcttatatcatttaaaggaaggtcagacatacgttggtagagacgatgcttccacggagcaagatattgttcttcatggccttgacttggagagtgagcattgcatctttgaaaatatcggggggacagtgactctgatacccctgagtgggtcccagtgctctgtgaatggtgttcagatcgtggaggccacacatctaaatcaaggtgctgtgattctcttgggaagaaccaatatgtttcgctttaaccatccaaaggaagccgccaagctcagggagaagaggaagagtggccttctgtcctccttcagcttgtccatgaccgacctctcgaagtcccatgagaacctgtctgcagtcatgttgtataaccccggacttgaatttgagaggcaacagcgtgaagaacttgaaaaattagaaagtaaaaggaaactcatagaagaaatggaggaaaagcagaaatcagacaaggctgaactggagcggatgcagcaggaggtggagacccagcgcaaggagacagaaatcgtgcagctccagattcgcaagcaggaggagagcctcaaacgccgcagcttccacatcgagaacaagctaaaggatttacttgcggagaaggaaaaatttgaagaggagaggctgagggaacagcaggaaatcgagctgcagaagaagagacaagaagaagagacctttctccgcgtccaagaagaactccaacgactcaaagaactcaacaacaacgagaaggctgagaagtttcagatatttcaagaactggaccagctccaaaaggaaaaagatgaacagtatgccaagcttgaactggaaaaaaagagactagaggagcaggagaaggagcaggtcatgctcgtggcccatctggaagagcagctccgagagaagcaggagatgatccagctcctgcggcgtggggaggtacagtgggtggaagaggagaagagggacctggaaggcattcgggaatccctcctgcgggtgaaggaggctcgtgccggaggggatgaagatggcgaggagttagaaaaggctcaactgcgtttcttcgaattcaagagaaggcagcttgtcaagctagtgaacttggagaaggacctggttcagcagaaagacatcctgaaaaaagaagtccaagaagaacaggagatcctagagtgtttaaaatgtgaacatgacaaagaatctagattgttggaaaaacatgatgagagtgtcacagatgtcacggaagtgcctcaagatttcgagaaaataaagccagtggagtacaggctgcaatataaagaacgccagctacagtacctcctgcagaatcacttgccaactctgttggaagaaaagcagagagcatttgaaattcttgacagaggccctctcagcttagacaacactctttatcaagtagaaaaggaaaaaaaaaaaaaaaaa

SEQ ID NO: 210 - DNA, 1986 bp, Homo sapiens
  ref <308>: DATABASE ACCESSION NUMBER: AK000168
  ref <309>: DATABASE ENTRY DATE: 2001-06-18
gttttctcatttgcaaccacccatgctggcatgaaagaaagtgaagctgctgggttgaactccatcttctgggggacatttgcagcctgcaggggcctggcaatcttttttgctacctgtttacagcctggaaccatgattgtgttgagcaacattggcagcctgacttcatctttatttctggtgctttttgacaagaacccaatttgtctctggatagcaacttcagtgtatggggcttcaatggcaaccacatttccgagtggtgtttcttggattgagcagtacacgaccatccatgggaaatctgcagcattttttgtaattggtgcttccctgggagaaatggctattcctgcagtcattggaattcttcaaggaaaataccctgatttgcctgtagttctgtatacctctttgggagcatcaatagctactggtattttatttcctgtgctatataaattagccacttcacctcttgatcgccagcgaaaagaagacagaaagagtgaggaccagaaagctctgctctctagctccgggctaaatgaatatgaggaagagaatgaagaggaggatgcagaaaaatggaatgaaatggattttgaaatgattgaaacgaatgatacaatgaggcattctataatagagacatctagaagtagtctgacggagcccacagctgaagtctataatcaatacccatcaaatgcactggtgtttgagtcttctccttttaatactggcagtgcccatgtgaagcacttgccagaaaccaggacaaaagggactaacgtttagagaagatggattactcactgacatctttgaataactgccacttctaaggacgccattcagagcagagcattagcagaatttcaccatgctttggggattaaaatttttaggtccatattatagcaaatgctaaaaatttttgaaatgttctgtaattcccagagtcttccataaataaccaaatggtctcatacacgtacaataggatcttgttataacgctatcatttgacatgtgactgattaggaaatattttatggtctccacccctcagagcacccaaagaaggcattgtttttgagaaggggggtattctcagaatgagaccatgtaggagttgaattgattggttgaacaaattatcaggtatcaatatttttccaggaaagttgaggagaatagtttcataaaagagaaatgggccgggattacaggcttgagcccccgcgcccagccatcaaaatgctttttatttctgcatatgttgaatactttttacaatttaaaaaaatgatctgttttgaaggcaaaattgcaaatcttgaaattaagaaggcaaaaatgtaaaggagtcaaaactataaatcaagtatttgggaagtgaagactggaagctaatttgcattaaattcacaaacttttatactctttctgtatatacattttttttctttaaaaaacaactatggatcagaatagccacatttagaacactttttgttatcagtcaatatttttagatagttagaacctggtcctaagcctaaaagtgggcttgattctgcagtaaatcttttacaactgcctcgacacacataaacctttttaaaaatagacactccccgaagtcttttgttcgcatggtcacacactgatgcttagatgttccagtaatctaatatggccacagtagtcttgatgaccaaagtcctttttttccatctttagaaaactacatgggaacaaacagatcgaacagttttgaagctactgtgtgtgtgaatgaacactcttgctttattccagaatgctgtacatctattttggattgtatattgtgtttgtgtatttacgctttgattcatagtaacttcttatggaattgatttgcattgaacacaaactgtaaataaaaagaaatggctgaaagaaaaaaaaaaaaaaaaaaaaaaaaaaaaaaaa

SEQ ID NO: 211 - DNA, 1767 bp, Homo sapiens
  ref <308>: DATABASE ACCESSION NUMBER: AK000174
  ref <309>: DATABASE ENTRY DATE: 2001-06-18
tggttttctgttctgtgttagtttgctaaggataatggcctccagctcagatggaatatctctatcatatagacctgttgttacagggcaggatcggatgatggacactgaagtcctcagcttgctaagttcagttgctctccctagcctccttttggcttcagagtcttttgattccatctatcctggtattttttgtgtgctgatgtttagttctggattggtttcagctgtgctaataggaagggcgttgtcttttcaagcaatcttaaaaggtggtcaatcaaaaggccagagtctgaatcccttctgtggcttaaataatttgaggatcaagtccagtgtcttgttaatccctgtcctactgtgccagacactatcttgaatgcttttatatgttcaggttcaaaaccgctctttcataccaggggatgatagtaacgtgtaacttgcaatagattccttcatcttagtaataagatgatcagtctagttaggacaaaatagagattgaataaattaacttttccaagtttacagagtaaaaatgagcagatctctgcctggttttgtgaaaaagagttagcactggtaaatagaatatttctactcctacaccattctttcagtatatcatcactgaagacaggaagataggcacacagattcttcctcgtagtaattcatagtgcactaggtgaaagagatgaagtatgtattaaaagtacaatgtgatggcatttattattcagataatcccaggattctagaagaaaataaagaagagtgacagttcagttagggtgtgaacttccagaggagcactgcttaagctgaacttgagagcattgtgcaaaagcacagtagtctgttaagaactagaaataacctagcttgtgccacttcgggagtattaagacataagcctggaaaggtaggcaaaggttagatcttagactgtcttgtatttttctcattcctgttgattacctacctcaaaattgaatatgtttttcctcctgcctaacacaaaactacccaagggcagaaatttaaattcttccttggtgtatgtgcaaagaaggttgaatatattcatgcctaccttattttggactaggaatacagtagtatactttccgaagacttgcctgaatagtatataaggtggaggcaactgactagttaggtcagtatttttagaaactcttaatagctcatactcttgataccaaaagcagccctgattgttaaagcacacacctgcacaagaagcagtgatggttgcatttacatttcctgggtgcacaaaaaaaaattctcaaaaagcaaggacttacgctttttgcaaagcctttgagaagttactggatcataggaagcttataacaagaatggaagattcttaaataactcactttctttggtatccagtaacagtagatgttcaaaatatgtagctgattaataccagcattgtgaacgctgtacaaccttgtggttattactaagcaagttactactagcttctgaaaagtagcttcataattaatgttatttatacactgccttccatgacttttactttgccctaagctaatctccaaaatctgaaatgctactccaatatcagaaaaaaagggggaggtggaattatatttcctgtgattttaagagtacagagaatcatgcacatctctgattagttcatatatgtctagtgtgtaataaaagtcaagatgaactctcaaaaaaaaaaaaaaaaaa

SEQ ID NO: 212 - DNA, 2609 bp, Homo sapiens
  ref <308>: DATABASE ACCESSION NUMBER: AK000345
  ref <309>: DATABASE ENTRY DATE: 2001-06-18
tacattgggtctactgcacaaattacagggctccaagtgtcttatgagagcaggacttgggctgaccatgtctctctgccctcacccatgctctgctctgatttcaggtcctaagtgtgaacgtgaagtccccagccctgctgctgagccagttgctgccctacatggagaacaggtatggcagggcgggggtggggaccagtcggagttggggacctgaggtgggcacagaaatacagtcggtagcacagccagtagtgggtagaggacagaagaggtctgggatctccacatccctcatcttcttgtcctgcctccccatctgtgtggctgccattcccaattccagtggctgcaggatgagagtagtattccaggggcccaggcatagcctccttggccttgacatcagcaggtttgggacaaggctatgctttaactccttgaccttgtgggctggtcattgtcaccttacctgctctctgttcttaccaacttaaaaccaatgacagggttagccccattcctctccataggaaaaagcctgtcccagacctctcctcatgcctgcgcttggtctccagggaccctgcctgtgttccaggtcctgcagatctgactgtacccctcacagacacacccttaggaactggccaggggctgtcttcagtagaaggaaagtccctgactgtcacttctggtctcccttaccccatctgctccttagaggttgctcattgataggcactcaccatcagccttgggtgcctcttcacaaagcccaccctgccctctccttcaagcccctggcaagagaggaagcagaagataagggttctgagcatggacatcgtatttatgagaaataggcatggaatcctagctctgccgtgtattggctggtactaaacctttctgagcctcagttttctgaactctgagatggggacagtaataggacctgtgttgcttctgtgagggttgcatcatttaatgaactcatgatagtgtcaccatcagtggtaagctcttagcttcagcttctcttatgtttgtcttgtctcaggaggggtgctgtcatcctggtctcttccattgcagcttataatccagtagtggtaagtgcttggtccttgtgctcctgagtggtatagggtgaggggcaactttgttcttttcctcagagccttacagacaaagtgcctgggacagacccccaccatcctcctgctgccctgggctgagcttgtctccatgtgggtgggagggctgctgggcctgtgagatccctgtaggtgagaaatccaactgatgctttcccccactctcccatatcctaatcactctgtcaattcccttcccaggcgctgggtgtctacaatgtcagcaagacagcgctgctgggtctcactagaacactggcattggagctggcccccaaggacatccgggtaaactgcgtggttccaggaactatcaaaactgacttcagcaaagtggtgaggattgggtgtgtcttccatctcccagtctggctcagtgggaacccttcccagtgaataagggatcaaggggtgactgaatccttaggtcagcatgcctatgactgaggtcctcattgttctctgaactcagccatggtgcagtccatccatcctgaaaagatgctccttcttttgagaagggcaaagctgccctaggtgttctgcctggtggccttcccggggccctgcccatcttgttttagtagcactgactccttcatttcttccctttgcccagtttcatgggaatgagtctctctggaagaacttcaaggaacatcatcagctgcagaggcaagtggggtttggagatttggtggtccatgtgtggctaggcaggggcagttgagtctattgcaagagcagacccctccctgtcatctggccattgtttttgctgaaatctggagtccacatggccctggagggtgcaagtagccctgctgcatccaccttgttccccatggagcccactcccacctgtcatccgtgagccccagagcagcagaatcagagtacgagatgcttgacactgtgtccttcttccatccaggattggggagtcagaggactgtgcaggaatcgtgtccttcctgtgctctccagatgccagctacgtcaacggggagaacattgcggtggcaggctactccactcggctctgagaggagtgggggcggctgcgtagctgtggtcccaggcccaggagcctgagggggtgtctaggtgatcatttggatctggaggcagagtctgccattctgccagactagcaatttgggggcttactcatgctaggcttgaggaagaagaaaaacgcttcggcattctccttaggacttatctgcttgtagatttggctgatccaattaacatgtggggttcttggtgtgggtctgaggagctgaaggattttatggagctggtgctttggaggaatcttaagggaaaggagtagaagctcaggcctttgaaggatttcagctcctcctctctgtaatttgtgctttaagcattttttttcctaaaataaactcaaatttatcctcaaaaaaaaaaaaaaaa

SEQ ID NO: 213 - DNA, 1675 bp, Homo sapiens
  ref <308>: DATABASE ACCESSION NUMBER: AK000543
  ref <309>: DATABASE ENTRY DATE: 2001-06-18
gcgcgaatcgcggtcgcgagccatggaggaggaggcatcgtccccggggctgggctgcagcaagccgcacctggagaagctgaccctgggcatcacgcgcatcctagaatcttccccaggtgtgactgaggtgaccatcatagaaaagcctcctgctgaacgtcatatgatttcttcctgggaacaaaagaataactgtgtgatgcctgaagatgtgaagaacttttacctgatgaccaatggcttccacatgacatggagtgtgaagctggatgagcacatcattccactgggaagcatggcaattaacagcatctcaaaactgactcagctcacccagtcttccatgtattcacttcctaatgcacccactctggcagacctggaggacgatacacatgaagccagtgatgatcagccagagaagcctcactttgactctcgcagtgtgatatttgagctggattcatgcaatggcagtgggaaagtttgccttgtctacaaaagtgggaaaccagcattagcagaagacactgagatctggttcctggacagagcgttatactggcattttctcacagacacctttactgcctattaccgcctgctcatcacccacctgggcctgccccagtggcaatatgccttcaccagctatggcattagcccacaggccaagcaatggttcagcatgtataaacctatcacctacaacacaaacctgctcacagaagagaccgactcctttgtgaataagctagatcccagcaaagtgtttaagagcaagaacaagatcgtaatcccaaaaaagaaagggcctgtgcagcctgcaggtggccagaaagggccctcaggaccctccggtccctccacttcctccacttctaaatcctcctctggctctggaaaccccacccggaagtgagcacccctccctccaactccctaccagctccagagtggtggtttccatgcacagatggccctaggggtgacctccagttttgcgtgtggaccgtaggcctctttctagttgaatgaccaaaattgtaaggcttttagtcccaccgacattagccaggctcgtagtgaggcctccagagcaggttgtgctgtcccctgcctctggaagcaatggggaatttggaatcttgtgtaagtgcccaaataagtctgagtgctttcctcttcttcaacactcaaccctcaatcccttagcactgattgattagagaggtcccccaaagaaaccactggttttgacccatgaagcattagaactgcattgttcattcaggagccactagtcacatatgactatttaaatttaaagtaaattgtatgaaaaattcatttcttcaattgcattagccacattttgagtattcatgtggctggtagattctgtattagcacaaagatatggaacatttccatcaccacagaaagttctgttggacagcactgcattagaatattttcatactgctcttcctcaattaatttttgttgttaatgttgatgtcttcattggatgggtcataatgttccatgaaacctctcaagtacacaattgtatgttctttgtatcccttaccacaaatatctcgctctgctcatttcttttgcagcttcctataaagtttgtcttcctcatcaaaaaaaaaaaaaaaaa

SEQ ID NO: 214 - DNA, 1863 bp, Homo sapiens
  ref <308>: DATABASE ACCESSION NUMBER: AK000552
  ref <309>: DATABASE ENTRY DATE: 2001-06-18
gagctgagtccgcgctcccgcccaggcggcggccgacgcgacgccccgagcgcccggccccgccgccgcggcccggcagactgcctctgtcaccgggtccctccacccttgtctcctgtgcggccagcgtcagagccatggcgacggaggagaagaagcccgagaccgaggccgccagagcacagccaaccccttcgtcatccgccactcagagcaagcctacacctgtgaagccaaactatgctctaaagttcacccttgctggccacaccaaagcagtgtcctccgtgaaattcagcccgaatggagagtggctggcaagttcatctgctgataaacttattaaaatttggggcgcgtatgatgggaaatttgagaaaaccatatctggtcacaagctgggaatatccgatgtagcctggtcgtcagattctaaccttcttgtttctgcctcagatgacaaaaccttgaagatatgggacgtgagctcgggcaagtgtctgaaaaccctgaagggacacagtaattatgtcttttgctgcaacttcaatccccagtccaaccttattgtctcaggatcctttgacgaaagcgtgaggatatgggatgtgaaaacagggaagtgcctcaagactttgccagctcactcggatccagtctcggccgttcattttaatcgtgatggatccttgatagtttcaagtagctatgatggtctctgtcgcatctgggacaccgcctcaggccagtgcctgaagacgctcatcgatgacgacaacccccccgtgtcttttgtgaagttctccccgaacggcaaatacatcctggccgccacgctggacaacactctgaagctctgggactacagcaaggggaagtgcctgaagacgtacactggccacaagaatgagaaatactgcatatttgccaatttctctgttactggtgggaagtggattgtgtctggctcagaggataaccttgtttacatctggaaccttcagacgaaagagattgtacagaaactacaaggccacacagatgtcgtgatctcaacagcttgtcacccaacagaaaacatcatcgcctctgctgcgctagaaaatgacaaaacaattaaactgtggaagagtgactgctaagtccctttgctcctgcccgcgagagactgtcgggaagttgacccggattggcaagaaacagggtgtcttggaggtggtcccccagatctgcgcctgggggtcaggacagggcctgatttgagcctcctctctgaagatgatttggccgagcggaaggtgtggaccaccggaaagttcttaaaagttgctggtgacatttcttgccaattctaacactgtctagggaagagttcctagtctattgtgttcaaacagagtcaacaaaagtttttaattttttattacagaagggtgaagttcaatttaacatgcgttgtgttttttcagtaaacgttctgtatctttttgatattccatgacccagtgcacgctgtggcctgtcaccgccaccgtggccccgccagctggcctcccctttggcccacgccggccgcccccattctctgctgcgtagatgccctggcccagggccctgactcctccattcccgccagtagctgttcctagtgtattttcgtctttctggaaaacagcattgagtggttgttttctgtgtaaagagccgtttgtgtcttgggagtttgtggcccacatgccgatagcacggtcatcgcacatgactctcccgtttgtctcagtgtccctgcaacaagcagcaccgcagactgtaataaaaggtggggttttgtgaaaaaaaaaaaaaaaaaaaaaaaaaaaaaaa

SEQ ID NO: 215 - DNA, 2993 bp, Homo sapiens
  ref <308>: DATABASE ACCESSION NUMBER: AK000617
  ref <309>: DATABASE ENTRY DATE: 2001-06-18
gtgcacgcgctgaaaccggagcgcgcagggcgcgccagggtgagggggacgggggcggggtgggggcagccctttcccaggcggtagcgggggcggcgtcgctgttgcccttttaagccgcggggccgccgcctcctgccgctggagtcggttacaaaggaagcgccacccaggccgccacacgccgaggcttccgcgcccctcgccattttccagcagcgctcgacgaggcggagccgcgagagcgcggcccaggccggccccgcggggcggtcgcggccgtgacggcggctccgggcccggctccccttccgcgcccggctccccttccgcgcccctcccgccggagatgaggggaagatgtccgtgtcagggctcaaggccgagctgaagttcctggcgtccatcttcgacaagaaccacgagcgattccgcatcgtcagttggaagctggacgagctgcactgccagttcctggtgccgcagcagggcagcccgcactcgctgccgccgccactcacgctccactgcaacatcacggaatcctatccatcttcttcaccgatatggtttgtggattctgaagacccaaatctgacatcagttctggaacgtctagaagatactaagaacaacaatttgaatgggacaacagaagaagtgacttcagaagaagaggaagaagaagaagagatggctgaagatatagaagacttagatcactatgagatgaaggaagaagagcctattagtgggaaaaagtcagaggatgaaggaattgaaaaagaaaatttggcaatattagagaaaattaggaagactcaaaggcaagaccatttaaatggtgcagtgtctgggtcagtgcaagcttcagatagacttatgaaagagctcagggacatatacagatcacagagttataaaacagggatttattcagtggaactcataaatgacagtttatatgactggcatgttaaactgcagaaggttgaccctgatagtcctttgcacagtgatcttcagatcttaaaagaaaaagaaggcatagaatatattttgcttaacttctcttttaaggataactttccatttgatcctccatttgttcgagtggtgttacctgttctctcaggagggtatgtattgggtggaggagcattatgtatggaacttctcacaaaacagggctggagcagtgcctactcaatagaatcggtcatcatgcaaataaatgccaccttagtcaaaggcaaagccagagtgcagtttggagcaaataagaatcaatataatctagcaagagcccaacaatcctataattccattgtacagatacatgagaaaaatggctggtacacccctccaaaggaagatggctaaatatgttgactgttgtatgtttggactaatgttgctttaaagaaaatctttccaacatgcagacaaaagctttgagtgcccctattacagcagtaccgaagatgttagttaatagatattttagtggataatctgtcatctgacatccagtataagttacagccttcgcattttgctcattttagatatcttggactgagcagtggggcctttactgtatttttcctgataaatacacatactggccactccttatctctttttcttgaaaagtgaactttttaaagcagccaagtcaacatcaggctactgaagttgaggctttagggtaactttcctatattgagcccatgggttacaaggatttgcaatatattgttccatttacagccaatacaggtttaatcgatgttcaatattggtttaggaaatttaaggccttctaaatcataatagctctttcatgtctaaaaccattttatgatattgccaaaatgtgataggaaacctactcattaaattgttaaactttttaatgactatgtgaagatatgaattgtttcctgaagataatactcttaattgagttgtattgtacttcttaggcaaagcagtgtaaaactgtatcagttaaggcttgtgagtagtgatttccactggggcatcagagtcttggctgggctgaatctgctgcttgttggttcagtgtttcttatgaacaagagccacagtacagagcttcaagttatttaaaatactaagtcatcttacgtttccattttattaacgggatgttgcaatcgtttgtaaactaataaacttataaagtgattggcacaaagactccttgagcaaaagctgtgcagttaagtacaaaaagatacttaatttggagactcttacagtaatttttgccatgtcaaaacaatggcttttacattgaaagattaatagaaactctacatatgttaatttttttatagaacctgactcaaatcaaggtactctccattttattgccttacctgaatcagtcctttttggttggtaatagatttttttatacacccacgtttgatttaaaagtaaattctagttcttaagcacttttaacaagaaatccagaagcacatttttctgcacaaacaagttacaaagttcaaaagtgtttcttgtgcattagctttgagattcagtttttaactttgtaaaccacatctgagagacttgtcatttctacattgtgtgtgtttaatttcttttgattccattttggttaagagagcagtaaatagattttctggtattcttgttcacttgattacatttgtataaagttctgattgccagttgctcagataacaagtaacaaggcagaattctttaaatcagtaaagttccttaagcctaaggctaaatcttgaatacattgttgaattctttaatatcctgatggcaagcagactgatagctgcacatttggcatgctttgtttaatggattttatttttaattgcagatttatttggcaatgtacagtaaattttgtaaacttgcatcaagtttatgaataaagaaccatttaaaaaaaaaaaaaaaaaaaaaaaaaa

SEQ ID NO: 216 - DNA, 1667 bp, Homo sapiens
  ref <308>: DATABASE ACCESSION NUMBER: AK000643
  ref <309>: DATABASE ENTRY DATE: 2001-06-18
ctgatcacaggtagcactcagattaccctgcctgctctgtgctttgctgcagaccatttgaccagaacgtgtgcagctcagccagccacagaactggaatttttcaggagcagggggagcatggagtttggactttgctgagcaactgaagtggagcgcagagcttgctcgcttaggagagagcatcatggatggcaaacaagggggcatggatgggagcaagcccgcggggccaagggactttcctggcatcaggcttctttcaaacccattgatgggcgatgctgtgtctgattggtctcctatgcatgaagctgcaatccacggacatcagctgtctctgaggaacctcatcagccaggggtgggctgtgaacatcatcacggcagatcatgtttccccactccatgaagcctgtcttggaggtcatctctcttgtgtgaagattttattaaagcatggagctcaggtgaatggtgtgacagcagactggcacactccactgtttaatgcttgtgtcagcggcagctgggattgtgtgaatttgcttctgcagcacggagccagcgttcaacctgagagtgatctggcatcccccatccatgaagctgctaggagaggccacgtggagtgtgtcaactctcttatagcttatgggggcaacattgaccataagatcagccacctgggcactccactctatttggcttgtgaaaaccaacagagagcctgtgtcaagaagcttctggagtcaggagcggacgtgaaccaagggaaaggtcaggattccccacttcatgcagtggccaggacagccagtgaagagctggcctgcctgctcatggattttggagcggacacccaggccaagaatgctgaaggcaaacgtcctgtggagctggtgcctccagagagccccttggcccagctcttcttggagagagaaggtgcttctttgccaaaacctaagccctaatctgttgacatcccttggggctctagtagaagggcccccttctttgatgcagttatgccgccttagaattcggaagtgttttggaatccagcagcatcataagataaccaaactcgtcctcccagaggatctgaaacagtttctcctacatctttaaatgcatctagggaatggattcacaaacgatgtgaaaacattattgagtgttgtagccactagaattttaaaatcaagttggatttatagagtttgactagttttttcgattagatttgtatttgttataaacttgtttatggagtttgactaattttttctattcaatttgtatttgttaaactcaagccagggtggaaagacactgcatacgtttgtattattagttagaaggcatgaagacttttttccctgcttggggagtgtcataagttattgttttgcatatctactgcatgccaagcactttctgcaccatctaatttagccctcacagccactgggtcaagatgtccaattttccagagtaaggatagaggagtcaaattcaaatacaggttttctgacattaacttatgtgatgacttgatcgaggcaggcttttccagcatcactgtcctggttccatctctgctatatgggaatgaaaataaagaaacatatttcttggcttgtctaaaaaaaaaaaaaaaaa

SEQ ID NO: 217 - DNA, 1198 bp, Homo sapiens
  ref <308>: DATABASE ACCESSION NUMBER: AK000660
  ref <309>: DATABASE ENTRY DATE: 2001-06-18
aaaatcaagaatataaaccacattccaggctgctgttttctctccatctacaggccacacttttactgtatttcttcatacttgaaattcattctgctattttcatatcagggtacagacttataagggtgcatgttccttaaaggtgcataattattcttattccgtttgcttatattgctacagaatgctctgttttggtgctttgagttctgcagacccaagaagcagtgtggaaattcactgcctgggacacagtcttataagaatgttggcaggtgactttgtatcagatgttgcttctcttttctctgtacacagattgagagttaccacagtggcctgtcgggtccaccctgtgggtgcagcacagctctctgaaagcaagaaccttcctacctattctaacgtttttgccctctaagaaaaatggcctcaggtatggtatagacatagcaagaggggaagggctgtctcactctagcaaccatccctccattacacacagaaagccctcttgaggcaaaagaagaagaaagaaagaaagcttatctctaaggctactgtcttcagaatgctctgagctgaatgctcttgctcctttcccaagaggcagatgaaaatatagccagtttatctatacccttcctatctgaggaggagaatagaaaagtagggtaaatatgtaacgtaaaatatgtcattcaaggaccaccaaaactttaagtaccctatcattaaaaatctggttttaaaagtagctcaagtaagggatgctttgtgacccagggtttctgaagtcagatagccattcttacctgccccttactctgacttattgggaaagggagaactgcagtggtgtttctgttgcagtggcaaaggtaacatgtcagaaaattcagagggttgcataccaataatcctttggaaactggatgtcttactgggtgctagaatgaaaatgtaggtatttattgtcagatgatgaagttcattgtttttttcaaaattggtgttgaaatatcactgtccaatgtgttcacttatgtgaaagctaaattgaatgaggcaaaaagagcaaatagtttgtatatttgtaataccttttgtatttcttacaataaaaatattggtagcaaataaaaataataaaaacaataactttaaactgcaaaaaaaaaaaaaaaaaaaaaaa

SEQ ID NO: 218 - DNA, 2504 bp, Homo sapiens
  ref <308>: DATABASE ACCESSION NUMBER: AK000689
  ref <309>: DATABASE ENTRY DATE: 2001-06-18
gattttctgctccggttggtgagcgcgcctgcgcgttgacggcgattttgcgttctgaggctgcagcgtcggcatcttgagctgccggttcgcgagttcgaggccaggttccgcctgtcgtgggttcgcaccccggacgcgatgctattcgacaaggtgaaagcgttctcggtgcagttggacggcgcgaccgcgggcgtcgagcccgtgtttagcggcggccaggccgtggcgggccgggtgctgctggagctgtcaagcgccgcgcgtgtgggtgccctgaggctgcgcgcgcggggccgcgcccacgtgcactggaccgagtcgcgcagcgcgggctcgagcacggcttacacgcagagctacagtgaacgcgtggaggtcgtgagccaccgcgccacgctcctggcgccagataccggggagaccacgacgctgcctcctgggcgccatgagttcctgtccagcttccagctgcccccgaccctggtgacatccttcgagggcaaacacggtagtgtccgctactgtatcaaggccaccctgcaccggccctgggtcccagcacgccgggcaaggaaggtgttcactgtcatcgagcctgtggacatcaacacgccagccctgctggcacctcaagcgggggctcgggaaaaggttgcccgatcctggtactgtaaccgtggcctagtctccctttcggccaagatcgaccgcaagggctacaccccaggagaggtcatccctgtctttgccgagatcgacaacggctccacacgtcctgtgctgcctcgggcagccgtggtgcagacacagacgttcatggcccgaggcgcccgaaagcagaaacgggcagtggtggccagcctcgcgggcgagccggtgggccccgggcagcgggcgctgtggcagggccgggcactgcggatccccccagtgggtccttccatcctgcacagccgcgttctacacgtggactacgcactcaaggtctgtgtggatatcccaggaacgtccaagctgctgctggagctgccactggtgatcggcaccattcccttgcacccttttggcagccgttcctccagcgtgggcagccacgccagcttcctgctgggctggaggctgggggccttgccggagcggcctgaggctcctcctgagtactcggaggtggtagccgacactgaggaggcagccttggggcagagccccttcccgcttccgcaggaccccgacatgagccttgaagacccgttcttcgcctacatccaagagttccgctaccgcccgccacccctgtactctgaggatccaaacccactcttgggggacatgaggccgcgctgcatgacttgctgaacggcacagggacccctcgaggaacaaggttgcacaccagctttcagccaccatgactgtggggagtggctggaccaagggctgacctccccgactgcatcaaagttggggaaccaagtctcagagtgaggcgggggcctttcggatatcacatgggacagaggaagagcccggctggaatctgacttacctggaccgctgtccttgtgaggcattgaatgcccagtgcagtatccgagagactgtttaataacctgtcttcccagccaattggtggtgctggaatcccctaggagccttcagtctgggagaaacagagccagacatagacagttccagcatcacagaaccagaagaagagacctgcaactgtgagagtccagacaggaagcagagaaggcgtccttgcggaaagggcattttagctgaggctttggagtacgaataggagctcagcaggcagacgaatgaggaataaaggtcagagaaggtcagagtgaagtgacgtttggaatccaccccgtttattgtagaactgggggttcagagggcaggtgcctcagagttgaggccacacagtgaggtctggtgggtgaaaggacccaggaacgaggcgttcaggaaagcaggttgtcagagctatgtggagtctgtgggtggcaggggcagccgctccagcctttgaagactttgaaagccagagattcctggcgcaggcttggacttcctgggagctcctccaagtacccaggggcatcagagctgcctgggtgttacatggcccagggaacccaggttcagggtaggacaggcaagaccagatacccaatgtgcaaagtgaaaacactgggctccctgttaaacgatgaagaattcaagacagtgacagcattacgtcacccctggggacagaggtcagcctaaggtgacacacggggactactgtgcttccggaggctccctgtgtcctggaggagaaaagcattagagggggcagctggacaagctcccaactgcagagtcccagccctggctggggcagggccccggcctgggactcagcatttctgatatgccttaagaattcattctgttttgtacaattattttttaaaagtaaacgtgggaaaaaaaaaaaaaaa

SEQ ID NO: 219 - DNA, 3106 bp, Homo sapiens
  ref <308>: DATABASE ACCESSION NUMBER: AK000745
  ref <309>: DATABASE ENTRY DATE: 2001-06-18
cggccgcggcccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatgg

SEQ ID NO: 220 - DNA, 1884 bp, Homo sapiens
  ref <308>: DATABASE ACCESSION NUMBER: AK000770
  ref <309>: DATABASE ENTRY DATE: 2001-06-18
ttcaacctgaccctcaaggagatccacttcctcaagtggctggacatctactgcccccacgtccccttcattttcaaaggcgacgatgacgtcttcgtcaaccccaccaacctgctagaatttctggctgaccggcagccacaggaaaacctgttcgtgggcgatgtcctgcagcacgctcggcccattcgcaggaaagacaacaaatactacatcccgggggccctgtacggcaaggccagctatccgccgtatgcaggcggcggtggcttcctcatggccggcagcctggcccggcgcctgcaccatgcctgcgacaccctggagctctacccgatcgacgacgtctttctgggcatgtgcctggaggtgctgggcgtgcagcccacggcccacgagggcttcaagactttcggcatctcccggaaccgcaacagccggtttggccctggaagtggacattcctctattactgtgaagttttatttatgaagaatttggagggagaaggctccaggcttcaggagggggtggtgtcctccctggccctcctcccttccctcccctcattccagctgcctcccctcagcacccccacgcccctcacagcccagccccctccagagccctgccccaccgcaccctgcttctccagggcctagcagaccagcatctgccccggtgaagggatggatcagctgtgggggtgggtgcagaacgttgccacctcctacctcagcgggagtcacctaggaaagatggagggattgacactattttctcaataaaatgggactttttttttttttttttttttttttttttggtgtgaaacttcctgttcccagctgcatcagagagcctgtctggggccaaggttgccagagatttctgaagacacagcttgttccttgttcttggctggtgggtgcacaaggacttctggaagggatttagacggggctgagtgctaggattaaagtggggatgggagtacggcaacagaaaaacctgggagctagcaatgcacccagcccttgactgtgccctggtggacagccgagctgtggctctagcgtgagccagtgccttcctgtccctgccaagggtgaggccagagttggccccgaggctaatgtttcagtgggtgagattaggtcggccgtacagaggccggtgggctccctgacatcccttccaggcaacctgaaagcactgaaatagcttatggccctgtgccagggaccttggcccaagctgctgacctccagggtggggagggagctacccccaggagaagagtcactcagacagcagtatgagcaagccagccagcagctccgtgcctgcacccagctcaggggaatcccagggggttcagatgcccaggaaggaaaaggggacagcgctactgctatggaatgagaccaccacttctcctgttgtccttcccagcttctccccaacctccccttttccctagtttataagacaggagaaaagggagaaagcaaaaagctggaaagaaacagaagtaagataaatagctagacgaccttggcgccaccacctggccctggtggttaaaatgataataatattaacccctgaccaaaacgactggtgttatctgtaaatcccagacattgtgtgagaaagcaccgtaaaactttttgtcctattagctgatgtgtgtagcccccagtcacgttcctcacgcttacttgatctattatgaccctttcacgtggaccccttagagttgtaagctcttaaaagggctaggaatttctttttcggggagctcggctcttaagacgcgagtctgccgacgctcccggccgaataaaaacctcttccttctttaaaaaaaaaaaaaaaaaa

SEQ ID NO: 221 - DNA, 2570 bp, Homo sapiens
  ref <308>: DATABASE ACCESSION NUMBER: AK000933
  ref <309>: DATABASE ENTRY DATE: 2001-06-18
attaaaatgagaaatacataagatgataaataaaatgaaggtgaaggtattccagatctaccgaaaagattttcagtatcacagattattcataagaaattgagaaaaggaacaatcagaagttgcaaaagatggtatagccgaatataatggaaataggaaaaattagtcgaaaataaaggttgatttagaaatgaagaaaatgaatatatttcttaatacaaaataagtgggaaatgagaagttataccaataaaaagcatttacaaatttaggggatattgtaacccagtataattttctgacaggttggactttgaccctaatggacttactggtgaactttttcaaatgtttaaataatgtctatccatgtatcatgaaggacagtatgcttcaaattgtcttttgaggcagacatgttctcagtactaaaagacatttttagaaggattttattctcaacagatgcaaaatgcaaaataaaatattgacaaacaatacagcaacaaataatttactatcactcaggattataaggctggtgttaagcagaacagccattaaatcagcatcaaaagaacaaatagtaaaatccaaagtattaattacagataacttttcaaaaattcatcattcacccttgatttaattatttctctggcaattatttaatagacttctcggagtctgttaagtacttaaaccaagaactaccattattcctactgggaaaacataaacatttctcaagtggaaagtaaacagtgttggcactatttttatatatggttaaagagacctgtcattgcaataaaagccagcattcacaaaatgaggaagataaggaaagtagcataaatattttctattaacatggctttacaactgctaaaacttatagtataaaaatgtactaacaaagactaattcaagaagttgcaggatacacaatttttaaaaatctcatttctacatcttagcagtgacaaactgcaatttaaaaagtgtgtttggttattaatatatatgagacttttaaagaaagttatataactacatagagataaattaagaaagatgcctaaatagaagcaagtttaaagagctatatttttaaacatgaacaaactcccatgggagccatgccagtgtagtggaaaagtagtacatggggagatggggagtttttttgaaaaccagaattacagttctcatttcactacttaccagttgtatactcttgggaaagtcactcctagtatctatttcaccatctacagaagagaaatacttcacagaattattgtggggattaagttagataatgtgttttaaaatataaagctacatccaaagaaatgccaatatgtgacattagtatgaaatttactacagttccatttaacattccaactggttgctgtgtggaatatggcataattgtaataaattatttaggaaagcaagcaaagatgtaagtttttttaatttagggggaaaaaatgggagccttgctctccaaatccttaaaacatgctattaagcaacctttctgaatattctgtggtgccaagtagaaagtttaactgaaattaataagccaatggaaagaaagaaatattaataactgctggtggaaagactagctagatgtcagtgtggaaagattagatccactttacatgtgatattccaaatgaattaaaatgttaagtataaaaagaaaaatactacaagtctcacaccaatagtggtataaaggaacttcatggcaattggcaaggtagatcaactaagagaaaaagttttaaatgtgtagtaaataggaaaaagacaaaacaagatggaatttaaaagaagctatttgcattacacatggatgcactcagtttttgtaaaactatatgcatatccataggggtttgtactcttaggcaaatttataaagcgatcgtgtataaatgatataaaaaatcaatttgaatggtattcaaatttcctaatattaaaaatgcaactttgacttagttcatgctattgtattagcaaaactgttttaattgcatgtgtccttatagcagcagcattgtgtattagtagccttttaagagaactgtgtagaagactataaaaagggctttataactgatcttttgacatactcactttgagtggcatatgcccaggaaaatatttaaaagaaagaaaagctatttgtacaaagttttctagcagttccactcagataactttaagggggaaaaaagcccaacgattggaaatggttaagtaaattttggtgtattgctagtgctatcacagaatgttatatagccattcaataatattgatatatgtcaaattgtatgcaaaaaagtgagattcaaaaatgttaataagaacataaattgtgtttactgatacatgtgaaaatttaggtctacattgaaaagaatcagaagataacatgtaattcagtttaacattaggggttctttatttttcttctgttaaatattgatgtatgcaataaaaaataaaagattaattggtaaagtggtttactg

SEQ ID NO: 222 - DNA, 1229 bp, Homo sapiens
  ref <308>: DATABASE ACCESSION NUMBER: AK000959
  ref <309>: DATABASE ENTRY DATE: 2001-06-18
gtcgtggctcgttccattctcggcggtggtacctgctcccggtggccctgaggacgtgtgggccaggggcggccccgaaattaggaagcggagggggagcagtctgcaggtctgcggggctaagtgtcgcggcggcgcacctcgcgtcaagaatccggaggaggagactgcaaggataggcccaggagtaatggagtccaaagaggaactagcggcaaacaatctcaacggggaaaatgcccaacaagaaaacgaaggaggggagcaggcccccacgcagaatgaagaagaatcccgccatttgggagggggtgaaggccagaagcctggaggaaatatcaggcgggggcgagttaggcgacttgtccctaattttcgatgggccatacctaataggcatattgagcacaatgaagcgagagatgatgtagaaaggtttgtagggcagatgatggaaatcaagagaaagactagggaacagcagatgaggcactatatgcgcttccaaactcctgaacctgacaaccattatgacttttgcctcataccttgaatcctaaaagttttcgctgaggttaatgtgaacactgctttacaagcttgtatttttgtgatttactttttctgtaagccttttggtgtttacacttaccagtttctaatggaaattagaattctaattgaatattgttttgtctcagcctaaaagttacggtcagcatggcaattcacctattttaggaaaaatactcttttcataatatgaaatgcataaagcagttcaaaaagcagtctgtattccatcatcttcctttttcattccagtccttatttttgtaagtattacttttcctcctccggctacctggactcaaaatctcagttgtctttgacagtttttttcttgtccctgaccaaaaaagaatgatcatacccagaattcaatgtttgatattttaagaatgtatgttctagtgtttttcagagtgagtctaccatctgtataaaaacaccttgggggcaggcaggggcatttaaaaatgtaggacctatcgtccagactcacagagtggggctccagaatctccatttttaacaaactctcttaagtaattctgatgtgtaccaaaatcagtgccattggtgtgtgtgtacgtaactatatacatatgtgtgtgtgtgtatatatataatgtgtcataaccgtaaacaataaacaatatcaagat

SEQ ID NO: 223 - DNA, 2132 bp, Homo sapiens
  ref <308>: DATABASE ACCESSION NUMBER: AK001100
  ref <309>: DATABASE ENTRY DATE: 2001-06-18
catgtctggagaccattttcaacctgaatttatctctgatgccagtccccaagatgagccattggttgcttattctttggggtcacccaagatggcagcactgaaggccacatggctggggttttctataccttgggattacatgttatacaaaacagctgactgacaatgcagaatgagggaagggacacctccaaattccttcagcctcccaaagtgctgggattacaggcatgacccaccgctcccggccttgttttccgtttaaagtcgtcttcttttaatgtaatcattttgaacatgtgtgaaagttgatcatacgaattggatcaatcttgaaatactcaaccaaaagacagtcgagaagccagggggagaaagaactcagggcacaaaatattggtccgagaatggaattctctgtaagcctagttgctgaaatttcctgctgtaaccagaagccagttttatctaacggctactgaaacacccactgtgttttgctcactccctcactcaccgatcaaaacctgctacctccccaagactttactagtgccgataaactttctcaaagagcaaccagtatcacttccctgtttataaaacctctaaccatctctttgttctttgaacatgctgaaaaccacctggtctgcatgtatgcccgaatttgtaattcttttctctcaaatgaaaatttaattttagggattcatttctatattttcacatatgtagtattattatttccttatatgtgtaaggtgaatttatggtatttgagtgtgcaagaaaatatatttttaaagctttcatttttcccccagtgaatgatttagaattttttatgtaaatatacagaatgttttttcttacttttataaggaagcagctgtctaaaatgcagtggggtttgttttgcaatgttttaaacagagttttagtattgctattaaaagaagttactttgcttttaaagaaacttggctgcttaaaataagcaaaaattggatgcgtaaagtaatatttacagatatggggagatgtaataaaacaatattaacttggtttcttgtttttgctgtatttagagattaaataattctaagatgatcactttgcaaaattatgcttatggctggcatggaaatagaaatactcaattatgtctttgttgtattaatggggaatattttggacaatgtttcattatcaaattgtcgacatcattaatatatattgtaatgttgggaagagatcactattttgaagcacagctttacagatgagtatctatgatacatatgtataataaattttgatcgggtattaaaagtattagaaggtggttataattgcagagtattccatgaatagtacactgacacaggggttttactttgaggaccagtgtagtcaagggaaaacatgagttaaaaagaaaagcaggcaatattgcagtcttgattctgccacttacaggatagataatgcctgaactttaatgacaagatgatccaaccataaaggtgctctgtgcttcacagtgaatcttttccccatgcaggagtgtgctcccctacaaacgttaagactgatcatttcaaaaatctattagctatatcaaaagccttacattttaatataggttgaaccaaaatttcaattccagtaacttctattgtaaccattatttttgtgtatgtcttcaagaatgttcattggatttttgtttgtaatagtaaaataccggatacatttcacgtgtccttcagtattgatttggttgaatattgggtcataatggttgagaagcatggacactagagccagaatgcttggatatgaatcctggatctgtcacttacttctgtgtgacctttgaaaggctacttatttcctctcttagctttctcattaaaatcaatgaacaatgccagcctcatggggttgttgaatgattaaattagttaatatacctaaagtacatagaacactgcctgcacatagtaaaagaattataagtgtgaggtagttggtaaaattatgtagttggatatactaccgaacaatatctaatctctttttagggaaataaagtttgtgcatatatataatcccgaaacatg

SEQ ID NO: 224 - DNA, 1149 bp, Homo sapiens
  ref <308>: DATABASE ACCESSION NUMBER: AK001164
  ref <309>: DATABASE ENTRY DATE: 2001-06-18
tattagaagttggatttctggtgaaagggtttgagtgtttttgaggctttggcacagaatacccagctggtcccagaaaggtggttcccatttacctgcccgaaggtaattcacccttactgatactgagtactgttttctaaaagaacattaaaaattggataggttaaaaacaggtgaatacatttttttagttgcatttttttggttacccgtgagagtgaacatgttgccatgtgtttgctgacctcctaaatggtctatttgctcctacctttgtaccccaaaagtctgctctcaagatggtagccagaatgatcctttttgagacataagtcaaaatttcactcttctccttaaagctctgcaatggttctcaggttaaaggccaaagtcctgttcaaggcctccagggtcctcaccacttggtcccttgctctttctgttctagccaacttggccttctcctgcccctccgccgcaccatggcaatttcccctgctctgtgtggtcaactacctgaatctgttcaaagctttgctcaaatgtctccttcctgatgagacctccccagcccctgagctccccatgccccactcctgatcgccttacttaacccttctttttcttttttgccagtagtacttatcaccgtctaaaatacttcataatttacttgtttattgtttgcccctctccaatagaatgtaagctccttggggcagggacctttgtcctttgtcttgttcactgctgtgtcccatgtgtaaacttgtctggcacagaagaggtgctcgataaatatttgttgagtgaatgaatggtaaattttctgttcatattctttgactattttctattgtaatgttcatctttttagtattggtttataagatgtatatttagcaccttttcatatatcactctttgtcacatattatgcaactaatttgtcatttccatcaatttttaaaatactttcttgatgcttcatttttaagctgtcagattattaatcttttctttatggtcttggactttattgttgcataaccgctgccttcaccaggaacatataaattttcaattaaatgttcttctgagattttatgatttcactttttatattaaactcttcattttgtcttc

SEQ ID NO: 225 - DNA, 1411 bp, Homo sapiens
  ref <308>: DATABASE ACCESSION NUMBER: AK001166
  ref <309>: DATABASE ENTRY DATE: 2001-06-18
aaacaaagagatgccacccctgtgtgatggctttggtacccgaacactgatggttcagacattttcccgttgcatcttgtgttccaaggatgaagtggacttggatgagttattagctgctagattggtaacgtttctgatggacaattaccaggaaattctgaaagtccctttggccttgcagacctctatagaggagcgtgtggctcatctacgaagagtccagataaaatacccaggagctgatatggatatcactttatctgctccatcattttgccgtcaaattagtccagaggaatttgaatatcaaagatcatatggctctcaggaacctctggcagccttgttggaggaagtcataacagatgccaaactctccaacaaagagaaaaagaagaaactgaagcagtttcagaaatcctatcctgaagtctatcaagaacgatttcctacaccagaaagtgcagcacttctgtttcctgaaaaacccaaaccgaaaccacagctgctaatgtgggcactaaagaagcctttccaaccatttcaaagaactagaagttttcgaatgtaataatacttccacagcaacaggtgctagagaccactgttgttgttttgagtgaatggtggttaggagaaagactttggtggtggaagaaagaaaagcataaaacaaagactactgaaatatagataaagattgccttagtttttaaaaatgtttggccattagtatttttataaaactcaatgctagttttaagtgtataaattggttaaaatttatgagtcaaatatatagtgataatgttaacatgtttgtaattgctacagaatttaagggtatttttatctctgtgctttctttttcatggtgtttattaaataattgtgtatatacatcctagctactgatatctttattatagccttaagacttaattttaagtcttaaaaatagcgtgtatacttgaataagaaagacactgggtactgttactgtgatgctattgacttagtagccaattatcatttctcctgtataaattccagtttttattgctgcacataaattttttaatgtcttatattgtgatagctatgtcttttattgcagatttattggatgttatgacagattttactaaagctagtgtttttataacatatatattagttgatgtttacctataagtggagtagattttcatctgcctgcaatggtataatttcagtcttagctaaaaatggaaagttgaactggataaattctttgggtacccttagacctctgattctaagtcaaatgcaaatgggttaaataaaatgagactacttcctttataaatatattttcatccttttgaaagtaagtgaaatgtaaataaacttattttttttaaaaatg

SEQ ID NO: 226 - DNA, 1831 bp, Homo sapiens
  ref <308>: DATABASE ACCESSION NUMBER: AK001295
  ref <309>: DATABASE ENTRY DATE: 2001-06-18
agttgccgctgtcgtccgcagagccagttcctagcgcagagccgcgcccgccatgagggagatcgtgcacatccaggcgggccagtgcgggaaccagatcggcaccaagttttgggaagtgatcagcgatgagcacggcatcgacccggccggaggctacgtgggagactcggcgctgcagctggagagaatcaacgtctactacaatgagtcatcgtctcagaaatatgtgcccagggccgccctggtggacttagagccaggcaccatggacagcgtgcggtctgggccttttgggcagcttttccggcctgacaacttcatctttggccagacgggtgcagggaacaactgggcgaaagggcactacacggagggcgcggagctggtggacgcagtgctggacgtggtgcggaaggagtgcgagcactgcgactgcctgcagggcttccagctcacgcactcgctgggcggcggcacgggctcaggcatgggcacgctgctcatcagcaagatccgtgaggagttcccggaccgcatcatgaacaccttcagcgtcatgccctcgcccaaggtgtcggacacggtggtggagccctacaatgccacactgtcggtgcaccagctggtggagaatacagacgagacctactgcatcgacaacgaggcgctctatgacatctgcttccgcactctgaagctgacaacgcccacctacggggacctcaaccacctggtgtccgccaccatgagtggggtcaccacctcgctgcgcttcccgggccagctcaatgctgacctgcgcaagctggcggtgaacatggtgcccttcccgcgcctgcacttcttcatgcctggcttcgcgccgctcaccagccgcggcagccagcagtaccgggccctgaccgtgcccgagctcacccagcagatgttcgacgccaggaacatgatggccgcctgcgatccgcgccatggccgctacctgaccgtggccaccgtgttccgcgggcccatgtccatgaaggaggtggacgagcagatgctggccatccagagtaagaacagcagctacttcgtggagtggattcccaacaacgtgaaggtggccgtgtgcgacatcccgccccgcggcctgaagatggcctccaccttcatcggcaacagcacggccatccaggagctgttcaagcgcatctccgagcagttctcagccatgttccggcgcaaggccttcctgcactggttcacgggtgagggcatggatgaaatggagttcaccgaggcggagagcaacatgaacgacctggtatccgagtaccagcagtaccaggatgccaccgccaatgacggggaggaagcttttgaggatgaggaagaggagatcgatggatagtcggaatagagccgccccaactcagatcctacaacacgcaagttccttcttgaaccctggtgcctcctaccctatggccctgaatggtgcactggtttaattgtgttggtgtcggcccctcacaaatgcagccaagtcatgtaattagtcatctggaacaaagactaaaaacagcagagaattgcgggttctacccagtcagaagatcacaccatggagactttctactagaggacttgaaagagaactgaggggccacaaaataaacttcaccttccattaagtgttcaagcatgtctgcaaattaggagggagttagaaacagtctttttcatcctttgtgatgaagcctgaaattgtgccgtgttgccttatatgaatatgcagtatgggactttgaaataatgattcataataaaatactaaacgtgtgtcttc

SEQ ID NO: 227 - DNA, 2453 bp, Homo sapiens
  ref <308>: DATABASE ACCESSION NUMBER: AK001380
  ref <309>: DATABASE ENTRY DATE: 2001-06-18
tttatgatgaacgctggaaggaaaagcaggaacagggcttcacttggtggttaaattttatattaacccctgatgacttcactgtaaaaacaaatatttctgaagtaaatgctgctactcttcttttgggaatagagaatcaacataaaataagtgttcctagagcacctacaaaagaggaaatgtctctcagagcttatactgctcggtgtaggttaaacagactacgtcgtgcagcatgccgtttgtttacttctgaaaaaatggttaaagctattaaaaagcttgaaattgaaattgaagctaggcggttaattgttcgaaaagatagacacctatggaaagatgtgggagaacgtcagaaagtcctgaattggctgttgtcctacaatcctttgtggcttcgaattggtctagagacaacttatggagaactcatatctttggaagataacagtgatgtcacagggttggctatgtttattctgaatcgcctactttggaatcctgatatagcagctgagtatagacaccccactgttcctcacctgtatagagatggtcatgaagaagctttgtccaagtttacattgaaaaagttattgttgttggtctgttttcttgattatgctaaaatttccagactcattgatcatgatccttgtctcttctgtaaagatgccgaattcaaggctagtaaagaaatcctttaggctttttcacgagatttcctaagtggtgaaggtgacctttcccgtcgccttggcttattgggattacctgttaaccatgttcagacaccatttgatgaatttgattttgccgttacaaatcttgccgtagacttgcaatgtggagtgcgccttgtgcgaaccatggaacttctcacacagaactgggacctctcaaagaaactcaggattccggcaataagtcgtcttcaaaagatgcacaatgttgacattgttcttcaagttcttaaatcacgaggaattgaattaagtgatgagcatggaaatacaattctatctaaggatattgtggataggcacagagaaaaaactctcaggttgctttggaaaatagcgtttgcttttcaggtggatatttcccttaacttagatcaattaaaggaagaaattgcctttctaaaacacacaaagagtataaagaaaacaatatctctactatcatgccattctgatgatcttattaataagaaaaaaggcaaaagggatagtggttcctttgaacaatatagtgaaaacataaagttattgatggattgggtaaatgctgtttgtgccttctataataaaaaggtggagaattttacagtgtctttctcagacggccgtgtgttatgttacctgatccaccattaccatccttgctatgtgccattagacgctatatgtcagcgtactactcaaactgtggaatgtacgcaaactggttcagtggtattaaattcatcatctgaatctgatgacagttctctggatatgtcacttaaagcatttgatcatgaaaatacttcagagctatacaaagagctcctagaaaatgaaaagaaaaattttcacttggttaggtctgcagttagagaccttggtggaatacctgctatgattaatcattcagatatgtcaaatacaattccagatgaaaaggtggttattacctatttgtcatttctttgtgcaaggcttttggatcttcgtaaagaaataagagctgctcgactcatacaaacaacatggagaaaatataaactaaaaacagatctcaaacgccatcaggagagagagaaagctgcaagaattattcaattggctgtaatcaattttctagcaaaacaaagattgagaaaaagagttaatgcagcactcgtcattcagaaatattggcgaagagtcttagcacagagaaaattattaatgttaaaaaaggaaaagctggaaaaagttcaaaataaagcagcatcacttattcagggatattggagaagatattccactagacaaagatttctgaaattgaaatattattcaatcatcctgcaatctaggataagaatgataattgctgttacatcttataaacgatatctttgggctacagttacaattcagaggcattggcgtgcttatttaagaagaaaacaagatcaacaaagatatgaaatgctaaaatcatcaactcttataatccaatctatgttcagaaaatggaagcaacgtaaaatgcaatcacaagtaaaagctacagtaatattgcaaagagcttttagagaatggcatttaagaaaacaagctaaagaagaaaattctgctattatcatacaatcatggtatagaatgcataaagaattacggaagtatatttatattagatcttgtgttgttatcattcagaaaagatttcggtgctttcaagcccaaaagttatat

SEQ ID NO: 228 - DNA, 1665 bp, Homo sapiens
  ref <308>: DATABASE ACCESSION NUMBER: AK001423
  ref <309>: DATABASE ENTRY DATE: 2001-06-18
tacaaatcattcatgaaactgaagctcagtctcccaggggtaagtcctgggccacgtgcaaacaatggcaaatccagctcttccatgatagagaaggcaaacacacccaccttcatcctgagcctaaaaggccacctctgagcacttgggcagccactcctctgggcctcagagggccatgagcttggccaggtaggcacagcggcggggaagtcacagctgtcaggtaccggccatggtgcaggtgggaataggagatgccagagctgctttagctgaggaaagcaaacagtcagcagtgctcaaaggagcaaaacttcgaatgtgcacattgacccctgacacctgcaagcataacacagatcctaagactagagtgaagtaggaagaagaattagaaaatccagtggatgtcctgagtatagggaaccagggccgttgaaaatcagtaaaggttgattacctggggcgagaccgggtgactgtggcagtgcaggtgaaggtaccctggaccttctcagttcgctggcacataaggctccgccaataaagcgtggttctctctgtcatacacacacacacacacacacacacacacacacacacaatgattggagggctatatgatccagcattagcttcctggtgtgccaagcatgcttgatcgggaatttttttttattattattattttttagctgtacctgaaggcatttctcggatgtggagaggagaatggaaatcgcagaaccaaatcagtttgccctgccatatttggctgtggtctgtcattgggcatttctgatgtgcttttctggattcaggaagagctgattgtcctccgagggttgaaaaaaaaaaacagtttcagaaacctgaatccagggccttatagttctcctcattatctatcttcttctcccttccctcgcccaagggagtgggggaaacacttttcattgcagagtttgctttaaagttttcccatcttgcgtgcattatcccttgatattaaaattattttctcagtttaatccaactcctgctgagaagctgtgtgagatttaggctgtggggtttttttcttgtactcttttggatggtgttgcatttttcactcttaacccgagggtgtgtttcagcttatgttcgttctgtttcatgcaggtttatagcacggtagagtagaaggcggcttctggtttttagggtatttttagaattcattcctgagtgaggggttcagacacccagtctcctcggaacaggggtgaggggtcgactgagctttgttgagaagcctccagttaggcttcgggcgggtctccatgttatattgtgtgtttactgagcttcccactggtagaagatgacacatttgtccatcgtcctgtgtatctgctttccagaggacaccggagcattctcctggggtcactcccacatggctgcctcacatagctgttttgcaacagcctttattgccaacacccttggaagaacatctcctgtagaagtacaagttttgcaatatggactttggaagtggttttgtgatgttcgaattttctgttagcctattgctcaagcactacagaatgtacatagtccctttggccatcctctcaccccagaatatcctaataaacattgttttcttttttt

SEQ ID NO: 229 - DNA, 2328 bp, Homo sapiens
  ref <308>: DATABASE ACCESSION NUMBER: AK001438
  ref <309>: DATABASE ENTRY DATE: 2001-06-18
gtgacttcgggctgtgggctcgctcgcggctcttcggccatggttttctcaaacaatgatgaaggccttattaacaaaaagttacccaaagaacttctgttaagaatattttccttcttggatatagtaactttgtgccgatgtgcacagatttccaaggcttggaacatcttagccctggatggaagcaactggcaaagaatagatctttttaactttcaaacagatgtagagggtcgagtggtggaaaatatctcgaagcgatgcggtggattcctgaagaagctcagcttgcgaggctgcattggtgttggggattcctccttgaagacctttgcacagaactgccgaaacattgaacatttgaacctcaatggatgcacaaaaatcactgacagcacgtgttatagccttagcagattctgttccaagctgaaacatctggatctgacctcctgtgtgtctattacaaacagctccttgaaggggatcagtgagggctgccgaaacctggagtacctgaacctctcttggtgtgatcagatcacgaaggatggcatcgaggcactggtgcgaggttgtcgaggcctgaaagccctgctcctgaggggctgcacacagttagaagatgaagctctgaaacacattcagaattactgccatgagcttgtgagcctcaacttgcagtcctgctcacgtatcacggatgaaggtgtggtgcagatatgcaggggctgtcaccggctacaggctctctgcctttcgggttgcagcaacctcacagatgcctctcttacagccctgggtttgaactgtccgcgactgcaaattttggaggctgcccgatgctcccatttgactgacgcaggttttacacttttagctcggaattgccacgaattggagaagatggatcttgaagaatgcatcctgataaccgacagcacactcatccagctctccattcactgtcctaaactgcaagccctgagcctgtcccactgtgaactcatcacagatgatgggatcctgcacctgagcaacagtacctgtggccatgagaggctgcgggtactggagttggacaactgcctcctcatcactgatgtggccctggaacacctagagaactgccgaggcctggagcgcctcgagctgtacgactgccagcaggttacccgtgcaggcatcaagcggatgcgggctcagctccctcatgtcaaagtccacgcctactttgctcccgtcaccccaccgacagcagtggcaggaagtggacagcgactgtgcaggtgctgtgtcattctctgacagcagctgcctgggcccaaggggtgatgaggcatcctttcctctagaagacctgagtcttcctgaccgactccaccatcacccaatctgttgattctccattgggaaaggcatttacaggtaaaagacttctgtatggattgcagttactctggtgatagttttcacctttattctgctgtgaaacaatcaaatcaaagccttgtgtcagttaacacatgacaagtggtctcaatgcagctaggaccatgccagaaacctggatctcttaagagattggtacctacctaggtacgaaagttctacccttggcatactcagcattcctcaaaaagaccatcagtgttagcacaaactgagcagaaaaaataagctgttgattttctacctgatacttaagccagtggcctactttaattcacaattccattttgattagcaggacttttccactttgaagataaatagcaactttatcaaagtgactgtactgcaaattaattcataatgcctgatagttttatatatagagacttatgtggaaggcatgttaataggtttccatgagacaccaaagaaaagaggactctatactgggtggagcagggtcttcacctttttgtttctgtcaacttgtcatatacacctccagggaccaaaaacaaaagcagctcggagtctgtgttgcctgattggaaagtagaagctctggtgtatgctacagcacataacacatttttactaaaggaaaaaagctaattatgtccatgcctctcgtaaaactggggggaaccttaaagagaaagaactaaggcttaagttatctgtagtataatcaattagaagtaatgaatggatgcatgtaaaatggatgtgattttttttcaagcttattttgaaatcttaaaaatcaggttacaccatagctactcaaaagttttacacacttaaaactcagatcagtaagtgttggtaccttttagactcataaaattgaataaaccattgcaatgcttt

SEQ ID NO: 230 - DNA, 2593 bp, Homo sapiens
  ref <308>: DATABASE ACCESSION NUMBER: AK001492
  ref <309>: DATABASE ENTRY DATE: 2001-06-18
gtgctaggagatgatcggggaaagcatagtcccctgtctgtggcaccagacactcccgactgtgcgctgactctccccgcccagccagcagccttttccagagaggctgtggtccatagcctctgttcgttttcactgcaggaccaggcacgaaagttaaaacaaaatgaagattttttctgaatctcataaaacagtgtttgttgtggatcactgcccttatatggcagaatcttgcaggcagcatgtcgagtttgatatgctggtgaagaatagaacccaaggaatcattcctttggcccccatatctaaatcattgtggacttgctcagtagaatcttccatggaatattgtagaataatgtatgatatatttcctttcaaaaagctggtgaattttattgtgagtgactctggagcacatgttttaaattcttggactcaagaagaccaaaatttacaggagctaatggcagcattagccgctgttgggcctcctaatcctcgggcagatccagagtgctgcagtattctgcatggccttgttgcagcagtggaaactctctgcaagattactgaataccaacatgaggctcgtactctactcatggagaatgcagaacgtgttggaaatagaggacgaataatctgtattactaatgcaaaaagtgatagtcatgtgcgaatgcttgaagactgtgtccaggaaacgattcatgaacataacaagcttgctgcaaattcagatcatctcatgcagattcaaaaatgtgagttggtcttgatccacacctacccagttggtgaagacagccttgtatctgatcgttctaaaaaagagttgtccccggttttaaccagtgaagttcatagtgttcgtgcaggacggcatcttgctaccaaattgaatattttagtacagcaacattttgacttggcttcaactactattacaaatattccaatgaaggaagaacagcatgctaacacatctgccaattatgatgtggagctacttcatcacaaagatgcacatgtagatttcctgaaaagtggtgattcgcatctaggtggcggcagtcgagaaggctcgtttaaagaaacaataacattaaagtggtgtacaccaaggacaaataacattgaattacactattgtactggagcttatcggatttcacctgtagatgtaaatagtagaccttcctcctgccttactaattttcttctaaatggtcgttctgttttattggaacaaccacgaaagtcaggttctaaagtcattagtcatatgcttagtagccatggaggagagatttttttgcacgtccttagcagttctcgatccattctagaagatccaccttcaattagtgaaggatgtggaggaagagttacagactaccggattacagattttggtgaatttatgagggaaaacagattaactccttttctagaccccagatataaaatcgatggaagtcttgaggtccctttggaacgagcaaaagatcagttagaaagacataccccttactggcctatgatcatttcacaaaccaccatttttaacatgcaagcggtagttccattagccagtgttattgtgaaagaatctctgacagaagaagatgtgttaaactgtcaaaaaacaatatacaacttagttgatatggaaagaaaaaatgatcctctacctatttccacagttggtacaagaggaaagggccctaaaagagatgaacaataccgtatcatgtggaatgaattagaaacccttgtcagggcccatatcaacaactcagagaaacatcaaagagtcttggaatgtctgatggcatgcaggagcaaacccccagaagaggaagaacgaaagaaacgaggaagaaagagggaagacaaagaggacaagtcagagaaagcagtgaaagattatgaacaggaaaagtcttggcaagactcagagagattaaaaggaatcttagagcgtggaaaagaagaattggctgaagctgagattataaaagattcgcctgattccccagaacctccaaacaaaaaaccccttgttgaaatggatgaaactccacaagtggaaaaatcaaaagggccagtgtcgttattatccttgtggagtaatagaatcaatactgccaattccagaaaacatcaggaatttgctggacgtttgaactctgttaataacagagctgaactatatcaacatcttaaagaggaaaatgggatggagacaacagaaaatggaaaagccagccggcagtgaagagtgacttgaagaactaaatttagcatattgcaaaaatattttgtgcggaattcgatataagtacttttacagcaagatggtatagttatgttgcctggactggtttttacatttttaaaatatttcagctgtcatttttgtactaattataaaattggcacataattcaaaaatatacatttgagatgatttgtcctcccaaattatacaagtttattttatggtataaagtgttctctctggaaatgtttttaaaaaaattcttaggcttctctttgcgaaataaaactattaaaatatttg

SEQ ID NO: 231 - DNA, 2635 bp, Homo sapiens
  ref <308>: DATABASE ACCESSION NUMBER: AK001499
  ref <309>: DATABASE ENTRY DATE: 2001-06-18
gcgctcctgctcttaggaagcctgggaaggaccggtgtgctaggagatgatcggggaaagcatagtcccctgtctgtggcaccagacactcccgactgtgcgctgactctccccgcccagccagcagccttttccagagaggctgtggtccatagcctctgttcgttttcactgcaggaccaggcacgaaagttaaaacaaaatgaagattttttctgaatctcataaaacagtgtttgttgtggatcactgcccttatatggcagaatcttgcaggcagcatgtcgggtttgatatgctggtgaagaatagaacccaaggaatcattcctttggcccccatatctaaatcattgtggccttgctcagtagaatcttccatggaatattgtagaataatgtatgatatatttcctttcaaaaagccggtgaattttattgtgagtgactctggagcacatgttttaaattcttggactcaagaagaccaaaatttacaggagctaatggcagcattagccgctgttgggcctcctaatcctcgggcagatccagagtgctgcagtattctgcatggccttgttgcagcagtggaaactctctgcaaaattactgaataccaacatgaggctcgtactctactcatggagaatgcagaacgtgttggaaatagaggacgaataatctgtattactaatgcaaaaagtgatagtcatgtgcgaatgcttgaagactgtgtccaggaaacgattcatgaacataacaagcttgctgcaaattcagatcatctcatgcagattcaaaaatgtgagttggtcttgatccacacctacccagttggtgaagacagccttgtatctgatcgttctaaaaaagagttgtccccggttttaaccagtgaagttcatagtgttcgtgcaggacggcatcttgctaccaaattgaatattttagtacagcaacattttgacttggcttcaactactattacaaatattccaatgaaggaagaacagcatgctaacacatctgccaattatgatgtggagctacttcatcacaaagatgcacatgtagatttcctgaaaagtggtgattcgcatctaggtggcggcagtcgagaaggctcgtttaaagaaacaataacattaaagtggtgtacaccaaggacaaataacattgaattacactattgtactggagcttatcggatttcacctgtagatgtaaatagtagaccttcctcctgccttactaattttcttctaaatggtcgttctgttttattggaacaaccacgaaagtcaggttctaaagtcattagtcatatgcttagtagccatggaggagagatttttttgcacgtccttagcagttctcgatccattctagaagatccaccttcaattagtgaaggatgtggaggaagagttacagactaccggattacagattttggtgaatttatgagggaaaacagattaactccttttctagaccccagatataaaatcgatggaagtcttgaggtccctttggaacgagcaaaagatcagttagaaaaacatacccgttaccggcctatgatcatttcacaaaccaccatttttaacatgcaagcggtagttccattagccagtgttattgtgaaagaatctctgacagaagaagatgtgttaaactgtcaaaaaacaatatacaacttagttgatatggaaagaaaaaatgatcctctacctatttccacagttggtacaagaggaaagggccctaaaagagatgaacaataccgtatcatgtggaatgaattagaaacccttgtcagagcccatatcaacaactcagagaaacatcaaagagtcttggaatgtctgatggcatgcaggagcaaacccccagaagaggaagaacgaaagaaacgaggaagaaagagggaagacaaagaggacaagtcagagaaagcagtgaaagattatgaacaggaaaagtcttggcaagactcagagagattaaaaggaatcttagagcgtggaaaagaagaattggctgaagctgagattataaaagattcgcctgattccccagaacctccaaacaaaaaaccccttgttgaaatggatgaaactccacaagtggaaaaatcaaaagggccagtgtcgttattatccttgtggagtaatagaatcaatactgccaattccagaaaacatcaggaatttgctggacgtttgaactctgttaataacagagctgaactatatcaacatcttaaagaggaaaatgggatggagacaacagaaaatggaaaagccagccggcagtgaagagtgacttgaagaactaaatttagcatattgcaaaaatattttgtgcggaattcgatataagtacttttacagcaggatggtatagttatgttgcctggactggtttttacatttttaaaatatttcagctgtcatttttgtactaattataaaattggcacataattcaaaaatatacatttgagatgatttgtcctcccaaattatacaagtttattttatggtataaagtgttctctctggaaatgtttttaaaaaaattcttaggcttctctttgcgaaataaaactattgaaatatttgaaatgc

SEQ ID NO: 232 - DNA, 2833 bp, Homo sapiens
  ref <308>: DATABASE ACCESSION NUMBER: AK001630
  ref <309>: DATABASE ENTRY DATE: 2001-06-18
aattcatgggacttatataagaaggacaattaatgctgatttgggtacaggggaattatgtgtgtgaatgtcatctacaattaaaaaaaattagcacatccctttacttacttgttatcagtggattctcggggtttggacttaatgttgagctaagaagcattaagtctttgaactgaatgtattttgcatccctggttttggacgacagtaaacgtaggagcactgttgaagtcctggaagggagatcgaaggaggaagattgacttggttctttcttagtcctatatctgtagcatagatgacttggaataaaagctgtatgcatgggcattacccctcaggtcctaagaaataagtcctgaatgcatgtcgttccaaactaacactctgtaatttttcttttatgtcttattttccaagagtcctccattttttgcaccccctcaccgccaactctgttattcagtagagagaagtgtacggctttctgattggtgagtgaaaaagtaacttgagacacgacctaagttgaagagtttagacttgctgagttttagaagtgatggaaattaagagagcatttcaataaaatgtgacttggctgtctttggaagagaagtgcaaggctttcctttgaagaatttaaattagtccggtaggatgtcaggtgagactgtgtatgcaaaatgaatggcacaggtgatgccagggcctcttgcttgggtctgatgtcttggcacagggtaagtgaaggttaattccagaagagaggaatgacttgaaggcaaaggaaactaaggaaggaggttcagtgaggaaaataaggttgtccatgagatttgaatagatttttagttcccccaaggtttaaatacaaacatagtcaagcaaggtagtcatctttctgctggttgtgagggggaatctgaaaatggagttttagaggaaaagtcaacatctaactagtgagggaaagtgcctaatacaattagaatctccctcactctatagttgcccagttgaaaggataaggaggaggggtggcttttatggacttccatgagagaaggaaagaaatatttcaggtaagcttctcagggctggccctttttgggatttggatgagaaattggaagtactaactactttctagcatatctttaagaaaattgattgttatttactcccagatcctcttgcagacccagaattatcaggaacatagctctgtgattcatgagtgtccccatactgatgaattggagcatccatatggaaagcaaaggcagaattatcccagctgtattattttgatcttttggatgcaggtgccttaatgaagctctcaaaatattttaggagctgctcagggagtgttgggtggaactgtttggactacattgttttctcttagattatgtgatttttgttgggcactggcaaaaggtgtgtgtgtgaatgtgtgcatgtgtgtgaatgttgtgtgtgtgtgtgtgtgtttgtgtgtgtgtgtgtgtgtttgcagacatgcaaaactgcagctgaaataataccttagatttctaggtaagtctttccacatttcaataatgggtaagagtagaaccagggccgggtatcaattattgcttgctgtttgcaaccaggcataaaatcactttctcaaatcatccaccgttcctattaaatttatgccggaaactctccttctgtgagtataactcctgcagttcctatagcagataagatataagaaagtgcctcctagtgctcctccgcccgcttgtttgctaaaattccctttctctctaagtccaccattttcaagatttgtagatagtgtattagttaagacagctttgtcgatctggccagatgttttttctcctttgtccaaaggccagagaccatcccaggaagagtggtgggtggtttatacactggaaatgttgcgtttatgctttttaaaaacacacgttaacttcagaggaaggatgggcaaatctggtctagctgggtgaaacccttattttcccagagatgccttaacctttgttggttttggctttagggttcagagtcacttttgttcccttctccattctggagagggacttcccctacatagagccctgatttttgtggctgtggggattggaggtagcattcaaagatcagatgtgcttttcctcactttggagatgaacactctgggttttacagcattaacctgcctaaccttcatggtgagaaatacaccatctctcttctagtcatgctgtgcatgccgcttactctgttggggtctatataaatttgttgaactcttacctacattccaaagaagtttcaaggaaccataaatatatgtatacatatacatatataaaatatatatattaaaataaaattatcaggaatactgcctcagttattgaacttttttttttaagaatactttttttttaagctgagaagtatagggatgaaaaagatgttatattgtgtttgactattttccaacttgtattttcatataatttatattttttaaaagctgaaaatttagaagcaagatgaaaaaaaggaaaagcaggtgctttttaaaaatcagaactgaggtagcttagagatgtagcgatgtaagtgtcgatgtttttttaaaaaaaaatgcaaaaaaattcttatggcggagttttttgtttgtttattttagtagctgatgctggcacatcattttgctggagagttttttatatactgtagcctgatttcatattgtattttaaactgtgtgaaattaaaaacaaagaatttcattcataatgct

SEQ ID NO: 233 - DNA, 2116 bp, Homo sapiens
  ref <308>: DATABASE ACCESSION NUMBER: AK001838
  ref <309>: DATABASE ENTRY DATE: 2001-06-18
tttgttatgtgcagagttctaaagccattttataatactgcagtatccccccccccccacctttttttttttgagacggactgtctgttgcccaggctggagtacagtggcgcaatcttggctcactgcaacctccacctccctggttcaagcaattcccctgcctcagcctcccatgtagctgggattacgggcgcacaccaccacacctggctaatttgtattcttagtagagacggggtttcaccatgttgaccagactggtctcgaactcctgacctcaggcaatctgcccgcctcagcctcccaaagtgctggaattacaggtgtgagccaccgtgcccggccaagtatctcttttctacagccttattaaactaactacaaacatttattttccaatttagttttactttcagtgcatatcaaagttgttgtactcttcagaccaacaaattaacttgagggcaaattacatagctttccatgtacccttttttcctcaggtgctaatcaaaggctctgaaaatggatactgctttagtgatgtctgctttattcttaaaatgcttatttcttttgctagatgtaaagatttggtgttaacaaaagtggttttaatatgtaaatatgaatgaatgcctttagtttaccctgtttgtctattattaatctgttttcatttatccttcatagaggaggatcctttcatgatcttgaatacatttcattagatattgttgcattttaagaatgaaaatacaactgttttctgtcttagattaatcctgctgctatgagaaactgaaaatcaagaatgtgatgcactttttacattactatataccatacatataccataggttgctttgatacctttcctgtagcacagccactaacaagagtgaatgaattataaaattctttttgggagggaatcaatacaagtaactaattcttagctgatattgtcctatgaaggacaataacttaggaatataagaattctgttaatagtacactttttggccttaaatgtcttctactactgaaaaaagtttaaatcttagctttgtttctattattccctctctctgcctcagaaagaggaattgggaagaatggcttaaaggacgtggtgtcattgatttgttgctgatcttttagaaaacatttgtctatgtaagctggggacttattttttgtttgtatatagaggggaaatagtgctgccctgaaccaatcagatttagtttaaatcaaatcaatcaaaactccagctgtttctcttgtctttttacttagcaaaggaaaactttagtgaatgctacttgacaagaagaaaagtcatttctcaagcacatacccaaacttgaaggtgattgaacccaaaataatgggtgggaaacaccaaatgaggtggaggaatgagaaagatgtgtgggccaaagctatctggttatattttgatgttgccaatatcgcaaagccaaaattttaatttgcttatttaatatatttgttggccagagatctatttttatatcaatgtgccttgcatgtatattaaaaaaaaaaattggaaacgccatgtagtaatgcctgagatagtcgatggttcttaccacctcactaatttttatgcagtatgaaatgctcattctattgcccaactggtgctctctgtttaaagttacagatcttgcgaaactggaactattttataagctggggaagtgatttactttttttgttgtatcttttttgttcttagtctgttagtggctgtcctgtagtgggaaatagtaaaaggattcttcactcccttctcccctcagcaccttcttcaagtaaacatttcttgtgtgctttgaaaaaagtttcagcttgctgtctcttttagtgttttaaagaagtgttatacaaagcattgtttgcaaaatatagggagataatggagtccactttaatttggaattctgtgtgagctatgatccaagttatcagctctttccaactttaaaaattttgttaaaagcaccttgcttagaaaattttaaatatttatgtctgcaacaattgtctcaaaataataaactgtgcaattcttgtcatt

SEQ ID NO: 234 - DNA, 1819 bp, Homo sapiens
  ref <308>: DATABASE ACCESSION NUMBER: AK001872
  ref <309>: DATABASE ENTRY DATE: 2001-06-18
gtaccaatgcataatcatctatggggtcgcctgggactacaagtacctgactctgaaagtcaaagcttcctacaggaaaataaacactcacatcctaaaggttccagaaacagatgaggtagagctcacctgccaggctacaggttatcctctggcagaagtatcctggccaaacgtcagcgttcctgccaacaccagccactccaggacccctgaaggcctctaccaggtcaccagtgttctgcgcctaaagccaccccctggcagaaacttcagctgtgtgttctggaatactcacgcgagggaacttactttggccagcattgaccttcaaagtcagatggaacccaggacccatccaacttggctgcttcacattttcatcccctcctgcatcattgctttcattttcatagccacagtgatagccctaagaaaacaactctgtcaaaagctgtattcttcaaaagacacaacaaaaagacctgtcaccacaacaaagagggaagtgaacagtgctatctgaacctgtggtcttgggagccagggtgacctgatatgacatctaaagaagcttctggactctgaacaagaattcggtggcctgcagagcttgccatttgcacttttcaaatgcctttggatgacccagcacttaaatctgaaacctgcaacaagactagccaacacctggccatgaaacttgccccttcactgatctggactcacctctggagcctatggctttaagcaagcactactgcactttacagaattaccccactggatcctggacccacagaattccttcaggatccttcttgctgccagactgaaagcaaaaggaattatttcccctcaagttttctaagtgatttccaaaagcagaggtgtgtggaaatttccagtaacagaaacagatgggttgccaatagagttattttttatctatagcttcctctgggtactagaagaggctattgagactatgagctcacagacagggcttcgcacaaactcaaatcataattgacatgttttatggattactggaatcttgatagcataatgaagttgttctaattaacagagagcatttaaatatacactaagtgcacaaattgtggagtaaagtcatcaagctctgtttttgaggtctaagtcacaaagcatttgttttaacctgtaatggcaccatgtttaatggtggttttttttttgaactacatctttcctttaaaaattattggtttctttttatttgtttttaccttagaaatcaattatatacagtcaaaaatatttgatatgctcatacgttgtatctgcagcaatttcagataagtagctaaaatggccaaagccccaaactaagcctccttttctggccctcaatatgactttaaatttgacttttcagtgcctcagtttgcacatctgtaatacagcaatgctaagtagtcaaggcctttgataattggcactatggaaatcctgcaagatcccactacatatgtgtggagcagaagggtaactcggctacagtaacagcttaattttgttaaatttgttctttatactggagccatgaagctcagagcattagctgacccttgaactattcaaatgggcacattagctagtataacagacttacataggtgggcctaaagcaagctccttaactgagcaaaatttggggcttatgagaatgaaagggtgtgaaattgactaacagacaaatcatacatctcagtttctcaattctcatgtaaatcagagaatgcctttaaagaataaaactcaattgttattcttc

SEQ ID NO: 235 - DNA, 2567 bp, Homo sapiens
  ref <308>: DATABASE ACCESSION NUMBER: AK001890
  ref <309>: DATABASE ENTRY DATE: 2001-06-18
acgtccccgccgggcccgcgcgcctcgtgcctcgcgcctcgcgcctccagccacgtccccgccccggctccggcgcgccgcggagttggctgctgggaggtgcgggactgggtgtggccggcggctctggtctcggctgtgagctgcgctctccacgccggctccgcgctccaggggctgctgagcgcccagcggacaccggcagcgcgcggtcgacgcgggcctgagctccctccagctgttttcactcattagctcctgaggtaaacaaattgaaaaaatgagcgaactggaacagttgaggcaagaagcagaacaactgcggaatcagattcaggatgctcggaaagcatgtaatgatgcaacgcttgttcagattacatcaaatatggactccgtgggtcgaatacaaatgcgaacaagacgtacactgaggggccacctagctaaaatctatgctatgcattggggatacgattccaggctgctagtcagtgcttctcaagatggaaaattaattatttgggatagctatacaacaaataagatgcatgctattcctttgaggtcctcctgggtgatgacctgtgcttatgctccctctggtaattatgttgcctgtggaggcttggacaacatctgctctatatataacttaaagaccagagagggaaatgtgagagtaagccgagagttgccaggtcacacagggtacttgtcctgctgtcgttttttagatgacagccaaattgttacaagttcaggagatacaacttgtgctttatgggacatcgaaactgcccagcagaccaccacattcactgggcattctggagatgtgatgagtctttctttgagtcctgacatgaggacttttgtttctggtgcttgtgatgcctcttccaaattatgggatattcgagatggaatgtgtagacagtctttcacgggacatgtctcagatatcaatgctgtcagttttttcccaaatggatatgccttcgccactggctctgatgatgccacttgccggctctttgaccttcgtgcagatcaagagttattattgtattctcatgacaatatcatctgtggaatcacttctgtagccttctcaaaaagtgggcgtctcttgttggctggttacgatgactttaattgtaatgtatgggacacgctaaaaggagatcgtgcaggtgtccttgctggtcatgacaaccgtgtgagctgcttaggtgtaactgatgatggcatggctgtggcaacaggctcttgggacagttttcttagaatctggaattaacagtgtcatacatatttgttctccattgatatatctggagaaatcaatgctacagcctatagctgtgaaaaaattctaccttatatttgcaggtgaagatttttctattagattatctacaaaaacaagctttcagtaaactaccaaaaaaaaagtgggggtggaggaaaaaaggcaaaggcgccttctgagatcaaaaggaccagtgtattaatttgaggggttgggttattttaaccttggtgaattgttgtgtgtactcagagtgtattttctttgtgtagaacagaatgtacacattatagcagctcgccattgtgtttgcattttttaagaagtacatttttaactttgtatacacaagaaatgtcatatttttgagttttgtaatggaagaaccaggcacagaaacagacagaaatgatactgtatgtgtgtgtatttatgtctgaagaaagtccccttgaattctgatatctctttgaatctaagagatcctgatagcttcatgtttaagagcattgacaggtggggcacctctgaggggagttcattgtttctcatgcatcatttgccatatactattaatcaaagtgcttgcttgcagtcctttgaggggacagataatctgaaggccagagattagagatttcactgatattttggacatacataagaaacatcattataattaataaaaagtaggtaatagcatataaatggttcttgacattttaaaagcctggttatgatcagttgacactttgagtacccccctaaatagctggactttccttttcatttcatatttggaactaagtttgtagcgtatactcatctttcagaagtttggtaaacattgggattgtccctgcatctgaacatctttcccagtgctatcagtatacatctagagaggaaatgcaatgtgacagtgttacatttggagagaagtgtgaaatctaaccaatcgctagcacatatttgttgtaacacggtggtttatttcatgtttgcatactataaaatctgaattgatgtgaaatatctgtgcctttaaatttcttaaacctttaagctttttgttctgttttgcaacattttgtagtatttcttcccttccttagcacaaaatactggtttctaagtggttttgcttcaaaggatgtctagatgtaagtgattccacttaaagccaaaataaaaattcctaaagcagttcttaaaggagttagagagctatattaaacagtttttctgtggt

SEQ ID NO: 236 - DNA, 1997 bp, Homo sapiens
  ref <308>: DATABASE ACCESSION NUMBER: AK002016
  ref <309>: DATABASE ENTRY DATE: 2001-06-18
ctacaatttttggactcaagcaaaaagccagattttttggaaccaactgaggaattctgtacacaaagcttcagcaaacacttagagaaaacaaacaaacaaacaaactgggtccttggaaacagttctggcacacaggcagaacactggaggccacctcaaaggacagaggccatgctttcgcatttggaatgtggctctgccacacagctcactcctatggtggggtcagaggtcagaacacaaaccacccatgtgggctctgctccctcccaacactctgtgttcccacagggcttctctgcgggcagccaggcacctgtcaggcttgggcaggggcctgctgagaatctgtgaatgcagaggggagggctcatggccaggattccagccagagatgaatttccatgctctgggccagggctctgtgccggcccctcatgaggtggctggctgcattatggggagatgctgcccacggcggagatggtggcagtggctgtgaagaacagaggtacctgaattctgtgtcctcagctgtcactttccggtgagacaagtggagcagggcctttgatcactgtggtcacagacctggtactgggttttgcccttgtgtgctcaaacatttctaaggtgtcccaagccctggaaatagggaagggaagggtggaggcttggatctgaggtcttgctgtccactccctgcctgcctgcccgcatctcaggcatggccaacagcagcccgttgaggggggcttgtctggacagttgcgtgtgatggtgttgagccatcacagggcagaggtcacttgtgtcacccccatagtcattgggttgcaggccatggaggagggacctccactccatggggcctattctccattaaggtggaagtgtccactgtgggcctagcacagtgcaggaaccaggccagggggtctatctcatacctctggggacaggaaaggtagaggatgaggaggttggacgtggtggtggctttgccttggatattcctcttcctctatcaaggccttctcttcttctctgtgtcccacaactctggcctcatcgccctgggactcccatctgctaagatagtggctttggaggttctggaagggcttagtgaggaggccagaagtatcagggaaagttgctggtgatggggtgggcggtgtcagaagcagccactgttttcccctcttcagacactgagagattaatcagggaatgaaatccaggtggaaattatttattgtgaagcagacgactgtctgtcctgtttatgacaaacccaaatgagaattggagggactaccagtaagtggtctcttcatgctctccccatcccagtttttaggatgaaatttagagcctggccttttgtgttgcttgcaccaaatctgtatgtctcaggtgaaactcactgttccatgagtggtcatcctttttttttttttttttggaaccagcccctttcaccctttcatccgtcttttttttttaggaaaataacccttcttgcttcagcacttctccctggtccttgctgaaagacagagataaaaatccattctctgagccttgcttggttgtcagaggccatgagaggtgccagttataggtggatgtgccaagatgctggtgaacttggtcttcagctatacccaggctcagaaagggcaagagccatgctgcagcgtaggtgactttggaggtgcacttggggcccagggctttgagtgttgcgggtgtgcctgtccctccagatagtgctctgtttctctctgttgtccccctgcctggtcctctggggccactgtgctttctgctgtgtgcatttataaatgatgtgtattttatatagacctgcttgcattggctgatgctcctctaattccctgagtttgattcaaccacccttgggttgttttgctatggccttagcctttgaaaatattttaaaataaaaaacttgatttttctagtgt

SEQ ID NO: 237 - DNA, 1913 bp, Homo sapiens
  ref <308>: DATABASE ACCESSION NUMBER: AK002088
  ref <309>: DATABASE ENTRY DATE: 2001-06-18
gttttgtgtggacataagttttcagttcatttgagtaaatacccaggagtgtgattactggatcttatggtaagatatgtttatgtttgtaacaagattgccaaactgtcttccaaagtggacatccagatgcataaaaatgaatctagatattttgcatttcctgtaccattttgtattctccactagcaatggatgagagttcctgttactccacattttcttcagcatttgttgttggtgttttggatttgggccattctaataggtgtgtagtggcatgcctttcttgttttaacttgaaattccctaatgacatgagtttgaacagtttttcatacgcttacttgccatctgtttatctttggtgtgaggtatctgttcaggtatttcacccattttataatcaggttgttcattttctttagttttaatggttcatcgtatatttttgataacagttctttatcaggtacatcttttgcaaatattttctccaaggctgttgcctgccttgttctcttgacattgtcttgcagagcaaaaaaaatctaggctgcagttacagatttggaagttaagagcatattggtgctattgggagccgtaaaactgcataagataaccaaaacagtatatgtaggtagaaaagagaagagtgtaaggtcttagctctggaggactggtgatatttaaagcttagggtgataaggaataggaatagagagtgagaacgaggggccaggaaatgtaggaaagctaacaaagtatgttattctaggaatgaaagagaaagtgtatcaaggaggatgtgattggctgtgtcaaatgttgctggaccagtcaaataatatgaagattgagaaatgatcattgggtgtagtgatgaggtcattggtgactttggataagagctgtttcagtggagtaatgggaggaaatgcctgttgggaatgagttcaagtaacaacagaggagagaaactgaagatagcagatgtagataagatttccaaggagttttgctgtcaaggaaagatgattgagatggaaactcgaagggagagagaaatagagattttaaaaaataataataaagttgggagaaagggcattgttggattcttattggcatcactcaccagagaaggaaaaatggatgatgattcaagacagtggaagagacagagagtgtcggtcagttgctagcctctaatatgatttgtttaaattagagtggactcagccctgcaactgctcatgtcccttcctgaccccttcccatcttgccgtatgttttgactaacagatggtacatttatgagaatgaaaagaggcccctaatccagacaggtagccaacactacctggattttaggactggattttagccttcacttgtcctaaactaggtgtctttgggtacagcaaagtaatcatactaccatagcttctctgcttagtctactccaagacaataggaaaagttatttactatcctgcaatagttaaatgtacactttgtcctatagttaaatgtacactttgtccgatggcaaatagcatgataagtgggaagagagcacatttaagaactaagaatttggtgtgggaatccaagctcttctatcaactggcagtaaaatatatttgaggagagtttaaggcgtatgagtcgtcttaccaacaagtaattatgagtttagattttatttgaactatctctcttgtttgtattttataaagtaatggtgtgttaagcgcagtgcaccaaaatgtaactaagacttagtagcacctaggactcagatcttggtttttcttacaacattcgcactgaaaggaaccctggctctttggaaaaatggctgattccaaggatgggattccttatgccaaaggaaggaaatgctt

SEQ ID NO: 238 - DNA, 2714 bp, Homo sapiens
  ref <308>: DATABASE ACCESSION NUMBER: AK002107
  ref <309>: DATABASE ENTRY DATE: 2001-06-18
atctgcaagggggaaacaggattttggcagcaatcctttcattactaaagcttcctttcttttcgggtacagtgaaaagagccaaggctgtgtgaccccctcatcacttagccaggcgtatggtcctggtttctgaggctgccagaaagcatcttagcaatttgtgtttggaaggtccatgcctgactattctaggctggaggttcctaaagagtaacaagaggaagagaaacaagaatctctgacacttgttgagaatagagcacagtcccatttgtttgaaaagagacaccaggcagccatgtttatgtgccagaaatgcattccacctcaaggaggacttaatttatggacccgtgtgtgccaggctgagctgggcaagatctttctcaggacaaactctgccatgcagctaaaagcctggaaactaaaggatttcatgtagtaaactatcttccaacccctgtaggcatcagaccacaggatgaggtttcagaaggtcataaggcagaatagttaagcctacagggcttacagtctgacagacctgggttcagttcttgggtcttcatcactagttttgtgacttcgggaagatgactcccggagcctcagtgagcctcagttacttcatatgtaaatgaagtaatactatctacttcacaaggctgttgaaaggattaaatggagaatgggtgtaaaacccttagtgcagtgccgtgcacacaccgtagatgccgaacgtgtgatgttggcactacacaatgtgtaatcccaatcaggcagagctaggcaggcaaatctaatccaggatctttgtaaggggactgagaaccagagactggagaaagccagtgtaaacaccatgagcaaaggagcaagagaaggggcattgtgtaagtaggagatggagcttggacttactaagtggatcagggtagaagaatccagtcaggaccaagggaggagagtccaggaaaatgccatgagcagctctgtagcatgaccttgttgggctgggttaaagtagggtctgccaccagtcatgtgacagaaaggtacctcatgcacttcctccttcccccagaaatcagcctccaggagtgaggaatgagcccagaatgagagtttagagtgctccagagcctttgttagaggtgccctccgacattcagaaaaccaggattccagagacctgggtttgagtcctgactttgcagcatactaactgtgtgatcttgaaccaacatattttcacctaatgaggctgacaatcttccctacttcacaaaatagttatgagagtcaaataaaagtacattttagaaagtgaaatgctgtggacatttaaggtggagccactgtgagagtctagggggacagatggtagtcgtctcagaatgaaacgaatacacccctctcagagccctttccaaggatcccctccttctttcagctccttccctccacctcaatacacactcctgtcccaggaacctaacctcatctagaaataccagggccagcatgccttacacctagaggtttggttggcttcagagaaacttctggaggctaaaagcagccaagaagaatcagccactacatgctgggcctggatgaacagagcagtgagctgtgatggggctggggctggggcccaggaggagcaggcaggagagtttgtatgcaccgtgattcaaatattataacaaaaatcatcgatcatgtgttaggcactttacagttcccaaagcactttcccatccatgccctgatggtctttgacacaacactgtggtgtgggttttattatttccagtacagatgaggaagactgaggcctgcatcagtgaagcaacctatccaagactacatagagaaggcagtaaatggcagggttagtctcagaacaggggagggtctgttccccccgcagtgggcagtcctaattctgaacttcacctatctgggggtgatagaggggaacaagaggaagcctgctgaagagaaaacctaaacatctgttttgtctacgtatgacttcctctgcttgtgggagagaaggaaggaaaggaacacattgttgtcagccccacaaccccaacagaattaaaccctggagcaggttgaacagcagaggcttccctcagatcaaggagccaggagcagatgatctatctctgtggccacacagagagatgtcaccttatgcaatttgcatatcatattcaattcccccaactgctctttctaatttattcaactggggaccaggctggtctcatgccaacctaggagatgtaccatagcagtatgagcagaattcctcaggaggaacaattagcaaaaactgcagttgcctctcgataggcctgagcagagagaggaacaatagctctcacgtctctcctcatcagattctaactaagcagatgttctcatgcttttttcttcttcctatgttctgtatactgacacctcttctcagtggcatatgaaatatgaaatgtcatgtgttgtgagtttgtatgaatataaaggaatatatatacacagtagcaaaagagaagatctcatttacaaatatctatggtgtttccttgttctgtgttgatctgttttattgatacaaactgaattttcttaatgtatcttctatctctattatagtggcaatgatggtatatgcattaaagttcttctgaattgtg

SEQ ID NO: 239 - DNA, 1984 bp, Homo sapiens
  ref <308>: DATABASE ACCESSION NUMBER: AK002197
  ref <309>: DATABASE ENTRY DATE: 2001-06-18
ttctgatgaatgtgtgaaagagttgattatttcaacagtattggttaagtcacaacgacgaagtgctgagaaggttatgggtaccaggaagaaacaaacagaagtcttaagattagaatgagaaccaaagagaatttaaccctgccattttttttttttttaacaccaagatcctaagtaattccaaatgccttagatatcaatgaaagctacacaccattgagatgggcaaaattctttctctacaaagggagtaatcaagtaaatacctgttctctttcaatggactgttgcctattgagcattgtggatgatgtgttttcagatttccaggtgaagttctgaccctacctgtttggccaaagacgtaaattgagaggaaaggccttggtcttcctgatcaaccagcatttaacgaacagtggcttaatgcagatcactcaagaggcagcatagcaatgtaaaaggaatataagtaggtgttggatgcctttttcctagaccaggaatggggaatatataacacctgtgccaccgctcttttaaggaggcattatgaatgagtgcagcattcctgtcctctgtgccaggatttggtcttagaatccatgtcagattggtgcttccagacatctattcccagtccatcagagtgaaatgaaggctatttgccatccctgccttagacagaggagtgaaagaattaagtgggtagacaccaaccaaaatgactttgaaagcagtgagctgattgagctccagttctgtggttaccagaaatactgagtgtctgtcatgtgcaagacaatgctaagaacagaatacagacataaataagtcacggcccatgaccttgaagagcttacggccttataaagaggttcactgtaattgtcttcaccagggcgtccttctcaaagatgcccacttttgtctggcacattggggctcggtggtctggtggtcccttcggtcttggccctatctgtcctttgtttttgtgatttactaacaatcatcacgaaccagttttgtttttcttttaaatttgaacatcacatcttgtgttttagttttttgctctatgatttttttctcactgcttttcagtcttctctgtacttcatttttgtgaaaaagtgaaaatcacatataatctttatttaaaaatgctcaccaaccactgcagactttggagttagggattcagcagcttgttccagtgaaaaggaggagtgaagctggggaagttagtatctaagaggggcaagctgattgcatgtgcatttatacctatgcctttaaaatattcccataaaaagtattaataaagaaatttccattccacactagtactgatgaaaaggtggttgattttgccttgtgataattatcaaaggatagtttttcatccttagattttattcacatgagagattttttttattttctctgttgacttaggaacacatcataaattcaccccaactgacacgttgctgacgtctgtacttgacataaccatttttattcatacaggaagcattaaatataaaagatggtcagttttgaagagcaaagggtgctgaaatgacttgtacggttggctggtgctttctcaaatggattgccatagttcattactagtaaagaaaaggaaaatgtgatttacgttgtcatttttcctattaaaaaaaacccttaagaatggggcacttgagctgtccctgcaatgttttcatatctagtagtcattttagggaaagtgataatctgtagaatgaatagttatgttttgatatgactgatactttctttgttaaaaggttgtattaagtcttcaatttcaagtctagcttaaaagtgtaaacattatgtgattcatttgaatacaagaatgcctatgaaatacccactataacagcattccttttgtgtttagaactatagaagaaaatgtcttcaaataaagtagttttcagtc

SEQ ID NO: 240 - DNA, 2503 bp, Homo sapiens
  ref <308>: DATABASE ACCESSION NUMBER: AK002206
  ref <309>: DATABASE ENTRY DATE: 2001-06-18
aacaatgcaggcctcaaagtccacaggaggctccatactggggaaaaaccatataagtgtgatgtgtgtgggaaagcctatatctcacgctctagccttaaaaatcacaaaggaatccaccttggggagaagccctataaatgtagctattgtgagaaatccttcaactacagctctgcccttgaacagcataaaaggattcataccagggaaaaaccctttgggtgtgatgagtgtggtaaagctttcagaaataattctggccttaaagtacataaacgaatccacactggggaacgaccttacaaatgtgaagaatgtgggaaagcatacatctctctctcgagccttataaatcataaaagtgtacaccctggggagaagccctttaagtgtgacgagtgtgagaaggccttcatcacataccgaacccttacaaaccacaaaaaagttcatcttggggagaagccctacaaatgtgatgtgtgtgagaaatcttttaattacacatcgctcctttctcagcacagaagggtccacactagagagaaaccctatgaatgtgacaggtgtgagaaggtcttcagaagcaactcaagccttaaagttcataaaagaatccatactggggagaggccctatgaatgtgatgtgtgtggaaaagcctacatctcacactcaagccttattaaccataagagtacccaccctggcaagacaccccatacatgtgatgaatgtggaaaagcttttttctcaagcagaactcttataagccataaaagagtccatcttggggagaaacccttcaagtgtgttgagtgtgggaaatctttcagttacagctctctcctttctcagcacaagaggatccacacaggggagaaaccctatgtgtgtgataggtgtgggaaggccttcaggaacagctcaggcctcacagtgcataaaaggatccacacaggtgagaaaccctatgaatgtgatgagtgtgggaaggcatacatctcacactcaagtcttatcaatcataaaagtgtccaccaggggaagcagccctataattgtgagtgtgggaaatccttcaattatagatcagtccttgaccagcacaaaaggatccacactggaaagaagccataccgatgtaatgagtgtggtaaggcttttaatatcagatcaaatctcaccaagcataaaagaacccatactggagaggaatctttaaatgtgatatatgtgggaagttatagtggcacatcccagaagagaacctatgagggagggaatgccctggatgggggcaggatgaggatgcctctgtagcaggcagagcttaccaagtctctccgaactcaaatggaagaaataccttatgaatgtaagaatgtagggggtcatggcttgtaatttacacagtgtaaatgaaaccatcctagaggattatgaggaatcctttctatgtgattttcaatcatagcaagcaagaaaggctccagtgtcaaggtagttcagctcttacaggatataaaacagtccatacttgagagaaaaacttagatctgagtgatggaatgtgaagcaagtcttcaaaatcagtagacatttctggacataaaacacagatgaggaaagggcttcaattagaagttacgtaatcaccatcagaaagttcatgtttggtaaattctgttactagaaatgtaggaaattcaggtatagctttgaatcccaattacacattggtcagtgggaaaactaagggcctccaacaggcaaattcagggaggataggtttcagggaatataaatttatttaatattagtggtctttaagtataaacttgatgtaattggtttgggagggggcagtgatgatgacttctgaaacaaaatttggatttccttttaggaaaagtagaaagcatagacttacaagtctaacaggagataggagagagtcactcataaaaaatgcaaattgatgaacgtactattgtgatacattagttgaatggatgaaacttttttaaagtttcagatgaactcccataatgaatgatgaatttgtgatgagggataacctggaagtggtattcacacattatgctacaataaaaggttctaccgtggagaggattttgacacattcagtaactaatggaacacaccgtcaacatgaattcgcaccttacatgacagaagtgattcagggattcctatgaatagaaatgctgagaaggaacgcattttattgcagaagctaaaaagctaaagtaccagtcatctagagagaaggaaattaatgtttcttaataatcctgttaaatgtttgattgtttttggaatgtgttattgtaaagatgtcatgcaggacatgtatatgttgtctgttgtaaaatgttaacgaatactttgttcagggctcactctctctttgtcatgaaagccagctccttgtggcgaggtaaagtggaattccaataaagaaattccttaaatc

SEQ ID NO: 241 - DNA, 1155 bp, Homo sapiens
  ref <308>: DATABASE ACCESSION NUMBER: AL035297
  ref <309>: DATABASE ENTRY DATE: 2001-06-18
ggaagagccgtcaacttagcgagcgcaacaggctgccgctgaggagctggagctggtggggactgggccgcaatggacaagctgaagaaggtgctgagcgggcaggacacggaggaccggagcggcctgtccgaggttgttgaggcatcttcattaagctggagtaccaggataaaaggcttcattgcgtgttttgctataggaattctctgctcactgctgggtactgttctgctgtgggtgcccaggaagggactacacctcttcgcagtgttttatacctttggtaatatcgcatcaattgggagtaccatcttcctcatgggaccagtgaaacagctgaagcgaatgtttgagcctactcgtttgattgcaactatcatggtgctgttgtgttttgcacttaccctgtgttctgccttttggtggcataacaagggacttgcacttatcttctgcattttgcagtctttggcattgacgtggtacagcctttccttcataccatttgcaagggatgctgtgaagaagtgttttgccgtgtgtcttgcataattcatggccagttttatgaagctttggaaggcactatggacagaagctggtggacagttttgtaactatcttcgaaacctctgtcttacagacatgtgccttttatcttgcagcaatgtgttgcttgtgattcgaacatttgagggttacttttggaagcaacaatacattctcgaacctgaatgtcagtagcacaggatgagaagtgggttctgtatcttgtggagtggaatcttcctcatgtacctgtttcctctctggatgttgtcccactgaattcccatgaatacaaacctattcagcaacagcacataagccttgggtgcaagtgattcccaggtggcaaaaggcagccccatcagagatcacgggagcaacagtaagggacagagttttggggtccacttgtccctcagcatggaagccatcaccgtggtcctgcatagagtgagtctgcttctactctggcatctgagaacaagtgactctgctttagacaagcccctggagagcctggccatggagtgaggtagaaaagaagcactttttggtggtatatgctgtttctgaatttgaatctaagcattcttggtgttctga

SEQ ID NO: 242 - DNA, 2864 bp, Homo sapiens
  ref <308>: DATABASE ACCESSION NUMBER: AL049265
  ref <309>: DATABASE ENTRY DATE: 2001-06-18
tggcaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacagcaagataatgacatctccagcctttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacatttcagggtcagatatacaatatgaactcttaatctacaggaatgagaatggaggatcattgaaggccatgatataaacaaatttgcatgttgaagcctgtataaaacatggtacagtgagtgaatatacccccatccccaagaacactttatacatattaaatggatatatgattactgtgcaaaaattcattctggaaatgaacatatatttgagcactaatatgtaatgtacacctgccctaaggagaaaataaattataaaactttttacattcaaaattactttcccaagcatgtcttagaataatctatgtgttgatgcatgtaaattgtactttaggtaggcaaagaaatctggttatttatgtaaaaactagtctaataaagttagttagtggctttatcactttaaatctttagtgtccaaaagtggtgtttaaagtaatagcacatcagaagaccttgtctggacaaaactagttcactcactgcttctgcacctgcagttgctccctttagggttataaaataatgacccaaatgttacatgtgttgatattataacttgtcagttactgatgtctgtggtatcctaccctcatctctgaaagggataatactgaataattattagaaaactataaaacttcacactttgtaccattaaaacctaaaattttaatcttgtccttttttactatggatcagtcggcactcgggaacagcagcaaggaaaaaaagcaaatttcattcacatgttctgtgtccatacctcttctctacctaattgttcatttaaatttcagccttattccttgataagggattttaccacatgaagtcatccagtgaccctagctcttattgtgaagttagtggagtatacttagaaatgttacaactttaaaatgttacaaaacattcattaaagctcatatttaaagtagagcatctagtttgagaaatagaaatcaattattaaagatgtcttttttctacccatttaactagttaaaaccatgacatgtaaatgtagaagtagaataatcacagaattccctaaaatatttctgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaattgttcaaaaaaaatttactgggatagctttctattacaggtattgttagattatattgtgctgataagattactttctaaaaaatttgtacttttctgtaaattaaaagaatatggagtcataaaatggcaagtgttttaggattagcctaaaattggacattgtcattgatttcaaagaaggtatgaactagcagtcttacagcctaattcttctttggactggtccttggcagcagttccttttcagactcgataaacagaattcagatgatgtaagtcaaaacagaactttacaaagccaagcgtattatcttttgcattaacctatttttttccatcatacatgctactagtatgtgcattagcatgatattctcatatacattgcattaaaattaaaaggtggcagctcagggtgagctcttctgttgctcatttgttcctaaatttttaagggctttttctcagtcaatagtttgtacaaactggttagtttaacttcattacccatttcattaaagttgatgggtcgtgtgatgagatgcatttaaggccgatagtgatagatgtttttttcatttcttgaacacaggctttgtctgaatgatgttcttttatctcttgaacacaagctttgaatgataactacaggttttaagtgctgttacattaataccataatgtgatgtgttagaaacaaagggatatttcaaaggtagatatttgaaaattctctagtctcaatatgtatgtgtattgaatatactctaaaaataaatgtgcaatttgctagtaggacaatgcagtgactgactagcattaggtatgtttcttttatatcctagctatgtcccactttcttctaagtgcaatcctttcatgttcacttgctgttttaccccatctactctaacttcatttggaaggcttgtctagagtatagcatgtatttttacctttgcagtgaattgcatgtgctaattgtaaccacagctatttttatgttgacataactccaaatgttatattaaatgttctattatatattagctctaatcccttaagtaaattttaagaaataaatacttgttcaaatttcaaaaaaaaaaaaaa

SEQ ID NO: 243 - DNA, 1574 bp, Homo sapiens
  ref <308>: DATABASE ACCESSION NUMBER: AL049346
  ref <309>: DATABASE ENTRY DATE: 2001-06-18
tacagagactgagaattttttcattctggtgtcaaagttttgttacattatgggtgtgaagggcatttgatatatttttcttaactatggggtttatttttctaaatgtgggttgattgactgttaattgattcagggtacccttaaaagaaaagaagttttcccattgtgaaccttaaatgatcagagaagtaagttcattgattaaattctctgttgggagaacaaaacttttctcccttgacactttattatctttgatttttcaaagggccttgattggtggttgtgtctcggttaaaatttatgggactttgctatgtagttggcatttataaaatctgaagtatcataaataaagttatttatttaattatactaccagtcttttttactggtctgattcttttgtgcattcattaaagctgattgtgtgagagtgaactgggacacaagctagtctagctcactgcagccaagcaaaccctgttgatggctgatgggcctttccattagggttttgcttatgtgaagtaatggaattatgttggttattttctttatgaaaataaaccagttcttccaaggaagttaaaaggcttggtatggatgttggtgtcagataggtctgactaacctctccgtgctgcagcctatactaaggtgacccagggccacatgtagacagctaggccagtgctttttcctcttagggtttctttgcagaaagaaacctccagcaagggaagagaggtgtgtgtccacaggaaggggctccgtggggatcccatgaagggatttgagctctttcagctccatgtcatttaacttttttgtttaaccaccttggctttctctccttttttgctgtcctccttacggaccagttaccagattcagaggctaacagttagttacttgttaatgctagtcacagccaggaggtcagaaggaattttctacttctggatccaaatgttacctcttaggggaagttatgccccctcaactattgtcttattataatgaatctttcctttttggtccttttaagtaaccactcaaaacttttcatttcactgaaaaaatatgataaaccatgacaatagggctgggtgcagtggctcacgcctgtaatcttagcactttgggagaccaaggcaggcggatcgtttgaggccaggagtttgagaccagcctgggcaatgtagcaagactctgtctctgcaaaaaaaattaaaagatacctgagagctcactttaatatcagggtatttgcatccattcccaccctgttagctcttaagggaggagggaaatcaattccaaccatactttcctgtgatggaagatgtttcctcttgaaaaaatgccaatacagatttttaaaacctattgttttccaaatgcactttgtaagtttttgcttttaaaatagcttcttggaaccaattttattgtatttgtacttaatttttgttctcatctaaatgtgcattttctgactgtatagaagaagctttggtatgtaatttaataataaattagaaatctaaaaaaaaaaaaaaaaaaaa

SEQ ID NO: 244 - DNA, 2561 bp, Homo sapiens
  ref <308>: DATABASE ACCESSION NUMBER: AL049365
  ref <309>: DATABASE ENTRY DATE: 2001-06-18
gaactttccccttcagatcacctctgcgccacatctcatccatgcctcctccatgcactccagtccacactccccgtagcatcattccattgcccctcccatccatgctgggaccctcctggcccaccaaggcccaggcaccactgtgaatattctcctctgaaccactagagggcaggccaggcaggccaggcgggcccgtgcagcttgtgggcaagaaggagctggcaaggaccggcgctgctggagactgacccagccctctggctgaggacatgcagcggctcctaaatgtagagatgcctgtggctgagggggcctctctacctgtgtccccactcactccaggagcactggctttggtcacgtcttagcagcagggccttgctccgttgttcccttgccctggtggtgggggggccagaccgcctccggaatcctgccacctgtgactgtctgactgcttagtgcttcagctgtcccttccttgtgtcctgggggacctgctggcggcctcttcctgggagccatgacctcagaccccacccacactccagatcgagacccctgcctccccccggcaaatgtcctcccgctgccttgcagcctgcactttgcacatgctcacccccagcacagtcccactggcccctcacctccccttccctgagctccttcccaaggactcctggtcactgcctgctgtgcagtcagaggcccagggtccagcagcccggcgggaacgggtgctgcctcttcctccagttagctccagctcaggtctgagacccgtgctgagaaaggtctgagcaccgaccgtgccctctgcccagggctgggtcctgagcagctggttttcctgcaggaaggttggagcaagcaaagtccttctctgccctcagggtcagctgcccagactggggcggatgccagagaggcaggtgggctgtggctggactggtccggagctggcttccttaccagaaaagcctcagccttcctctggaagcatcccccgttctgggcaagggggaagggctcctttaaggggtgtgctttcccagtggggagcagtctggccctgccccctactaaagcctctgctctcagcactttcccccaagtccttgtaacttgcttgaaggtgggttctggctgccagccagtccctggacaaactctcctgccccttttaaatttcactcattttgtataaacccagcaggctggtgtttacttagccctgtagcttttttcattttttctttccgtctttcttcttgagttcacggttcaatattgcctcctcgccctggtgaggggaggtgctgcttttctgccccacctgccggctggttccagcagcgctggggcccagctggggggccgggatgggggcttctctctctgggaggggtgcaggtgccctccccaggctgggagggttccttccctagctccccatctgcccccgctggtgagagttgggcttcttggtcttggaactccctggcattgggaacagagcatttccagcatttgttgttgttgttttactcacctaacccttagaaaatgaatgttagaaggtgcctgccgaggcgggacagagtgttcgctcgcgctggagaaggctctgctcagccctgagagtcccttcctgccccaccgatactggcactttaacaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggtggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagatttaaagaaaataaaggtctacaatatctttaggttttttttttttcctgtttaccgcacaaactgaccacatggcatgtctatcaggatggagggtgtccatgttctcctctgtctttagggaggtgataaggagatgggcggaggggtgtttttttctttgactcccctcctttctaacagaatgttgccaccactgcttgagtgggctgtgtttgttcctctgtcccagcttctgttgtagaaaataacattgttaggggaactcaggctagtgtcagcgtcttggtttggggagaaaaaattaaatgtttcggtttttgtttaaaaaaaaaaaaaaaaa

SEQ ID NO: 245 - DNA, 2722 bp, Homo sapiens
  ref <308>: DATABASE ACCESSION NUMBER: AL049370
  ref <309>: DATABASE ENTRY DATE: 2001-06-18
gggagtaggtcagacagggttttcactgtctagatttagctggttagattttcctctaaaatcttaagcagatgctgaatccataaagccaaggagtgctgagggctggagtgggtgggccctccctcccacagccccagggagatacatctggactcctgggaatctggattaagaaagttgggatgaaagaggaggactgctcaggccagttgtgagccagggagaatgttccagtctggttttggtctggtggctcctagaaagggatgtggcccagaagtgggactcaaacagagagatgaagtaggggaggggagtcctccacgggcatctctctcctggcggctggatagctttaccctagggtggggccagccctgacaccctcatcccctcctcagcccagcagcctctagagcagcgtggtgctctcttgatggccaggaatccagaatctgcccttccccaaccttggtttctccttctgtaaagcagagtgatggctgagaagtcctctctagctgcagaagcctgagcttcccggtgtcagtcagctctgcaacgtgggagccttggaggcgggtggcctggctgtgcttcatatgcccaggagtggagaaggaggctgagaagctggtttcccagctctgatctccacaggcacctcctataaccctcctctcacccaccccgctacggtctgagagatctgaaataacctttcccagtgggcagggttgccagggttgaggggacagcacataccacccccacccaacctgttcgaggggccctgcatggcacgggatgagtccctgccctgtgcagctgcctggcagtggctgggacaaggatcttgcagccagcacagaggcctcttcaaaggcctctccctcttggcactccaggcaaggcaggtgcccgcttccccaacacctccaggcagtgaccctagggcatgccccagcaggtctccgagcagccactgggacccgtctcagcacatcctggcctttgaaagtctgatatcctgagaggagggcaggttttagggccgcagttccagccagcgtccccagcctggcttccctgccatggactcagtagctcgtggggcttcttaccacccaccagccccgctggggtgcggcctggctgtgggcaaaggaggacttgcctggagatttgagagaagattccttctaccagggctgctgaggggccaggcctgcatcaggggctaggctctggctgggcccggaggctgagactaaggctttcgaccctggtgcctccatgtggatgctgcctcagacaaaggcagtgagccttccctgccaaagtgcccatcccatgggctcggcctcactggtcactgttagcccatgaacacgtgtgggcctcggtcacgtggctttgagggcagtctgaccaggctagaccacacgtgccgtgacagggggtgccattcccctcgcaggctctaatgtgcccacatgtagcctggcagtccaaagaccaagaatcaacttgcaaatctgccattaaactgctgtgcgacttcaggcatatcactgccttctctgggcttcagtgtccttttcatacctagaagtctgcggtctgaggctctttgggttcagacacactgttctaggcttctgtaggggaccttgtgatctgccgtgcccctcctccctgttcttttctgtcctccccaccccaccctcagaagctgcttgctctgcccccaggacaggagcttgacggatgaagtgcagccagccacccaggtgccatttccagtctgacttccagaaatgtgcaccatgtcctagagcacagacccattggctggagcctcctgggagggttcaaaccatcagctctatgagaaatgcccagaaaggctttgccgactccatccgtctgtggaggctgcctgcctccggggtgggatgggtggtttctcctccaattcagacccaagaggtagcccccgagggcatgtacctggtgggaagcagctcaggtacccttgggggttgcagggcccttacgcaggtatttctctctctctcctctctggggtgcgtgtgtgcgtgcgcgtgtgcgtgcctatgcttttctctgtgggcacatcaggatgcccctcggagagcatgtgcacgtgtccccacctgagcgagcgtgtgtgtgtgctcctctgcgtcccaggtttggacgtctagggtttggtgtgcctgtcttctgccctccctgagcccacagggtcagtcaatgtatcttctacgtgcctctccctctgccttctctcacagtgcccccggctccagagctcaggggtaggggttctcctgagggtgcaggggatccttctcatctcctggaccctccagggcactctggtccctattccccagctcctaggcagctgagccgggtcccttaggggaggtgaccaggagctttggtgcagggagctcttggtggggcaaagggctggacccctgccaggtctgtggacatggttatatgcccgggagaggggggtgcagggccccagggatggcccccaatcccacctctgtttattctgtaaactgcaacctataaataacctttagcattcctattgtaacaaaattaatttttatgaaataaattatatttcctagtctaataaaatccgggttgcatttaaaaaaaaaaaaaaaaa

SEQ ID NO: 246 - DNA, 2278 bp, Homo sapiens
  ref <308>: DATABASE ACCESSION NUMBER: AL049381
  ref <309>: DATABASE ENTRY DATE: 2001-06-18
ggggagtgctccattttccccgacagcgaatttcccctgagaaacgatactagaccctgggtttgcccaccttgtaactcttccttatctcctccttttcatccctaattcatcctccctctggcatggaattgacgcccgtgcagtacatttgccaagtggcaccttctttcaatttatgttttattttgctatggtggtgattctttatttgctggttgtcttttctcacacatctttctctctgtctctctctttcctgctctttgtttttctgcccagaaaaacctgacttcgataccaaaaaagatgaaactacagaaactcaaatttaaaaaaaactttaaaagaaacaaaaaaatactcaacgattctttcagctttattaacattttccattgtttcttgcgacttgtgtctcgttctttgtagtattgatgatgaacatttgataatgaatgttcttgtatattcagataaagaaaaaaaaaaccaaaaaagcggtctgaatttaatagtgtttataataaaaattttaaaaatgaccctcatagcacgcaaaacaggatggggaatttcccctcttctttctgtgacaatgcgcatcattcctgcattagtttttaacaccagactacctacattcatcatttccctcatttttcttttattttcttgcatttgtgaattagttcaagaatgctagaaaagtgtcgagttgtgcacatccatttcttgtttcacaatgtttaaaagtgacagtaattcattttgtaaactaaaaaaaaaaaaaaaaaggttggaatagtgagcataataggtacaacctaacacattattatgtttattaactttgagacccagaaataaattcttttcttttcttgattcttgctcttaaaaatacaaaaaaaaaaatgttttgttttgtgttatttttggtttgtttattggggggctttttttaattgtcaggattatgatcttgctgtttttcttcaatatgtatacaaggtgatgtgaaaagatgacttgggcagaggagtaagaacaagtaggcttgttcttctactttgcttcagaattcagttaatgccaaaagcgaagatcaagcccatgttgatgtctcgttgctcacctgcatttccagagagtgtgacactcatgcagtccctgagaaaaataaaatcagggacatacttctccttttagccttttaaaaattcaaaaacgtttagtccaagggaactttttatgctatcaggaaaggtttttgctgtttttgattctgattatcacagccaagtactttgttttatttctccctaattaataactacattccatgaggcctcttccaaccaaagaggccttttcttccaggagagtcccgcaggagatgctggtatgatgggcaccattggttaagtaaactacatgcaggaagaagtccttggggccagtctgccagctgagtcctggttttggatgaagagttaatgagatattgggccaggctcaatgctgtagttttaatgctaagaggttacgtttacttcacagagtacacctcttagtaacctctgacttaggcagctgcttaaagcaaattgcaaaactggcttgatttggaatgtttttattagaggaaaaaagaaagccatattatctggaaaaaaattcattttaaataccatcattcaacaaattatgttcagaaagtggtcagaacttaagcaagaaaagtaaagaaagaatgcagaattgtggagcaatgctttaggaaatatttctacctgaacacttgtactcttgaagtcacaacaaaataatgatgagcttttcacatcacctttatggtttcaatccctagctcaaagcttcctggaatcttttattttttgtaaacttttttttcttttgttaaaataaataaaacattcaatgtttttctccttttctctcttattacttctttcctttggcattttcaatttgaaatgctttcctttggttgttggttttattctccccctacccctccccttttcttattattcagaatataaacctgcaaagctctgctctgttttggttttgaaagtttaagcttttctgcttctgtgagagcacaggcttctgtcccttttgattccaactgaacttttgtgttctctaatgatactaacacggtgtaggttttacagtctcctaatttgtactggtaatgcatattccaaataaatagtttcttttgttgcaaaaaaaaaaaaaaaaa

SEQ ID NO: 247 - DNA, 1737 bp, Homo sapiens
  ref <308>: DATABASE ACCESSION NUMBER: AL049397
  ref <309>: DATABASE ENTRY DATE: 2001-06-18
gcggacgcgtggggggaaaataaaccttgggttataagcattagcctgaggacaatgaagccacttaacctaatttatgctttcgactgttctgtttccagagaggaaagcctttacaaattactctcagttctttaggggcagaaggcttgtttcaagaggtttgacagaagaaaggaatatatgaacttaatgagatgtcgacttggttcaggtctaaaaatgagggcaaaacactaaggctctagcagtgacttgttcactaaaaagagagagtcctgtccccagacggttagtacaaagccttggatacagtttgcttgtaatatttttaataatgtgaggagtacagtgttttctaattcattcaagtatatatgatttaaacctgggctactgacacacacacagtagccattagttagactcttcttagtgaatatcaggaacatcccatctgtgcttaaccagaatccagcaagtcagcacacaagtgattttattgttattttgttgtatttacttgcatttgttgtatttactttcatctgcagcatttggagtttaaaaataatgtaaagggttctagtagaaatagtgtcctaaggccaattacctaccatactaacaatcagcagataaaattctggacgtgagattccttataatctaattatacctgaggttgagcaagaaatgtcttcctttagaaaatctcattcaagtcaggttcttctctacagttcaaaattgagaatggatttaattaactagcatttagccagctttttcttgcccttggagaaaaagaatcattctcaacctgataatctgttaagaaaaatcccatatgaacaatctggtcattaacatacatatgatacggagtctctttgttgtcaccaagtgaacatacttctcatggtgggttggacagtaatacatgttagagggtcagaagcttctggtttctgctgtttgctttaaatacccttggggttttttttttaaacccttacaaggggagcatcagctttggaaagtgtgactctgtaggagtgtagaaggcagtggtgtatgatcttagcctcgtcctgatgcctgaatccagccagctgttgctctgacccacagcaatagagcaagttacccatcaccagcatttgtacagagcagggaattctggttttagtccattggtagcattgtgtgtatgaggagattcaacaccacagacagctgcaggactcgatatccatggcttctttccatcacaaaacgggtagaaacacattcactgcttcagggttctaatctgtgtgtctccttatgactccatttctgtaagctactctgtaactttgatatatgctgtattttctttctttaaaagatttagatgttttttcagcaagctagccatacaaccattgtatctctttctcttcagtatggtttagagcccagatcagttagtaggctttcgttgtcttctctttcaatacatgtacatctttactgtttgaaaagtgttacagctgtcaaagaatcttcatggacctgaagataatttcttgtgaagttgaatgcaagtgtactgtcattcatagtgtttatatcaaaataccaggaatcttcacttttgctaccttgatatagcattgggctatcatgttacaacattgaaatacattgatttattaaaaaatacttttataagaaaaaaaaaaaaaaaaa

SEQ ID NO: 248 - DNA, 1249 bp, Homo sapiens
  ref <308>: DATABASE ACCESSION NUMBER: AL049415
  ref <309>: DATABASE ENTRY DATE: 2001-06-18
gggcttagggaaggagagaccttattccaaagcatgattgcagaaggggaaagggaatattgcaaaagggagaggaaggggccttatgggaatagtgaaaaggctcagaccgaccgatggcaagatctgcaagcgtctcaaagcccgggcagagggggacttttcttttattggaagaagtaaacatggctagaaagaaccacgttcagggaatgacgttgtgcccagccttttttttttttttttttttttgtctccaggggaggggctgtttgctggctcaggctgaggatggcccaaagtccagggtctggtggggaggagggaagcttaactcaagtttgggttagtgagttagcaagctctttgtgcagatggggatgtaggtaaatctttttaaaagtgaaattaacctcctgccaattttacaacccaagaatttttttttaagggccttggagccatctctaaaacaaacctcaagggatttagtgccctgtctccctgtctctagaagccttagcctgggcacctggctcaatcttgtaactgcctgctagccatagattcctttcggccttgctggcttctccctataaaagtaaagcctttttctgccccagctctgggacacttgcagatcttaaggtctgagacttgctgattttctggttggagtgtttttttgtattgccatagtcccttccccctgaagcaatagcccctccccacctcctgcaatacgcctttccaatctttattggaggtctctccctgcctacttcctaatttattcttatttgacagagggtatggaagacttgcaatttgaaaactggggaccagttccaaagtcagtaattgtgttaaccacgtgtataacagctctgctggacacccaagaaagccatgggaacgccaactggaaaggtccccttccccaggggagcctgcgaaggagaggttctgtagaatccaagcccacatttccaaagtcacccccaacgcgtcctctcacaccgtccactgtgcgtttgtatgtgtctgggatccagggcaatgtgaattttctttttatttgggagattgttcacggaaaacagatcttcttctctcttgtccacctattaattgtttacaatatttgtacatctatgcaaaatacttgaatgggccatggtgccttttttccttgttagtatttaattaaaaatgaattgtttgtcatttgcaaaaaaaaaaaaaaaaa

SEQ ID NO: 249 - DNA, 2058 bp, Homo sapiens
  ref <308>: DATABASE ACCESSION NUMBER: AL049667
  ref <309>: DATABASE ENTRY DATE: 2001-06-18
gcccagacctatggattgaaagcgtgtgctttacccatctgctgtcttgctccatctgagaccagagccaagatctgcccaggactggaatgctttcccgagtggcttgagttggagcctgggactaggagcagccttattgaggtacaattcatgtgcttgtgggtttggatggcacaatctgtgtctgggctaaggaaagcagacttggcaccaacattaaccctgacagatccaggcatctattccaggaactggaagccaagcgcaacaggtgcttggaggtcatcatgatcagcccagaccccaggccctcccctggcttggcccggtgggctgagagctatgaggccaagtgtgagcgcaggcaagagatccgtgaaagccgccgctgccgtcccaatgtgaccacttgccgccaggtggggaagacgctgaggatccaacagagagagcagctccagagagctcgactgcagcagttcttcaggaggaggaacctggagctagaggagaagggcaaagcgcagcatccccaggccagggagcaagggccctccaggcggccaggacaggtgacaggcaccagctctgaagtctttccagcccagcatcctcctccctcaggcatctgcagggatctgtctgaccacctctcctcacaggctgggggccttcctccacaggacactcccatcaagaagccacccaaacaccaccgtggtactcagacaaaggcagaaggaccaacaattaagaacgatgccagtcagcaaaccaattacggagttgcagttctggataaggaaatcatccagctttctgattacctcaaagaggccctacaaagggagctggtcctaaaacagaaaatggtgattctccaagacctactgtccactctgattcaggcctctgacagctcttggaagggacagcttaatgaagacaaactgaaggggaaactgagatccttagaaaaccagctatacacctgtacccagaaatactccccttggggaatgaaaaaagtactactggagatggaagaccagaaaaacagctatgagcagaaggccaaggagtcactgcagaaagtgctggaggagaaaatgaatgcagagcagcaactacagagcacacagcgatccctggccctggcagagcagaagtgtgaagagtggaggagccagtatgaggctctgaaggaggactggaggacccttgggacccagcacagggagctggagagccaactccacgtgcttcagtccaaactgcagggagcagatagcagggacttacagatgaaccaggccctgcgatttttggaaaatgagcaccagcaactgcaggccaagattgaatgcctgcaaggggacagagacctgtgcagcttggatacccaggacctacaagatcaactaaaaaggtcagaggcagagaaactcaccctggtgaccagagtacagcagttgcagggtttgcttcaaaatcaatccttacagcttcaagaacaggagaaactcttaacaaagaaagatcaggctttgcccgtgtggagtccaaagtccttccctaacgaagtggagcctgagggtacagggaaggagaaagactgggatctcagagaccagctgcaaaagaagactttgcagctccaggccaaggaaaaggagtgcagagaactgcattcagaattagacaacctcagtgacgagtatctctcctgcctgcgtaagctgcagcactgtcgagaagagctgaaccagagccagcagctgcctcccagaaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgaccagattgttcctca

SEQ ID NO: 250 - DNA, 5784 bp, Homo sapiens
  ref <308>: DATABASE ACCESSION NUMBER: AL049801
  ref <309>: DATABASE ENTRY DATE: 2001-06-18
ctcacagacaacagccaagcacagaggaaatattagctggcagagataacgaagagaaaacactcggtgacagatgcaccatctgtcagtttctgaggagcagttttcaagaaagctgaaaatgaattgaagaagagaggggttttgtttgaaaggtacagcacagcctaaggacaattttaaacaaaaaattgaggcaaaagaagcatgtgactggctccgtgctgccgggttcccgcaatacgctcagttatatgaggattcacaatttcccatcaacattgtggctgtcaagaatgatcatgattttcttgaaaaggaccttgtagaacctctttgcagacgactaaatacgttgaacaagtgtgcctcaatgaaacttgatgtgaacttccaaaggaaaaagggtgacgactccgatgaggaagatctttgtatcagcaacaaatggactttccaaagaaccagtcgcaggtggtctcgtgtggacgacctctacacgctgctccctcgaggagacagaaatgggtcaccgggaggcacggggatgaggaacacgaccagcagtgagagcgtcctcacagacctgagcgagcctgaggtctgctccattcacagcgaaagcagtggaggcagcgacagtcgcagccagccgggccagtgctgtacagacaacccggtcatgctggatgccccactcgtcagcagcagcctcccacagccccccagagatgtcctcaaccaccccttccaccccaagaatgagaagcccacgagggctagggccaaatcatttttgaaacgcatggaaacactccgagggaagggagcccacgggaggcataaggggtctgggcggacaggtggcctggtgatcagtgggcccatgttgcagcaggagccagagtcctttaaggctatgcagtgcatccaaataccaaatggagatctccagaattcgccgccacctgcctgcagaaaagggctcccatgctctggcaagtcgagtggcgagagcagcccgtcggagcacagcagcagcggggtgagcacgccctgcctgaaggaacgcaagtgccacgaggccaacaagcgcgggggcatgtacttggaggacctagatgtgctggcggggacagcactgccggatgcaggggaccaaagccgtatgcatgagtttcactcccaagagaatttggtggtgcatattcccaaggatcacaaaccaggaacattccccaaggcactttctattgaaagcctctctcccacagatagtagcaatggggttaattggaggaccggtagcatctccctgggcagagagcaggtccctggtgccagggagccccggctcatggcgtcctgccacagagccagccgagtcagtatctatgacaatgtccctggctcccatctgtatgccagcacaggagatcttttggacttggagaaagatgaccttttccctcacttggatgacattctgcagcatgtcaatgggctccaagaggtagtcgatgactggtccaaagatgtcttgcctgaactgcaaactcatgatacattggttggggaacctggcttatccacctttccatctcctaatcagatcaccttagattttgaaggtaactctgtctcagaaggtcggacgacacccagtgatgtggaaagagatgtaacatctcttaatgaatctgagcctcctggggtcagagacaggagggattctggtgtaggggcctctctgaccaggccaaacaggcgactccgatggaacagtttccagctgtcgcaccagccccggccggccccagcatcgccccacatcagcagccagacggccagccagctgagcctgctccagcgcttctcactgctccgcctcacggccatcatggagaagcactccatgtccaacaagcacggctggacatggtcagttccaaagttcatgaagaggatgaaagttcccgactacaaagacaaggctgtctttggcgttcctctcatagtccacgtccaaagaacgggacagcccctgcctcaaagtattcagcaagcactgagatatctacgcagcaactgcctcgatcaggtgggtctttttcgcaaatcaggagtgaagtctcgaatccatgcccttcgccaaatgaatgaaaacttccctgagaacgtcaactatgaagaccagtctgcttatgatgtggcggatatggtgaaacagttcttccgggacctccctgagcctcttttcaccaacaagctcagtgagacctttctccatatctatcagtatgtctccaaagagcagcggctgcaggccgtgcaggctgccatcctgctactggccgatgagaacagggaggtcctgcagacgctcttgtgtttcctgaacgacgtcgtcaacttggtggaagagaatcagatgacgcccatgaacctggcagtgtgtctggccccctccctctttcatcttaatttattgaagaaagaaagctctccacgagtcatacagaagaaatatgccactgggaagccagatcaaaaggacctcaacgagaatctggcagcagctcaggggctagcgcacatgatcatggaatgcgacagactttttgaggttccacacgagttggtggcccagtctcgtaactcgtatgtggaggctgagatccacgtgccaaccctggaagaattggggacacagctggaggagagtggggcaactttccacacttacctgaaccatctcatccagggcctccagaaagaagccaaggagaagttcaaaggatgggtcacgtgctccagcacggacaatacagatcttgctttcaaaaaggtgggcgacgggaacccgctgaagctgtggaaggcttctgtggaggtggaagcacccccctcagtggtcctgaaccgcgtgctgagagagcgccacctgtgggacgaggactttgtgcagtggaaggttgtggaaactctagacaggcaaacagagatctaccagtatgtgctgaacagcatggctccccatccttccagagactttgtggttctcaggacctggaaaactgatttgcccaaaggaatgtgtaccctggtgtccctctccgtggagcatgaggaagcccagctcctgggtggtgtgcgagcagtggtgatggactcgcagtacttgatagaaccgtgtggctctggcaagtcaagactgactcacatctgcaggatagacctgaaaggtcactccccagaatggtacagcaaaggctttggacatctgtgtgcagcagaagttgccaggattagaaactctttccagcccctcattgctgagggcccagaaactaaaatctgagttttgcccagtgtgacatcaaactcagggaagaggaagctaaagtgacgagtgtggcagagagtgtgcatgtgagaaagcgagagaaagaggaactgaaggacgcggttaatgcctaaaaatggaaacgttaagaagttggaatgttggagatgcaagaatttccaagaactttcttagccttcctggagatggctacatccctactaatataattttaaaatgagaactttatatatattacttaaaattaaatggactattccttgtgcattgcctaatttgctatttaaaggcttctaagaagcgtatacctaactgtaaataaatgtatgtatagcatatgtacatatgtgtgtatatctccatctttactgtatatatgtaaaataccaattttatatagaattgtgtgttttgaaaatgacggtgtctgactcagtgagtcccttcctcacacagttctttccaagtggctctgggccccatctctccactgtcctgtaagctgtgcagaacctgctgctaacaccaaggtgtgaacatgccctgatgcctaaccaaagatgagttaaccaaaggaaaataacattaaaggagacttatgtgttaacgctttgtttctgctattcaaaaactgagagtggagatctgggataaagcaaggaaataataattactcctccttaaagcaaatgggggggtgagaagtcattaccaaatttaaagctagatgaggagttgccactgggcccagtaagatggaatttcagtgagatatggaccaccggagtcagcgagagtgactgaaacagaagcgatacctctcgctcccatgcccatcactacagaccccaagtcaagatgaatatcatagcctttacttcttcacagccaaagggagcccctgtgttgtctcaagtttttataaatacatttcataatgttattaaatgtcattctatttgaccagtggcctatttggtcacagttaattggtgttttcttattgcactgaattcaactccagacaccatacaaagggagatgatggccattccgttcaaatcctagatcgttacagcttcagggaattcatattttgttatgtgtaggatactcttaaaatgtaattcattaaacttttacaatctgaaagacagggtttttaactaacatgagaccaaaactatgttctttgattagttttagatagtataatcgggtttattaattcttctgtgtttcttcactagccagtccaagctacctatgcatttgacccaaccttatttattattgtacagatgaagcgaattgactccctttagccaactgctaatggatcgaatgtgctttttattgtaattcaacagctatagagagaaagataacttattgtgtgtttgatttcagggagagagattttctttggtcatccataatagagattgataagatttagcaactggtgttggagaaaaaaagaaaagcaaatgagtgttttcaggtttttttgcattatatgcatttatgtaatgtttctgttatcagcaatgtgcaattattttattgagaggaataaaaaagctttctatgagtttggtatggtgcgaggaaaatcttacagtttgaattatgacctagaaatttttcattcccatgtctacctaagaaggaagcagtaaatccataatttaccttttgggcaatgctttgtgagcaaaacaaagtcacttctgccataacatcttgaatgtaaccatatatgccagattactttatatgcatcaacaagatcaccagtgaagtttaatctagctaaacactggtcctgctcctgagatgggatcctatgtgtttggaaaacgtgataggcacacgaggatgagtggctttgtatcgcccagagaggtgcttgtccagatttcacatgcacatgaattgcctggggatcttgtgaaactgcagactctgctccaagtaatctgggctgggcctgagattctgcatttctaaggagtctcagggatgcctatgctgctggcctaaaaccacactcagaaacgaggacctagaagatccctaaaacagaataagaacaaatgtgattgtatttctgattctccctctcttcgaattatctgacttttttgtttttgtgcacatagtaatcatatcaccgctgcataacaacacagtgcatctttttaaaacaaggaaaagggaaaaaaaggagaaaaaacgatgcatcaagcttgtttgtcaaataccacagtattttattcattgttatcttgccaatggaaataaagtatgatattgcatttaaatattatatttatacctcatgtatatttttacctcaattgttgatatcaatcatcaattgtaaataaataattgccaaggcaaataaattt

SEQ ID NO: 251 - DNA, 1865 bp, Homo sapiens
  ref <308>: DATABASE ACCESSION NUMBER: AL049932
  ref <309>: DATABASE ENTRY DATE: 2001-06-18
tttttttttttttttttttaagcacttgttttgggtacaaggcatttctgacattttataaacctacatttaaggggaatttttaaaggaaatgttttttcttttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtatagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctttattgggagtacatttttttaggtctcttaaactttaatttcacacagtaaattttgaatctcataaggaagcatatttgaacctagtcaatttaatcttagtgttcccttgaaaactttttttccctacaaaattttaagtgaaaaatacaatagtaaatcaagattacactggggaaaaaaatgcaggtatcactttactccattgttatctgacctagagcttaattaagttttagaaatatgtaataccttccatcattccatcatccttaaattctgttaccaaataatggctaatgttacaaaaagttatactccagagacccaaagcttgacatttacctaatgtatgagaaaatattaccaattaacaataaagaatgatcatatttttaacctcttttacatagcctaataactcagcaaggcctcaacgtctgtgctaatttaaactgccaaatattgactgcagcaaacaagaattatattcagaatttatgagggtactgttaggagtatactgcttacaggtttagatatagtctgttagaattaaaaccaagtttagtgttcatatttacctcatgggctttatcaagcccatattacctcagcttatatatagttaccatttttaggtttttaattgtttgacacttggatgataaatgcagtcattttattctcaagtgcttaaaattaatgtaattaaaagcttagctgactacagaataggtgagggtttcttaaaaatgagatttaagggctgggcacggtggctcatgcctgtaatcccagcactttgggaggccgaggtgggcggatcacttgaggttgggagttcatgacagcttgaccaacatgaagaaaccctgtctctattaaaaatacaaaagtagccaggcatggtggcgcatgcgtgtaatcccagctacttgggaggctgaggcaggagaattgcttgaacctgggaggcagaggttgcagtgagtcgagatggtgccattgctctcgtttgggcaacaagagtgaaactcttgtctcaaaaaaaaaaaaaatgaggtttaagacagttttgtcattactggtgggatctggtcacacaagatagcattaaacgtgacatggcacataaaattggttaaaaaattttgttttttaattacgtaatgtaaaagcccaacaaacactttatgcaagattgaaatgtatcttcaaattcagatttaataaacatgtaaagatcctctgtaaaaaaaaaaaaaaaaaaaaa

SEQ ID NO: 252 - DNA, 5957 bp, Homo sapiens
  ref <308>: DATABASE ACCESSION NUMBER: AL049935
  ref <309>: DATABASE ENTRY DATE: 2001-06-18
ggggatgacaaactcatttccagtctgtgaactcctggacaaagcaaactaaccactgaaaaactcgaaaatagggcaagacgacattaaccttgtgaaagtctgctttgaaaaaaggcattctgtcaagctgtgtatttttttcttgattattcaaatttatttcgttattcaaatttaattcagaaaatagctcagttggtttcagggggaatggggtgggaggggtttgggcacataaatttatgatgataattttaaatgtacgatcattaagttgtatgcctcagtactataacaggtgaatctctgtaatattgactaaacagttaaaagatattttgtaaatttcaggtccatcgcatcaatgcatgaaatattagaaaaccaaattccaaagaatcaggaatttccatttccacccaaagtatacattattatcttctagcagttgtctgttaatataaaagcagcaaaatctcagctacttatataattttctccttttatttgaaagttacacttagagattaataatatgtacagagaagcttttcctgcctactctgtttataactccgtccaacttgcccacaaacactgccctccttcaacccatctgatgtgggcaaagccactgttttcttaggcccataactcagtgcagctgttttatttttataatgccggtcaacctttttgtttgtgtgtgtgtgtgtgtgtgtgtgtgtgtgtgtgtgtgtgtgtgtgtgtgtctacgatgtgcttatttaataattgccaaaatatttagactagagtaacttccggtgggtcaattggattgtgactttcttttgtggttttttggttcttcgattgctctctgttaaatattttcataattccccccacagaatacgtgtgtatatactgcaacttaaaaactaaaagcagtactcgaatgagttgttttaatgttgtacttttatctgtttgttttatgggttctcctgctgcctaatgacctttctgtttttataactgccggaaagccgcgaagcctctcgcatggggagctaggtccccgctgcggctccgcacttgagtttattataaactctggggttctgagtaagttttgtttgaatacagcaacatgattgtctctttctattcttatcctaaaagactctgtctggcatcttttagttgtaccctcgtatctgcttctctaataaatgttatattttttctcagtattgtgtattttaagtgacttttcatgtttccaagaaaattattctgtgtaatatgaatatttaactctttcatctccagtaataggggattttctagcccaatgcttttttaaaaattctgcctcccacccctacctcctcctttaaatgatggcacctcccctgtttctgatcttgcgtgcactcagggcctgagaagtctgtgtttcttttgtttcttttctctctccttgagatgaagagcttttcacggtttattgcggaatgaatacagaacaacaggttttccttttcaccaaagattttacattgtactgctgaagagccaagagtttccttctgagagaactggaccttcatgttccttgtaccattctaggaaattgatgcatttcttttcttttcttttttttctggagttgaattctcactctgttgcccaagctgaagtgcagtggtgtgatcctggctcgctgcagcctcgacctccctgggctcaagccatccttccaactcatcttcccgaatagtcgggactacaggcgcatgccaacatgctggttaatttttttttaattttttgtagagatgaggtctggctatgttgtggcccaggctggtcttgaactcctgagctcatgcatcctccctcttcagcctctcaaagtgctgggattacaggtatgagccactgcacccaacctccgtttcctttttttttttttttgagacggagtcttgctctgttgtccaggctggagtgcagtggcccgatctcagctcactgcaacctccgcctcctgggttgaagcgattcttctgcctcagcctcccaagtagctgggattacaggcacctgccaccgcgccaggctaattgttgtatttttaatagagatgggttttcaccatgttagccaggctggtcttgaactcctgacctcgtgatctgcctgcctcaggctcccaaagtgctgggattacaggcatgagccacggcgcccagccccggcctccgtttcttactttctctcaaaactaaacttatgagaaagacgagttggggcggatggcctcatcagtctcctgtttgggcttctcttaactctgaaggaaagaccagctaaaggctagagagaaaaccgtgaaagttcctcatctcagacccgccctgtggtaaccgattgctctaagacgccccctcccatccctcccctcccactaccctcccctcccagggcggtgcagtttgtagccaagagcaaaatgcccgcctgaaacccgcgccttcctctctaacagagagtttctctttctgtttctctttgtgttgtagattcctagaggggagtgcctgcgagcctcgggtgagccttcctggaggagcctccgtctgcttgttcccacaggcctccagcgccctgccctgtggacagcccacccctccgcagccccatccctgcggggcggtctctctctctctctccagcatgctccctgcggccctgccctcccgcccagcccgggccacctcgtgggggacaagtctcgccagcgcccacccccatggctcgggtcagtcctcatcgctccccctccccaccccgcgcaggccactgagacggtgggacactcgcccccacctgctccttcctgggccctcagtccacccgggctcgtcctggcagcccttccgcgcttcacacagtgccttttgtgaaagtgtcatcacgggtcccctgaggagacaaggcaggtccagcgcacatcaggtggactgagcactcgatgtcatccgtgtcgatgtcatccgtgtgtcccagactgcctgctgtagaaaacacttcctcctctcctgagtctgtgaagtcctcagtggtcctttttggattctaggcttgcacctcatactaaacattgaccctttcactatgccctcaacctgggagcatctggcaggcaggggggcaggtacacacacacccacaggcacacccaccagtacacacgcgtgcgcatacacacattttggtttgacgccctgttttcagtggcctggggaggtccacactggaagtcgaattccagctcgccttgttgactcgcctgtgtccaccggccatgaggagcccacgcctgtcctccccatcactttcctgtccctgagaactgtagatcatgcgcttgtgagcgaggccctcccctctgcaccagctcattgcaaagcgaacatcctctcctttccaggagccccaggattagcatctgaaaagggtagcacttccttttttgttgttgtttttttttttttttgagacgggagtctcgctctattgttcagactggagtgcagtggcatgatctcggctcactacaacctccacctcctgggttccagcgattctcctgcctcagcctcccaaatagctgtgattacaggcgtgcaccaccacgcccggctaatgtttgtatttttagtagagacagggtttcaccgtgttggtcaggctggtctcaaactcctgacctcaggtgatccgcccgcctcagcctcccaaagtgctgagattacaggtgtgagctaccgcaccccgccgaggttagcactttcatcaccaaagaccccgtgcctctcgtggtcctttgagggatcccgccgccaccacccttgtattttatcacgtgctcttcagggcatgtggaattcgttgagtttgcttttagagccaagtttctttccctgtgtgggtttttgaggaaaacctgaggtcccctaatctgtggccaccaccccccccccgccgccacgccttagagcagagcagcccctcctctcatttggtgcagaaacagtcaagaggaaccattggcctagagctcctgtgaccgagagcgccacggaagcctggggatgatgtcgggcagctttattctttgcttggctttggtaactaggtggtcccctcaagcatcctcagttcctcttgctgtttatgaatctaagacaaggaagtcctatagaagccaaagggacagggacggaaaggacaggtcccaagggatggggctgtctttacttgtggaaaccaggaaattgctcctctcagccaaccaaggttgaccacacaccacccttccggagcagctcagtcagccctcggggacgagaaaccacaagcgcagagacgctgaggcccaggcaggtgaagaggaagtggctttgggtttttaaagtaggtgagcgtgagcctctctgactgcttcttccccgggggggactgcaaaccgctcagggttgcggcagagccatggacttccggtccctgcaacgggtgacctaagcgtggtgcacccatcagtcacgcaggaggactgacttgacagacgaaagacaagcccggatgacacagggtgagaagagtcagggccgcacctctgtccctgcaaaccaacaggtgcatggtgagtgtggcagtccccacagctccacaatgggctcccccgccaacggggacgacagggatcttcaggaacttctgacctcaccaagtcaagtggaccactctccactccacgaggatgtgaaacggttctttaaaatgggattttagagcctcgggaatgcatgtgcgtcgcatctttcatattatgggtcaggatagattcatttcttgcaacatagtggaaaagatataagctgcagtaatttgctctttgaatgaccgtcacccccagtataggatatgcttgtatccccccgtcactcctcctcctgttttttaaacttttccaccacctgcgtccaaaaagaatgttatagcgagtgctcttaaatgttgaacctgggtgttgcttccgggccagtctgcgtggctccatgaaaagcccactgctgccccagccgggcttcttagaggaggtcagttgtcctatgtatcatcatttactctgggaatcctactgtgaaatcatgtctgtatttttctggagcagttcacatagagtagaatgtggaatttcccgtgaacgtctccttcctcccccgtatctgccgcctgtcacttcgccaccgtgctagaatactgttgtgttgtaagatgactaattttaaaagaacctgccctgaaaagttcttagaaacgcaatgaaagggaggaacttgtcctttacccagtttttcctttgtaggatgggaaagtataaaaaggcacagaaggttgtcatgggctgttccttgggggtttttatcctgctcaccgtggagataagcctgcggcttgtctaaccagcgcagcgcaaaggtctcaatgccttttggtaacatccgtcattgcagaagaaagtttacacgacgtcaaaaagtgacgttcatgctaagtgtttttccagaaatattggtttcatgtttcttattggctctgcctcctgtgcttatatcatccaaaaactttttaaaaaggtccagaattctattttaacctgatgttgagcacctttaaaacgttcgtatgtgtgttgcactaattctaaactttggaggcattttgctgtgtgaggccgatcgccactgtaaaggtcctagagttgcctgtttgtctctggagatggaattaaaccaaataaagagcttccactggaggcttgtattgaccttgtaactatatgttaatctcgtgttaaaataaaatataacttgtgaaaaaaaaaaaaaaaaaaa

SEQ ID NO: 253 - DNA, 2078 bp, Homo sapiens
  ref <308>: DATABASE ACCESSION NUMBER: AL049943
  ref <309>: DATABASE ENTRY DATE: 2001-06-18
tgggcaattaaccaagccatagccaatgaatatgaagtccggagaaagctgctaataaaacgtttggatgtcactgtacaatcctttggctggtctgacagagctaagagccagacagaaaaattagccaaggtttaccagccgaaacgttcagtcttatcccctaaaactactatttctgttgcccatcttttggctgcaaggcaggacttgtcaaagattttaaggacaagcagcggctctataagagaaaagactgcctgtgccatcaataaggtgttgatgggcagggtgcctgacagaggtggtagacccaatgaaatcgaacctccacccccagagatgccaccgtggcagaagaggcaagatggcccccagcagcaaacaggaggccgagtaggagggagaggtggctatgaacattcctcatacggaggacgaggaggtcatgaacaaggaggcgggagaggtggacgtggtggctatgaccatggtggccgagggggaggaagaggaaataagcatcaaggaggctggacagatggagggagtggtggaggaggtggctaccaagatggtggttatcgagattcaggtttccagccaggtggctatcatggtggccacagcagtggtggctatcaaggcggaggttatggtggcttccaaacatcttcttcatatacaggaagtggataccagggtggtggctaccagcaggacaatagataccaagatggcgggcaccatggtgatcgtggtggtggtcgtggtgggcgaggtggtcgtggaggccgaggtggtcgtgcaggccagggaggaggctggggaggaagagggagccagaattatcaccaagggggtcaatttgaacagcatttccagcatggaggttatcagtataatcattctggatttggacagggaagacattacactagttgaggctaccgaactttacattttgctagagctcaagtaatagaaacttagtttcagaatcctgaattcagcacctattttgaattaatgtgagaccacaggtggcaggcagattcctgcttggcataagcatttgtaggtcttcattcaattctgttagatttttttattggacttacataatgccgtttatttgagaaacacataacatctctccttcctatgaaaaattttttaaaaggtggttaaaattgcctttaattgcccagtagactaattccacagtcagaacatgcaaacttttttgaagaaattacttgaataagtagttttcatgttttcaatatgcagttttgaaaatgaggattcacctagacttttttagatttactactaggaaaccttcctcatatgaataaccatttatatgtgttttgcttaaagtattccaatgcctattttccaagcacagttctgccccccggttgacttttatgccacgtgtgcttcatgatggaacttttaggtcagttcctattaaatgagctcttctgcagatagcacattcagtagccttattttgttgatggaatactgtatcatatgctcaactctgaaaaccttgaacacggccaaaatccataaagattataaaagcaaactaagttgtgaagctatagtacatgtaggcatttagttaagtatagcaattcaaactgacctgcatccatccaaaacaaattcctccttcaaccttatttttacttgaaatttgctagaagaaatagcaaaccgaaatttgttttatgcatgagttaataccactggctcagcaaatacaagttagtttgctttaagcaggtaactttttttgtaatggaagaaatgcactacaaagttaagacagatttttgctaagtgcaggaggccctttattattgctgcagaaaacaaaagcctggctgagttgatgttttacattctcccttactgaaatctacatgacatgatgcttcttgctgggtttttgtacatgtaaacattgtcaagctgtgaaagaaaatggctggaggtgtgctttgtgtgaaaggtgagcaataaagtatctgttaagttcaaaaaaaaaaaaaaaaaaa

SEQ ID NO: 254 - DNA, 2758 bp, Homo sapiens
  ref <308>: DATABASE ACCESSION NUMBER: AL049949
  ref <309>: DATABASE ENTRY DATE: 2001-06-18
gacaagccacagaacccctcttttctaaaatggagacaataatttcctacctcccaagggagcagagaggcctcgtggcacgtccgtggccagggagcccactgtcctggctggcggcgggatcgtgcgctcctctgtctcccggatgagaagccccgtttccatggtcttgacccttcctttctcccggctgtcagaactgggtctcttgattttgcccctacattatgcctctgtgggaaaaaaaaaaatcagaccaagaaatgagcctgaaattcagtgtttaccatggctcaaggatgcccatctggtgtccagttgccttttgtattcaaatgaaaatgctttgtacaactgaggagttacagtgaagtgttaaccaggggtccagggagcgagttgaaaagatggagtgagtgtatttgcagccagggagctgcagggtggatttgaggggccataccctctgagcacttaaaaaaggtatttgctccaggccaggcagcaggctgtggacacccttgccaccactggggactgccactgaggactccccgagcacgttgttccccgtcttctccaaggtgttgaggtgagctggggttggccccggcccaggcttctgtcccaaggagaagctgccactgacagtcatcctaccgcactgctaaagagaatgttcgcagtggtgggcggcgtgcctgtgccaacccttccagggacccggccatgggggaccttggcccaaggatgcctggggcctgccagctgtgctgcaaaggtggggggcccacaccctaaaactaacccaggccccagaccactggaggccagggcttccctgcacgggctaaggggtgttgggatatcaccccaaagtgaccttgccagtgagctgttcagcaggtagccactgccctgccatctgtgcagagccagccaccttgggggctggggttcccgctttgaggcccaccttccatactccccttgactcggctctggctgaactggggaactctcttgtggtcagcaaagcccctgccatgcaggccaggtgccattgagaattaagtgctcagagggccaggagcccaggggatgggaaagtgtgtggttttagtacgttcaaaagggacaatcgcttgcagttggtagatctagcgatctagttgggagataatggtgtttaccccatatgaagtattcaatagttctacttgtgaatttgtatttattttgagttatacttgacacagaattccttttttaaaaaaatatgtgtgtattttggaaaaaaaattcatagatgttaaaatttctgcatggttaccagtttttctcacgacactgaatttggtagcttttcccgaaaaaatcttcacagtaattttttgtctgtatatatttgagggcctttttttaaaaaaaaaaaagaaaagaaaaatataattgtttgatttttgagattaaaacaaacaaaaagagaggcattttcaaaatttcagaactttcaggagggcaagagaatatcaaacaaagatttctggaagtattttgccaaccttctggttgagctgcaagaaaatatttatggtgagaacttttctgtttcccgttattgggtttttggctggtttttgtttgttttttactatgctttggtctgtaaaaatatgcaactgaactacattcagaaggaaatattgtctacatagaatattatatgaagttggtacataattctgatgaggaaaaaaaatctttgcaattctttaagccatattgttgtttttctgtgttgttttccctggatgaaaatatcagtattaagtagacagcatattatccaagtgtttagacttattaatatgttcttgtcctgtatttatacatatgtgtattttggaaagtattgccttttttaagggaagctataattcgatacatagtgaaaaagggaatggtgacccctttgtgcctcttccactgaggataacaaacagcattgtaatccattctcttgcaccttcttcttcttatcttgttattacggttttattaattttgtagagggacagggagtgggcaaggggaagaagcagcttatttgactaaccagcccctctgtggtccaccagcgtcttggcttggtgggagggctctcaatcagcagggccccaggagggaagaagaagtggggcaaagcctggcctcgccgctcgggagctttgccatctgagccacgcctcctccaggccatgctccttgaacttggaaatgtcaaccggagcccttacaccagccctccagcatctaatagacttgaatctactctaaacgaatatttaatccaacctcactacattgtagctcagtccaacgactaaccctgaaatgggggtgttccagccttcagcgagatggccaagcggtcccctgggggctgtggcagcgggcttatccttctctgttgccaaccttgccgtccgacctcctccgcccccatgcggtgaccccgtccgtgtctgtgtctgtccatacgtgtgagtccagctaaaaagacaaaacagaacccgtgggcccagctcggaaggtgcgtggagaaggctccgacgtctccgaagtgcagcccttgggatggcattccgttgtgtgccttattcctggagaatctgtatacggctcgcctatagaaatatagcctcttcatgctgtattaaaaggacttttaaaagaaaaaaaaaaaaaaaaaaaa

SEQ ID NO: 255 - DNA, 1340 bp, Homo sapiens
  ref <308>: DATABASE ACCESSION NUMBER: AL049963
  ref <309>: DATABASE ENTRY DATE: 2001-06-18
gggtacggctgcgagaagacgacagaagggtacggctgcgagaagacgacagaaggggtaggtccagaaaactaattattggcatcagtctgtgaaatagtccattatttgttgttaaaaatgcttcaaaaggttttcagtgtcagtctgagatgcctggtatataggagcctttgggaaatacctatttttcagtattccatgcatattggatatcaccatgaagcaagagacatgcattctataatcatgtagacactcagactcaggggaaaatacaagttatatcctgaaagcctttaaaactctatggtaggatcaaagattcaaatggtttcagagaggttttatttcaattaatttgttctagtgctttcaagagcaagtacatcaaaatgtagaaggtaaaatgtatgcaacactaatataaattattccaagtctttaaggagccaaagaaaaaaaagatttctcacagctttttgttctgttttgtatttcaattaggaacttgcagtattattttgaaaaccattctaaaataataggagttaggaaataaataaagttttgctagccctgctaagttcaggcttagaggcttatcgctaagtgtaaacttcaccagattccacgaaaagctggatagctttttttctgacttatgttgtggttgcacccctcacaaatggcagaacagtatgtaaagctggtaacacctcggtttcagtgcaccatgtgtttgctttgtgaaggtgaagaatatgttggtttagagaaagaaattggatgtaattttatgcaatttacttttaaagacaaacataactatttagcagagaatattttaataaatgcaaaacaacagctggactgctgtacatcaaggacagattaactggaaaacatatgttccttatgtgtgattgagagccattcagaaaagacttcctttgtgttcagcctatacttttccatatggtataccttgaaaaaaattagcacaccatggttatttttctaccttttataaaagacagagcctgtttactcatttagaagatagagaaaattggtctaaaattgaacatcctagattcacactcccaagtcacttaaggtgatttgatggtgaggaaaatgattgacaaagcccaacaatgatctcaggaattacattttccaacagaccaaaaaatgttttcatgtagcagcaatgcagatttggtgaatatttaatatatattttagtatgtatttcactttatgactgacaattaaaaaatattgtttggccaaacagtaaacacccttttgaaaccaaaaaaaaaaaaaaaaaa

SEQ ID NO: 256 - DNA, 1215 bp, Homo sapiens
  ref <308>: DATABASE ACCESSION NUMBER: AL049987
  ref <309>: DATABASE ENTRY DATE: 2001-06-18
ggggggacttgagtatcctttgttaccctcaggagatcctgaaaccagtcccccatggatactgagggctgactgtatagtcctatcctcacggaactttcattctaatgggggaagactgactataaacaaaatatatgtaataggtggtggtaagtaccgtggagaagtaacaaatggggcaaagtgagttatacagctccattcttagaaaccttggagtacttttcttagtttatactcgtggtggtttccttttgtctcctttattacatgggactctgacatgtgcccatagctagggtgacagtaggatctacccgatagtagggtggcagtaggatctacccaaaaagcgtcctgctgatacaggaccaaagcatcctgttgttctcgagcctataaaaagagctaatggtgttgcttctcttaactgtggcctcctacactgtgttttggatgattggtgatgtcttggatattctgtttctttggaactttgaatatacaacactttactagggaattagcaatggaagcagagcaaagatgtacagaggaaacaatgcgtaactctgatggaattgaagtcatgaggcagcagagagcttaaattacagctttaaaaatttttattttttagagggaatttacttgggagtaacagcagtaatagttaacggagccagaatgcttgagtcatataattgcaaagcagagttgggagcaacagatgctaaagagtagttgctgtagttcctctttgggtcgtaggagcagttgtcatattactatatagctactgcatgaagaagagttcttagtgaggcctgggtgatcagctcttcttagtattctgtgtgaccccatttgaccttttaacaaatccctaagtaaataaatagcccctcaggaaaactaagtttttctctgctgtttttttgcttgagagagctataactgtaatagacttatatttctgaacattttagtgcttgccaatatttggtaatatttatgtttcctatatttgtaatgaacattcttcttccggtacattttttgttaaattattgtttgatggataaaagttcaccttttattgtataaaattgactgagattaatttatacacattgacaatgggtaaatagaatttttcagattattaaaagctgaaggatgcccacgtaagcaaaaaaaaaaaaaaaaaaa

SEQ ID NO: 257 - DNA, 3104 bp, Homo sapiens
  ref <308>: DATABASE ACCESSION NUMBER: AL050021
  ref <309>: DATABASE ENTRY DATE: 2001-06-18
ggggataagttttttttttttcttttttttcttttctctagtttttctttctggctgagatttccgtgcaagacagcacccaatagactatttagagttgacatttgacattttaatgggcgccatggctcattttgtagattgagaaggtgcgtctcccctgctccaagtctcatcatgacagcgtgctgacagctgggagtctgtggccttcctcacgcagaggccttaaagctggacacagatgcacgcctaggctgggcagggatgggacccatgccccctccttagaggacgggcttcctggttaggaaaggacacgtgggggtgccttgcataatagttcactggtcaccgtgcttttatgagtagtgtttttgtgcacttgccaggggttttctctctgtgtgcgaggggagtgatttaagcaatggtgtctggagtaagccttacaattttaatagactttttcttatcatatccctcatttctttccctgaaataaaaatacacacaagcaaaaaaaaaatgatagtttcacatctcttagttcccttgcccaaacaagaatattcttagttccactggccaggattttcctacatagtcagaacttacacattactagaggcacacccaccaaggagtattgtgtctacttttatctgtgcaccagccacaaatacccacattggaaagacccatttgtgatgggtaaacatcccttcctgtctcccacaacccctgtgactgccctgcatgtgttcatgacctccgaaggccctaattcatgaagcagcaaacccagcagatctccacccccctgcctcaggacctctgctgaagagggggatgaagtgggtctccagggaggcagtgggggccttgttggcagctggctcgggagccggcttacaggagggcagctctgcagttgggaggggcaccgtccggaggagaccaggcctctacacaccccccactctacttatcatccctgctcacacacccttgtccaaggctttatgcatcggatttatttttccaaatcgagaggacagtgatagatgcattttccccaggctgtctcagaaaggtcgctaaatgtatactgttgtcagaattgctgagatctccccccacttttggtttttgcagcagtaaaaactctttccactgtgacttattttctctctcaggcagccagccacctggtcccttgtgctgactctagcacagtggccaggatccaatacgagtccaggggtgaccgcaggatggtgggggcagcgggcttctccacctaccccagccaccaaggccctgacgcactgcctcctgcaccttcagcacatccctgtgcacagctggaagggtgcatggcccgctcacctttgttcagatgggtggaaacgctgatgataccagctcctccctgccgtgcccctgccacggagcaggcattgtgaactggctggtgtttgcagtcccacgtggcatggcctccagcccaacccacagtggagactggagacagggcaatgagtctggtcgggggcacgtggacatgccccataggggccccacccagacttaacaggcaaggtcctgggcattgcgcgacgcaggactcaatgctaaagcaagcctgcctggctctgtgccagggcccctcttctgatttacacatcccatttttacacagacccttccttcttaataaaggctgacagttctgttggcagccaagaacccacaccatgaagacagggagtgaggggcctttgtgcccaactccagcacagctgcgttctggggtgtgtgagaggcatgttcgtgtctgtgcgctggtggtctcgtgagacagttccgaggacggggaaattgcagggtggtgggggcgtgaggcttatatgtggaactgatgcagagttcgcctgcagacggatctggatatacactatgtataattgttacgtgtaatttaaaatatatctgtttgccatcgtcatgagaagattatatgtaaggctctgaagggagagggagatgtacattctgccaggctcctggggaccttatccgagtcatgaaattgatgactgttgatccagtggtgcaagaagctacactccatgtgtcatcacgcttatgactcctaatgtatttttaaggcaaaaaatgtcagccgactccatcttcacccctcgattcctcgagtccagcctttctgtgccagtgcttcactgagccacaacgctctcgccatcgggacccggctgggcctggagtctcggggcacagttgccatggagccctcctgggtcattctacaaatgtgctgagtgccagctgaaaaccccacaggagatggagtaccttggccaagcttaaagagaagattttctcagggtatttattagtgtgtccagcagggtcaggaagcaggatggaaagatgcattcagactgttaatttattaacaaggcaaatgattttgtgtttcttgatgacagactattaagtttgggacttattttcccatttgagaagttataatatatatttaagatgataagtttcctgcttaagttgtgcctttcagcttcaatgagtttaaggagcactaaggctaatgataccaatgagggttggtttattatcaaacctgaatagctgtggtttctccagtaaatattttcttctactgaacatggagccattattaagagttgtgtgttttttattatgtacatttgtatatttttttgcttgtttgatgttctatttttctaatagttttcttttagtttcttaaagttgtgatactagatttagattctgatgctaactgcaaatcaggttggtctctgctgggtctctcctgcttttattttactttaaggacaagtgtagttgtcgtccaccacctttcaaaaaatgtgaaactgccctgcctcccctttttgctgacaacactgtgtacattgaccacttcctaccatactttatgttgtaaaatcaaactcttttgtggtacattatctcatgcttctgcaaattcgaataaattctatggcttccaaaaaaaaaaaaaaaaaaaa

SEQ ID NO: 258 - DNA, 1500 bp, Homo sapiens
  ref <308>: DATABASE ACCESSION NUMBER: AL050024
  ref <309>: DATABASE ENTRY DATE: 2001-06-18
gggggttgccgggaactgcgttccaccaaatacatctctgatggccagtgcaccagcatcagccctctgaaggagctggtgtgtgctggcgagtgcttgctcctgccagtgctccctaactggattggaggaggctatggaacaaagtactggagcaggaggagctcccaggagtggcggtgtgtcaatgacaaaacccgtacccagagaatccagctgcagtgccaagatggcagcacacgcacctacaaaatcacagtagtcactgcctgcaagtgcaagaggtacacccggcagcacaacgagtccagtcacaactttgagagcatgtcacctgccaagccagtccagcatcacagagagcggaaaagagccagcaaatccagcaagcacagcatgagttagaactcagactcccataactagacttactagtaaccatctgctttacagatttgattgcttggaagactcaagcctgccactgctgttttctcacttgaaagtatatgctttctgctttgatcaaacccagcaagctgtcttaagtatcaggaccttctttgggaatagtttttccttttcaagtttttcaagatgtaggtatatccatgaatgcaatttgcatttaaattccacgtatcctgtagttttaattcctcattgttcttaaaagactgttgatactataaacatcagtgaatcattatattttaaaacagaaaagggcttctcagataccctccatctactggcccatcccctctcctaaacaaaactccttcaaaacaggttaaaaaaaatatgttgtcatgaatcttcacagtaacatttcagaaaggtgcttttttggtactcttcatgggaacagtttagcagccatgagtgatcttcctttgaaagagaatgaaagaccctgtgacatttcacttcaaaaataagccctgtagctctttacggtcgcatagtataaaattataccctgcatgctgaccctcgcttggaatggaatgccagaaatgcatggcagcagctaataagtaaagctgattaactatttatttgtcaatgttattatttaatgagctttcacatgtgatttgtttcaaaactttaattttttaatgttttgaaactttttcatggacctaaatattttcctatatgatttgtggttgattagaaatatgaaatacatgttgtagatatgtaaaatgaatattttagtctccttattacatatatgttcatggtgaactttatcaatagtatggatctttttaaatcaataagatgctttgtaaagttgaaataagtaatactttcttgtttaatctgtgcaatcagaaggtgtcttgaccttcaattcaattggtttcttttaacaaaaataaacactgctaaaagttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 259 - DNA, 2655 bp, Homo sapiens
  ref <308>: DATABASE ACCESSION NUMBER: AL050090
  ref <309>: DATABASE ENTRY DATE: 2001-06-18
gaaaatgtatacctggcagcaggcactgtgtatggactggagacccagctgactgagctagaagatgccgcccgctgcatccacagcggcactgatgagacccatctggcggatctggaggaccaggtggccacggctgcagcccaagtccaccatgctgaactccagatttcagatattgagagccggatttcagccctgaccattgcaggattaaacatagcaccatgtgtgcgcttcacaagaagacgggatcagaagcaaaggacccaggtacaaaccatagatacatcaaggcagcaaaggaggaaactgcctgctccaccggtgaaagctgaaaaaattgagacatcttcagtgactaccattaaaacatttaaccacaacttcattctccaaggctcctcaacaaacaggactaaggaaaggaaaggcaccaccaaggatttgatggagcctgctctggagtcagctgtgatgtactgacaccatggaattccactgccagtgacccactgcctccggccgtacacgacagtgccttgacccaacagccatcgagtactgtatgtatttccacctgaggagaaggcctggggaggccacagtgcaccattgcacagggctgtcctgatacctcatccagaaagccgtctcagacttcagcactgcggtcttgcccactctctgccttaggctcccaggggaatccaagacagaaaatgaagacactggcttccaacagcagcgctccatgtttaagatacatattttccctgtttgctttgctactgtatgttgactttaagatctttttttaaatacatttgattcagctagtattccatgtcaacaatttgtccaaaggaaaactgctggagggaggtggagggaggaaggtgggaattattatttaatacatcattaatgcttattaatctctcacaagcatctttgtcttgcaaatcctaagggaaaagcaagtccctgcagtgagcactagggacagtctaatttggggattgctcaaccatcaagactgcaggtctcccttcagccacctccttcctgctaaaagcttagcctaccacactaccagtcattcccatcgctttgcaatcacaagccacaggatgagaagttctgactcactcatgccatgcccagggctatctgaaacaatgtctcattaagaatttagggttcttccatgggcttactgacagttgcccagatctgaaggggaaagggtcttgagaaagaccatcactggctcaactttagggcactgtccagagtcaacatgatgtggtttagcagtgatcacatctaaacaaagtttaggtaaatgaattatcgcagagaaaaaccacatgagaaaatttttgtactccaaatttacttcccaataaatattcagcaaagtagtaaaatgaccttaaagataaaaatgattagggaatagccttagaaaatttataggtataaaaaattcaaggacaaactgtgcatttaatggacacaagaattgactctaactccatgtctgtggtttctttgaacccatatcaaatgtatgactatttagagtgtttataagagataatggaactgaactttcactcaattaattgggcattaacaaccttcttttatgtttgttcctgatatagtctgaatcttaggaagaaggtaaaagaaaggaggcaagagaatagttatgatgaatatgtgttaagtgcctgctctgaaggaggcaatgttcttctcatttgaatccttatggcaaccttattcaataggttttcccatatttcagatttaataactgaaggccagagagattaatttgccaaagccacacctttatgctaattatgattggaatgcatcacaaaagcctaactctgttgttttcaacctctacgttattttgctgctatgtgcatttccagatctgattttctgctaacttgtgtgctatgatccactcctgatgggggtctacattaatcttccagtactccttgctgatgctgtgttatgtgtcatctaacagaaatgactcctttgaaataagtaaatctttggctttttgttctgttggtgtgattcaaagcaaaacaaacaaacaaaaacaaattttaagaacacaacaaaaaagatttgacttccgaatagaatgttttctttaagaggcatgaaaagcaactattgttgtgttacagtgttaaaaatattcagttttctttgacaaaaatgtgtactgtgtaagccttgcaaacaaaaaacaacaaaaaagaagcagcagcagcagcctgctgtgtggcatctgaacttttataaaggtttccttgtgccaaataagtgcaaagatttaatttactattaaaaaccataagcatatgttatagttccagaagaattattttgtcatcaagtgattttgatctttagtgtcaatatttatatttagattaatttttataaatgaaaatattttaatggtttaagaaaatgaggacaacaggataatatctttgatgacttctgaaagttatgcttcccttcatgttatatgcacattgccaagaattactgtcaagagaaatgataagtaaaagtcatttatgaaaataaaaaaaaaaaaaaaaa

SEQ ID NO: 260 - DNA, 3030 bp, Homo sapiens
  ref <308>: DATABASE ACCESSION NUMBER: AL050148
  ref <309>: DATABASE ENTRY DATE: 2001-06-18
ggttgctttgttaagttccatctaatgatcattctgacgtaagtctgtttttcttatttccttggaatgatgtctcctctggtttcagaacttcctcctctgcttcctgtatcctgaggctggcggggccagttgtctttagggcttgtgcatttttgtaaagagcttgcacgtgtggaaatcaagtaggccagtagtgggttaggggtactgagccagaagcctctacaaggaataacaggagcacaaaggaagaaggtggtattccagctggggacccaggagggaggactttgtggagaacctgatgcttgaactgagtctaaaaggtgtaaaagtgtttgttgcttctgcctccctgtctgtctggcagggtgaggtaggcgcatctagggaaatgtcaagtggcttggtgtagggtaaagtcagtgaggcccatggagaaaaacgagcaggagccacatcacatgggtgtctgataggacctgggaggcgctttccacattaccattgtcgcttcgtgatctggacacaccagaaggcgtgagactggaggcaggaagagcagccaggcttatccctaccctcaggagagctgaaaagggcaggtatggtggggccagagctcaggagagtttcggaaccactgagatcggtccttgatttgatgagaggcttgaggggagagggaggtagctaggatgccccgcaagcttctggcccagacactgggcagacaatgaaaccctttgtaacacatgaggcaataggtttggggcagatgggaggggaagcagtggtgggggcagtgagtgctgaaggtgttttaagaagcggctctgggccaggcacagtggcttatgcctgtattcctagcattttgggaggccgaggtgggagaatcacttgagcccaagaatttgagaccagcctggggaatatagtgagaccctgtccctacaaaaataaaaacaactagctgggtgtgtggtggtgcatgcctgtaggcccagctacgcgggaacatcacctgagcccaggaggttgaggttgcagtgagctacagttgcgccactgcactccagcctaggtgacagagcaagatcttgtctcaaaaaaaaaaacagctctggatgggaagggaggccagttgctttaagtaggggagatagagttaaaggaggctttgttttatttaaaggtgggacaaacttaagcatgttaataaaattcagagaagagaaagagaatgactatcagagccatgtttggaagaaaatggggtccagagcacaggaaggggacctgtgttcagagggtgcctcactgctgaggccacaggaaagaatctgtaggtggaggggaggccgaagaggggaagtttcatgcttgataattaaaattttctgagataggaatgtcatatttacctatttaagccaagtttttttagataaaaggtatggaacctgctttccccttggctagttcagcgtttgggctccggagtgctgaagatgaggactggacttcgagctggtgtgatcccagtattcagtgtcagtactcagtgacaaaataaatgagagaaacgggaataagaattgtcgcctacacaaaaataccagcaactgttaactcttcccagaagattttcattctgaatgctcctgtagctaggaaccctaaaaagtctttgaagcaactcaagttttaaaaaaggggaggaactcctggaaatctcaggatggggccaagatgtggctggagagtgtgtggtgatggagggcgtgtcttttgccgagcacactcagggcccacgggaagcccatagacttcaaggacatcaagccccaaggtggtgggattttccccaccagtacttggcagcctagggggaaggggagggcgggagaagataatggggatccctggctccaaacataggaggacacatctgtgctacagtgcgcacatgcctggatgtacactctgtctttggagacactggctaagattctctgctccatgtttggacagggtcgtgcctgatctgagataaatggacaagaacaactgaagcctgtcttctggtgcatgtgtcacctgccgataactgcatcttgtgataaagttgggtgatttacagtctccaccaaatgctaaactctggggtcttacgcctttataactccatgggccccagcaaaggttcaggctcaaaacaggtgtcaaatagataactgttgaatgattgttccccagttgcaggctctgccacctggcgttcatactgtctgtgaaaggacccagctcacctttccctctttatctcccagtccttcccaacagcgccgacacctcatggaaactgattgcaaatgtgctacttctcacttctgtgtggcccgaggaggctgggttaatgctgggcttggtaccttaagcaccctttctcccttccccatcttcattctcagaattacacctgtctgaagcaggcattttccaatgccctagatgggaatataagtgtaaggagatgtgaagcatttgcctgtgtgtcagaacattcactgaggatcctcataggcacttctagaaaccaaatccttgaagatgactaaccagaaatgcccgtcatagcactgtttacagttgcaaaaactgaagccaattgaaatgtccatcaggaggggattaaatgaattatggtacagttacaccgttgaatattttacagccattgaagatgatatatagctatattcattgacaaggaaaactcatattttttagtgaaaaaagcaggttatagaattgcatgatattcacatttatataaaactttatatatgggaaggatgttgattgaattgttaataactatggtcacctctagagatggaagtttgcattacctttaatttttaataccattttgtattgcttaaaatttgtatgtattatcgttaaaataagaaaaatcaaataaagctattttcattatgggaaaaaaaaaaaaaaaaa

SEQ ID NO: 261 - DNA, 2361 bp, Homo sapiens
  ref <308>: DATABASE ACCESSION NUMBER: AL050151
  ref <309>: DATABASE ENTRY DATE: 2001-06-18
gaggggacactgcacagccgctcgcccctcgactcagtcatgggagctgcagcacgcagatccaccgcaagcttcctgcacgcgcatctccggaatgctgcgctgggccctcccaccatcttcgcgtttgtgagaatttactcagaagtgagagaactgaagattcctggtgcttttgttaacacgtttctatcttattggttggtgtggaaatgttagatgtgttgttaggtttttaaatgctgtgggtggtatgattaaagggttaagtcctcacctcagcccccagcccccttttggggggtaggaagaggctgagttatctcctatttaaaacctccttggatttaagtagttcagagttaaagctaaaacaccaaatattaactctttcccccaagtgtctccaggaactggacgttggggccattcttattcagttctttctgtagctccaaggtccttaaaatgagtgagttgatcccaagaacaccccacagcaccaaccagcagggcacagtgcaagcgacttcatagatcggggtgctcgtgtaggggtccggggctcctttgaactctgggagttgtgtgcgcagtcttgggtgggagacggcaggtccctctgtcccaagaagctggtggtgccaaggccttcctctgtctccatcagtgccagcctgatcgcgttctggaagacccagtctcagactctgtgcctttaaagtccggtcctcagtgtcctttcagaatcatgttggggctgcgtttctctggggaactaagcctgtgccattccacaaggcaggcgtggacctccagccttggaagctttctttccgctcctcagcccctgacttgtaaactgtgatgccatgcagtctggagccgcgggggacgcactcggtctcattgcggaaaacacttggttccagtcgtgtggtttctcccataccctgaccaagtccacctctgccaggattgcaggagattggtgcaagacccatctcttatgcattgaccatgaccatcagcaaagcctggtggtcttgttctcatagtcactcgagaagaatatttattgtaatggaagtagattttttaaaaaaggaattggaatcatgtctttgtagaatgtgtgtgtgtgaagtcctcagctgtaaggtgctattcagtcctgtgacccttattttggaatgctcttcattactgttgctctgttttgtgacttcctgggaaaccgcctactttggtgtggtgtcaccttgagctgtgcacataggacaccagttttgacttaacctaacaggcagtttttatctctagctttttcaagccaggtattgagcagtttcttggccaatggcctgagaaaccacctgtccctgtcaaggggtgattttattggttttaagtggggaagtaatcccatgtacttatttcttaaatacctaggaagttcttcttggtggctcctcttggccctcccctctttctcccccaacccaccatcctgcaaggcaaggaatggcctctccctccacagaggcaacggctgcagagggagcactgtggctgccatcccagttcctcttcaaagccaaacagacacgcgtgactcaaaccctacagtatggagggtggcgttgcattgaaattccaggcctgagtttgatagtggattttaatgtagttgttaaaggtatgaattcatgttttataactgtagaggcaagcaagtttttattttttaaaaagttttgagagaataatttataagtttctgtgcagcaaagtggctaattactcattaaatacaggaaaagaatgtagtatctaaatccagctttttcttacctctggtacacttcagattacttacctaatacatattgagggcttttaacccttagttttatcaatttttctagttttattttatttttataaaataattgaaaaagaaccaaaaatgaattcagaagttccatagatggatttttgccccttcttaattttctcccacaatgaaaacattttagaagacattttgaatcaaaatgtattatgaccattgaaagttctctattttctaagaagctgagcagctccaagggcctcgtttcaggtggtactctatgtattgtctgtgggcttgtttctacctgtacagtggaaccatgtgaccatgtcttgtgcttgcaatatagaaaccatgcagtgctgttttgtgaattggcagtttctgtataaactcttatttatatacattggcctctctgtatgattttccatttgctacatgaattgtaaaattaattataaaattatagtacctgctaaatacaaaaaaaaaaaaaaaaa

SEQ ID NO: 262 - DNA, 1284 bp, Homo sapiens
  ref <308>: DATABASE ACCESSION NUMBER: AL050227
  ref <309>: DATABASE ENTRY DATE: 2001-06-18
ctttcacagaaagaaagtaacaggcataattcctgttgatgaggctgggattgtttttaagaggagagataataacttcatatttttaaagtgccagtagcctaatatgtgaaacagatcagaatctgttgtgtagtaagtctgctttgttgaagaatttattatgggagtaaagataagaaggaaagagatcaccatcagaaacaagtcagccttttcatgcttttttgagcatttttggagatgattccacttctcaagttattatcatttgtgcatctcttcaatgctattgttaaatgctttagaattagaatattttgatcctttaattaaagtaagccaaacgtctaggcaaaaacagccaatcattaaactttaatagtaattcaaatatagatttctcatacagttttccatgtctgtagaaatcaaagttgtaatgttaagcagagggaaatgcgtgtgatttactaatacacttcaacgttctacttttgaaaggatactcatgtgggtggggcagagaacatagaaaaagatatgatggaaaacctgtccattttctacctgttaaccttcatcattttgtgcaggccctggaagcaaagagaggaagggaccgactgcatttatctttgaacacttgagcatcagtagtactactgagtggccaggggtcttgtctgtcaaagcaaatgataagttcactcaggccattattgactgctgaactctcttccttcccaactcttccttgaaagagaaaaaaatactttgccttcttgctctccttatcaaatgtttttgtacaaatagtgtaagcctgtttaagcaaaccaattaaaataggcactgattattttgatctgtttgtaacaaatgaatgtaagtactatttacatggtgtgcctaggaggagctgaaatcattggcactttaatccatattgtaaagatcagtatcaaaagcatagtgttcttcacctctcctcctcagcatccatctctatatacttgattaaatggaaaagtctcttttatcacctctatgtaaagttttatgggtagttatcgtcagtgtatttaaatatatcttctagtatgttttaaaggctggtcttcaatactgtggagacaaaaaataaaagagcgtatgaaaagtacgttagacttttgctggcattcaagtcatggctagtctgtgtatttaataaatgtgtgttatttatgtcgtgtttgtcaatggaaaataaagttgaatattctgaaaaaaaaaaaaaaa

SEQ ID NO: 263 - DNA, 3958 bp, Homo sapiens
  ref <308>: DATABASE ACCESSION NUMBER: AL050367
  ref <309>: DATABASE ENTRY DATE: 2001-06-18
ggggggagacgagcaggtccgcgacgctgctgctgtgcctgctgggctgccacgtctggaaggcggtgacaagacgctgcgggagcccggcgccggagcccaagaggtgacgttaaaggtgcacatcagcgacgccagcacccaccagcccgtagcagatgcgctcatcgagatcttcaccaaccaggcctccatagcctctggcacctcggggactgatggcgtcgcctttatcaagttccagtataagctgggcagtcagttgattgtcaccgcctcgaagcatgcctacgtgccaaactctgccccatggaagccaatccggttacctgtattttcctctctgagccttggcctgcttccagaacgctctgccactctaatggtatatgaagatgtcgtccaaatagtatcaggattccaaggtgcccggccacagcctcgcgttcatttccagagaagggctctgaggttgcctgagaacaccagctacagtgacctgaccgcgtttctcacggccgccagctccccttcggaggtggacagttttccttatttgcgaggattagacggaaatggaacaggaaacagcaccaggcatgacctgaccccagtcacagccgtcagcgtccacttgctgagcagtaatggaacgccggtgctggtggatggtcccatctatgtcactgtgcccctggccacgcagagcagcctgaggcacaatgcctatgtcgcggcgtggcggtttgaccagaagctgggaacgtggctgaagagcggtctgggtcttgtgcaccaggaaggcagccagctgacgtggacatacattgccccccagttggggtactgggtggccgccatgtcccctcccatcccaggtcccgttgtaacacaggacattaccacgtatcacacggtgtttcttttggccattttaggaggaatggctttcatacttttggttttgctgtgtctccttttatattattgcaggaggaagtgcttgaaacctcgtcagcaccacagaaaactgcagctccctgcaggactggagagttccaaaagagaccagtccacgtccatgtcacacattaacttgctgttttcacgccgagcgtcagaattccctggcccgctgtccgtcaccagccacggccgccccgaggcccccggcacgaaggaactgatgagtggagtccatttggaaatgatgtctccgggcggcgaaggggacctgcacacccccatgctcaagctctcctacagcacctcccaggaatttagctcccgggaggagctcctctcttgcaaggaagaggataaaagccagatctcctttgataacctcactccaagtgggacgctggggaaagactaccataagtcagtggaggttttttccttaaaggcaagaaaatctatggaaagagaaggctacgagtcctcgggcatgatgactacaggggtagttacaacaccgtgctctcacagcctttatttgaaaagcaggacagagaaggtccagcctccacgggaagcaaactcaccattcaggaacatctgtaccccgcgccttcatcacctgagaaagaacagctgctggaccgcagacccactgaatgtatgatgtcgcgatcagtagatcacctcgagagacctacgtccttcccacggcccggccagttaatctgctgcagttctgtcgaccaggtcaatgacagcgtttacaggaaagtactgcctgccttggtcatcccggctcattatatgaaactccccggggaccactcctatgtcagccagcccctcgtcgtcccggctgatcagcagcttgagatagaaagactacaggctgagctgtccaatccccatgccgggatcttcccacacccgtcctcacagatccagccccagcccctgtcttcccaggccatctctcagcagcacctgcaggatgcgggcacccgggagtggagccctcagaacgcatccatgtcggagtctctctccatcccagcttccctgaacgacgcggctttggctcagatgaacagtgaggtgcagctcctgactgaaaaggccctgatggagcttgggggtgggaagccgcttccgcacacccgggcgtggttcgtctccttggatggcaggtccaacgctcacgttagacattcatacattgatctccaaagagctggaaggaacggaagtaatgatgccagtttggactctggcgtagatatgaatgaaccaaaatcagcccggaagggaaggggagatgctttgtctctgcagcagaactacccgcccgtccaagagcaccagcagaaagagcctcgagccccagacagcacggcctacacgcagctcgtgtacctggatgacgtggaacagagtggtagcgaatgtgggaccacggtctgtacccccgaggacagtgccctgcgatgcttgttggaggggtcgagtcggagaagtggtggccagctgcccagcctgcaggaggagacgaccagacggactgcggatgccccctcggagccagcagccagcccccaccagagaagatctgcccacgaggaagaggaagacgatgatgatgatgaccaaggagaagacaagaaaagcccctggcagaaacgggaggagaggcccctgatggcgtttaacattaaatgagctatcgcagacccacctgactgtggaatataaaattgccaaatatcctttctcatggaagcgcgtacccgttcgtggaggaaacggaacggcagcccagccgtgggacggacgtggacgtttactgcattcctgtttgccgtgtaaatgttagaaaggaattaaagttattactcggaataaaggatgactttggcggatgtcgcccctgcaaggaggtggctgaaagtggtgtccagatgtccttccgaggactcggcgtatccgccaccagggacattaagaaaccgcacgtgatgtcgctatgctctaacgatcacctcagttctccctcggattctgggaacagatgaaactttttgcatcgcttgagtcatttttatcacaataatcctactgtgaagctgtcgttgagaacttaggttggcacgtagcgtctcaaggtatgcgttctctcaaaggaaagctatgcatcgctgcttctttgtctgattttgcttagattttgctttggttaggttgcgttttggggtttgcctttttttgttgtcgcttaaatgcaatttggttgtaaagatttgattcctttgtgttcatctgttccgcttctcagcggtccatctcagcgtctcccttcaggaaccgctgagtgtcctctcttaacatccaagccttttaatgaaatcgtactgaaatctgtatcagctaagagtcctccaatcctggtcccattaactccaagtgcctttttgtcagtgacaacagacagtccctcgctttttgttgttgttggttttcttaacccctttaatggaactgcctggattttatacagttattaaaggatgtctcttttgctttaaactgcatgctgccaagtgccatttggggtcagcatcctcgtttcaacacagtgtgctctctagttatcatgtgtaacgtgggttctgtttagcgaagatagactagaggacacgttagagatgcccttccctgctccatccctgtggcaccattatggttttttggctgtttgtatatacggttacgtattaactctggaatcctatgggctcatcttgctcacccaatgtgggagtctggtttgagcaagcgagctgaatgtgactattaaaaaaaatttaaaaaaaaaaaagaaaatcttatgtactatccaaaagtgccagaatgactcttctgtgcattcttcttaaagagctgcttggttatccaaaaatgaaaattcaaaataaactctgaaaaaaaaaaaaaaaaaaaa

SEQ ID NO: 264 - DNA, 2515 bp, Homo sapiens
  ref <308>: DATABASE ACCESSION NUMBER: AL050370
  ref <309>: DATABASE ENTRY DATE: 2001-06-18
agcattttccacgtgattatcaactttacagccatcatttcaatgtctgtactattccacatggtggatgaactagagtctactcatcttttattgttgggacatttaggctttttgcaaataaaaatatttatcatagcagttccttccctcccctgatggcctcataagcctgtggtcctaggacttgactctttcccaaattagggtgcccacgcttccttattccctgaccacattcttccagcaaaccctcctggagctgagtgataggcactcatggtgggaggccccatttaacaccatccatgcagcactgatttgttataggctgctgtggggggagggggtctccaaggaaacagttgaggaaacagagagtgaggtgagcaggcagctaaatacagaaactgttaagggcatcagaaacacccatgggcatgtggacagctgtagaaatagggctgcaagacacctcagctagaatctaatgacctgagagcaccaggaaaagagaagggagttgacagtgtatgcagctaggaacacatccccgtcgggggtctgctctgaggaccctctataaccctaaagcagacagtacctctcccagctcagtatgatgtgctctatgattaatctaacatgaggcgactgtgttctccatcaaaggagagactgttcctgtgtgtgtgtgttgaggggtgaggggaggggggaacaccagggagacctttaaggatggggtggcatttgagcaggacctcgaaagatgaggaggcttttgacaaagggagtccagaggcagaggacagaacatagaactagatgaagagcccttgagggcagggacggtggacctccccctccctcccagatgctggctcaggcctggtggacactggcaaatgtcgttttgaatgagtgcccccggggggagaggtggcagcatgtgggcggtggggcatttgttggggggggcggtgagtcttcaccactgctgctcttgcccctcaggtgcagtgctttgaccccaaggaggaccggtggagcctgcggtcaccagcacccttctcacagcggtgtctcgaggctgtctcccttgaggacaccatctatgtcatggggggtctcatgagcaaaatcttcacctatgatccaggcacagatgtgtggggggaggcagctgtcctccccagccctgtggtaagtggaggcttcaaggcaggagagcggaacccgcttctaaggctctggatcttggagcttgtgaatcttgtgactccatcctaggtggttttattatacatcactctctagctcatcctcacagtgatagtgaaccatgcatttcacagatgaggagactggccttagagaggttcagcacctggcccaggccaacaactaggccctgttaaggcagagcctagaaccctgcagtcccaagtgctatagctttgagtggggatttggtccaaatgaccctgtggtctctcctgccccgaaggccactgctagtaaccaatcatgaggtaagatgtggggaagggagttgctaaggtctgctctagtgatatcagagcagggaggcccaagtcctggaagctctggcccctgcaattccctgcctcccctaccttcttctccatcccctgaaactccagagactacacagatatggttggactggaggtctctgccagttctgacctttggtgaccttagaggtgagatttctggcttgagtctgagattctaagatggcggcagtcgagattattgttattggtgtgcttaccacattccaggctctatgtaaaatgctttatatgcttaacttccattaactgttaagggaaccctgtgaagaaggcactttagttcttctccctttgccgatgaggaaactgaggtccagagaggttaagtgacttgcctaacgccattcactgaataagggtcaagctagagctggaactcaggtccatccagtttcctgcctctctacagtccagattgcctgttcacagcctgtgggtcaaggttctattatctggcctggccaggcagggacagaggaagccccaggctggacctgatagttgtctttctgtttgtccacccaggaaagctgtggagtcactgtgtgtgacgggaaggtccacatccttggcgggcgggatggtcgcggagaaagcaccgataaggtcttcacctttgaccccagcagtgggcaggtggaggtccagccatccctgcagcgctgcaccagctcccacggctgtgtcaccatcatccagagcttgggcaggtgattcagatttggacagcctgagccaggaggcggagaggcaggcggagctcagatgcacactctgctccctcatggcacctccacgcaaacagcccttaacttaatggtcccttttcttgtataaataaaatcttgttgggtctgtgttccagctgcagtctgccctgcctggagatgcaaaaaaaaaaaaaaaaaaaa

SEQ ID NO: 265 - DNA, 2549 bp, Homo sapiens
  ref <308>: DATABASE ACCESSION NUMBER: AL050371
  ref <309>: DATABASE ENTRY DATE: 2001-06-18
agacaagatggcgacgtccgtggggcaccgatgtctgggattactgcacggggtcgcgccgtggcggagcagcctccatccctgtgagatcactgccctgagccaatccctacagcccttacggaagctgccttttagagcctttcgcacagatgccagaaaaatccacactgcccctgcccgaaccatgttcctgctgcgtcccctgcccattctgttggtgacaggcggcgggtatgcagggtaccggcagtatgagaagtacagggagcgagagctggagaagctgggattggagattccacccaaacttgctggtcactgggaggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtggtgaggcctgaccctttcctcctgcaggaaacaggactttttcctgcctccccagcacagcccccctggtctccagcgtatctggaaggggcaggatgacaaggggaggtgggggctgtctcctggggggaggagaccctgctctccctggcagcaagcctctcctgcccttccagattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctcccacctgttccagaggtgcagacaagaggtggcgagagcccccgtcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtacctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcaatgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaaaaaaaaaaaaaaaaa

SEQ ID NO: 266 - DNA, 1056 bp, Homo sapiens
  ref <308>: DATABASE ACCESSION NUMBER: AL050372
  ref <309>: DATABASE ENTRY DATE: 2001-06-18
cggaggcagcatccgcttcccctcctccttctgcggcatctgcggcctcaagcccacagggaaccgcctcaggtctacaccagctctcagcccctgcgtgtggggtactatgagactgacaactataccatgccctccccggccatgaggcgggccgtgctggagaccaaacagagccttgaggctgcggggcacacgctggttcccttcttgccaagcaacataccccatgctctggagaccctgtcaacaggtgggctcttcagtgatggtggccacaccttcctacagaacttcaaaggtgatttcgtggacccctgcctgggggacctggtctcaattctgaagcttccccaatggcttaaaggactgctggccttcctggtgaagcctctgctgccaaggctgtcagctttcctcagcaacatgaagtctcggtgtaccgcaaaaccgtgattgcccagtggagggcgctggacctggatgtggtgctgacccccatgctggcccctgctctggacttgaatgccccaggcagggccacaggggtggtgcctgtcaccacggtgactgctgaggacgaggcccagatggaacattacaggggctactttggggatatctgggacaagatgctgcagaagggcatgaagaagagtgtggggctgccggtggccgtgcagtgtgtggctctgccctggcaagaagagttgtgtctgcggttcatgcgggaggtggagcgactgatgacccctgaaaagcagtcatcctgatggctctggctccagaggacctgagactcacactctctgcagcccagcctagtcagggcacagctgccctgctgccacagcaaggaaatgtcctgcatggggcagaggcttccgtgtcctctcccccaaccccctgcaagaagcgccgactccctgagtctggacctccatccctgctctggtcccctctcttcgtcctgatccctccacccccatgtggcagcccatgggtatgacataggccaaggcccaactaacagtcaagaaacagctaaaaaaaaaa

SEQ ID NO: 267 - DNA, 1984 bp, Homo sapiens
  ref <308>: DATABASE ACCESSION NUMBER: AL050388
  ref <309>: DATABASE ENTRY DATE: 2001-06-18
gggactcgtggctgtggtggcttcggcagcggcttcagcagatcggcggcatcagcggtagcaccagcactagcagcatgttgagccgggcagtgtgcggcaccagcaggcagctggctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggtaggttccaggctgagcggcgggaggcagtccccggcagaggcgaccccagggagccaggccccatacggacgggcctctccgtggaggagaactcgcttcgcatttgtaccggttccgagttttccaggcacgatagtctctcttttaaacacatggtctacctcattgtagaaggagtgcctcgatgggtttgaacacacttctgtcatctcagggaacttggggtcctgcgaaggagcttgccttactgttgtgagccacattccgttacacatattgccagcactggtgaattgtagggcctgaaaagaaagctctactgtgtcactcgttttttttgcaaattgaaattgttcttgttgtataatgtgctttggggaaatgtttggtctctcaggtaggtgtgccagccgtttgcaggagggctgagagcgcctgtccactggtggccagacatcatcgggtccgcaggtgtctctgagtgtcagggtcacctcctgatagaagtgggagtggtgtcttactgccaggtcacactgaaggtgggagacaggaggacactactccgtgctaggaaccatggtccttgtcatcttcctgagagcaaacggggtcgggactccagcctaggacttggagactccctgcatccccagctaccctgcaggtgaaacttcactgagcccacttgacttcaggtgggagaggaggaggcacaccgttgtggtgtgcgttaccaaaaaagcagtaacctaactgtggaacagttcaggatctttagacttgatacttttcttgatttcccttaggggtcaaagttcacaaggaaaatagccctttagtgggaaactgaaacaggcttgtttttatttactatttactcatatttgtaatgcaattaaaatatatgttgttaacttttttttttttctcaagagctcggttgataaaaccaggggtatgtggactttttgagtctgtgccttttgggggtgtgtatgggaatgttatgttttaacgttttttacaaaatagaattgtctttttagtctattcgttagtggtttgcacaaggaagataatcgatagtcatgttttttagactctctgtattgcttggtaagctacgtagtaaaaaatgtttacttttccttaaatgttttgaatttcggggttatgaaatttgttgagtaatttttagacagtcacatcttgttgactggaggcatctagtggaaaaatgcagtatttcagcctgattgtgtttgaagtaaatgattaaaagaggaggaagttaccacattctggaagatttacttgagacagacgaaccttgaattacgggaaaaggccccgtgatttaggaaataacaaatttgggaaacatgtaatggggagagactggggaataccccagttgtgaaagtacttcctgtaaggcaacatctgacaccaggaacctttctcttcagtattttaaaaacaacttaatttcagtcctttacttgtggaatcagagccttacttatgtaatacaacccactggaaaaaagctttttattgtattgtactatattgtttataagtgattgagtacctgcagagctttcttttacttaaacatattttaaaaattattaaaaagattttcatgtttgaaaaaaaaaaaaaaaaaaaa

SEQ ID NO: 268 - DNA, 1047 bp, Homo sapiens
  ref <308>: DATABASE ACCESSION NUMBER: AL079276
  ref <309>: DATABASE ENTRY DATE: 2001-06-18
gcagcagcagcgcgggggagcctggaggagcagagagcagctcgtccccgcacgcccccgagagcgaaacccccgagcccggcgacgccgagggccccgatggacacctggcgaccaagcagcgcccggtcgccagatcgaaaatcaagttcaccacaggcacgtgcagcgactcggtggttcacagctgtgacctgtgtggcaagggcttccgtctgcagcgcatgctgaaccgtcacctcaagtgccacaaccaggtgaaaagacacctgtgcaccttctgcggcaagggcttcaacgacaccttcgacctgaagaggcacgtccgcacacacacaggcattcgtccctacaaatgcaacgtctgcaataaagccttcacccagcgctgctctctggagtcccacctgaagaaaatccatggggtgcagcagcagtatgcctataagcagcggcgggacaagctctacgtctgcgaggattgcggctacacgggccccacccaggaggacctgtacctgcacgtgaacagtgcccatccgggcagctcgtttctcaaaaagacatctaaaaaactggcagcccttctgcagggcaagctgacatccgcacaccaggagaataccagcctgagtgaggaggaggagaggaagtgaggagaaggaaggggaggacagacgttcacactgccacgtatgtctacgtggatttttggttttcagcttcccccaccccactggctcttcttaattagaagtgaccagttcacctctgtgtccttttgaaacatcagcagtagggtccattccaagattgtcagttaccgttagtgacgtcaggccctgtaacctgtgtcctgtctggcgcagttgctcacattcaccaaagtttgttttcatgatcctgatggccaagaacaccgtgtgggattttttttcccccaaggattttcacacacggaaggagaggtatttcttagagagatcatcattttatggtgccttgaaataaaaatacttctacttgaaaaaaaaaaaaaaaaaaaaa

SEQ ID NO: 269 - DNA, 827 bp, Homo sapiens
  ref <308>: DATABASE ACCESSION NUMBER: AL079298
  ref <309>: DATABASE ENTRY DATE: 2001-06-18
tcgtatctcagtgatgggaggagagcaggcagccaatgtgttggccacgataacaaaggaccaaagagcccgggaaggaaagcagttctccagtgctgatgaagcggctttaaaagagcccatcattaagaagtttgaagaggaaggaaacccttactattccagcgcaagggtatgggatgatgggatcattgatccagcagacaccagactggtcttgggtctcagttttagtgcagccctcaacgcaccaatagagaagactgacttcggtatcttcaggatgtaactggaataaaggatgttttctgttggacatgtactgaaaattaacacatgtagtagccttaaaattttagacttctcgaacatgaggctgttacagtaatttttttaacactgtgcattgtacttttctaccttaaaaaaatcagtgaggatatttatttaatgaacatcaattccttttaaattttcttagagaaatttctctgtggctcagttttaccacccataaagcggagacagtaatttacggttatcctttctgacccacaaagtatgaaaagttctgtaatctgtaaactcagttctgtaatctgtattattgagatgattaatataaagttgtattttcactgaaatgattgttttgctggttatgcttggtgatattttagcgggcttatttttgaaaggcatctgttacttcagttgcataaagtgccctcacactgctgtgcagccattaccaccattcatctccagaatttgttctcagtcccaaactgaaactataccattcaaacaacagcgctccccatttc

SEQ ID NO: 270 - DNA, 2626 bp, Homo sapiens
  ref <308>: DATABASE ACCESSION NUMBER: AL080059
  ref <309>: DATABASE ENTRY DATE: 2001-06-18
gggtacggctgcgagaagacgacagaaggggatgtcacctgctttatttctggctttggcctgtggtctgtgatacccatcctgcttgatgttctgcagaatggcacttgactgctgggcatgcatgaagttaagggcaagaaacagtatgccatgtgttctgtaccatcatgtgtctcttcttgcttctgggcccttctactggtgaactttcatcaagatctgcgccatgccgtgtcactatcaagccattaagttttgtctgggttgctgtcagccccagttggcttcctggtcaacaaggacctcaagaactgcctgtggaccgaggccccctaccagtgcatgagacacacacctaccctccccagctttccaggaaccctactggctgccagactgatgggcgggctggtatgtgtggacatgtgttcactgtcattatgctgtggctccaggtgagggtgaggactgggcctatatagaatccagataccattgtcaacttcccttattcccgtctaagatgtgagcagagtgccatagtaggggttctgggaagaggtatttctgatttgtgggcctctgcttgcttgacttcaggtcacttatacttcttattttgcttgcctgccttcatccctcatttcctccctctcattcttctttcctccctccctttcctggtagcctcctttcctccccttctgccttccccttccttctttccttattcttttttattttgtttaaatagtaccacagagaaaacaactgaaaaaccacatttttctacatacagctggggaggtagctgagaacttggcactgcgcacacatactaggttgaaagagagttgaggaaaccagaaggccaagtggatctgctggcaaaccctgaacctgtctcctgcgcttgctctacagttctgaagttgaaaatcgttttcatgcctagcatctgcttgagttataaaccccaaggcagccatgtcatagactagtgtttactcttgttttgactttgttttaatgcttcctaagacccaagtgcctcctgctgtttcctcctttgtggtagcctctggccatctggacctcaatccccagctttcccactttcagcagtcctttgctctctttgcttctacctcaaatagccccaggagtgggctttagtctccaatatggagcatctcaagcttctcctgggggatggggattgggatgggcggaatctgttttggatctccgggttatttccagtgggtgtaaaagcagagctgggcctttccctctcttatccctgagggtgggtaagaaggactgtatctacacctgttcttccctaccttctcttttgttagggaggcctcattctaagttcctcaagagagtccttggcttaaagctgtagcaagggtgtgctaggtgggggatttggagcaaaaccgtcgagtaggcatgatactggtatggagtgggcctgcaaaatcagacagaaatggcttgagaagccgcagggggagcatgcctgtctctcagtgatagagtatgggagggacctccctagcttggaaaatgagaattgaaggggttatgaacaaataggatgcctagttgaggatgttcccaaagttttgtccaatcttatcattagtagattttataagccacagagacaaaccagaaacggaataatgttactttggatgctttatttttttgttctaggtgtggctttgtacatgcagaagaatgctatatgctgcacattttgcctttaaagtcttacgactttccccattttagtctaatgggaagatacagatgtgcaagtctgcttttttgttttttgttattatttttttttttgctctgtgttatggacattttcagacatgcacagaagtggagaggatggtccttggaccccatgtgtccatcacctagctgcatcacttatcagctatggtcaacctggtttcatctgtatctctctcttttcacctgtattgtttattgaaaatccaagacactatgccaatgcaaccgtgactactttgggagattggtagtctcttttgatggtgatagtgatggggtgcactatcataatcacatcaggtctgctttttgcttttaatgttaactaatgaagttccagagatgggccttagaaatgtgttttaagaattaacaaggagtctcaaaaagaaatgagagggatgcttcctttcccttgcatctacaaaacaagagagagactgttctgttgtaaaactctttcaaaaattctgatatggtaaggtacttgagacccttcaccagaatgtcaatctttttttctgtgtaacatggaaacttgtgtgaccattagcattgttatcagcttgtactggtctcataactctggttttggaagaataatttggaaattgttgctgtgttctgtgaaaataacctccccaaaataattagtaactggttgttctacttggtaatttgacaccctgttaataacgcaattatttctgtgttcttaaacagtataaatagttgtaagtttgcatgcatgatggaaaaataaaaacctgtatctctgtcaaaaaaaaaaaaaaaaaaa

SEQ ID NO: 271 - DNA, 1929 bp, Homo sapiens
  ref <308>: DATABASE ACCESSION NUMBER: AL080079
  ref <309>: DATABASE ENTRY DATE: 2001-06-18
gggggagaatttccattaggcaagctgtatgcagtggaattttccttttaggagacacacaattaagactctctggttctgtccttgctttggagactttaagacatttcctaaagcacaaataaaagcctcgtatttccccattgagagttttgttccaaggaatatgaagtgagacatatgggtgagttataataatcaaaataatttatgaagagctgggtctgcaatagctagtctaaaaactacttgtgtgtcagtcctctggttatagtatataagagcctgaggaggtctggcaagatagatggtgtattatttatggatcaggctgctgcatacaaaccttgcatactattatgcagcttacctaactctcagactattctgagtaatgcttgcttgctaatgaatgtataggagaccacattgtaattgttcttagatgatggagtccatgcagtttcttagaaatcggtctcagtgcatgctgtgctttttcacatttgctctgggttatctgggaagtatcaggttctgggaggcaacagcattaagtgataagaaaaggagacattctggcaaagccaatctgcttaaaggcaaagtccagaacctggaacctagaggcctttctctctgcacgaaaaacaggtagtttgcagtctgagatatgggagagcttttaggctacacagcaacccaagggacctctcaccttttgctgagcttcaatcaggaagctatttgcctggctccagcagatgatgagataatgaggtagtgggttttttattactgttccattttgcaacatcctgcaacaccatcctgggagacaagagcattaccgagcttggctttcacgggggagggttgtattcagtaaaaaagaatagtaaatataaggtcactgagattctaagtaagatagtaaatctaaggtcactgagccaaatccttttcaataggcatatattaacaggctgcttattttggcggaggttacatatggatgaaaatgaatcttagtcactgaatattcatatacatttcccccaaaaccttagacattcatagtagattttaattagttagctttctaactagtcagatttctgcccaaagtgcttagtcaatagtaattaagatatagcttcaaaaatggctttgcttttgatttctactcatattcgtatggctccagaaaaatatttttttcatatttgacaatgtcagctccactttagaaattttcaataaccagatgagaaaaaaattaagaaattgctcaagggaaacatttgtaaatggatttgaaagattgagccaaattctgttgtcagttctaagcatgcagttctcacctccatttagtcccccatcagaacagaggtcaggaatttagctggggagcctaaatttagttcagcttacctttgagaatagcatcaattcagactctcttttcattatgttttcttttctttttccctctttttaaactacattgtgttagagtcgtagtctaggatcctgagagattttccattcttgtcaccattcacttgcattgtaaagattttctttgtctgttgttggcatagattcttttgtacatatttatttatttgtgtttatatatgtcaattggtttcctttcttagcttgatattgcctagctttgttgttttaattaactttctattagagggactgtatatattttttctaaatactttgtgaaatcatttttggtagcaatatctttgaatatgatgaataaaagtgactgtgagtgcaaatagaattagcagtaagaagctactctagctaatttgccatttcacttaaatggaaaatgtttttcaaataaatacttatgttgttcatgttccaagttattcaaaaaaaaaaaaaaaaaaaaac

SEQ ID NO: 272 - DNA, 1866 bp, Homo sapiens
  ref <308>: DATABASE ACCESSION NUMBER: AL080110
  ref <309>: DATABASE ENTRY DATE: 2001-06-18
attcttgtgagtggattacaggtttttgatcccaaaattccagagctttcaactctctgaatttgtagtcctgaatatcccagtggtgggggttcccagcattgtgggtgctacttgcaaggccatagaatctagatggccctgtcttgaccctgaaatgaaccttaagccttagaacaaagtcatgcagatgccccatttgataataatcttattcacctgtgctctggtcctcggtttctgcatgtgttagcattgcattgataactcagaatcttgataaacacttaatatttgggcctgaagcattaaactttctttttattgtatatacttaaaaaatagaactcactgccctatcatacattgtagccctcttattctttggtctttcatatgcattagttaaatcccttaaagtagacattcataaaaacttacattgtttattggagtataaaatattacccaagtttcttcatgagttgacatgagctgttttaaatactggtgtattttcagaacagtaaaattactgaatatcagaaaaaatgttaattgatgatgaagcttattcccaaaatgccttttgtgcatatgatacttggaaagtcactaatgtgcctcagttaatacatcagtaaaatgttgtgtttcttttccagtgtagtgtttttggaatataaattccccatgctagtatagtatctcagcaaagagaatttccccccaggaggctcagtaaaggaataccgtgtcttacccatcgttatgatggaaggctgctttgaaaatggctgttttaccttataaggttaaaattttgatccatatgttaagtgatagaagattttggtgcaacagtagtaggatatatttctcctagaacatcccttattggcttacatgattttattgccttttaatagatattttgtcattttggccaaacaaaagacactgagtagttacacttaagttaaaaatgaggggaaaatcattattttaggtgtggagccatttttattataaaactttctcaaaataaaaaaacattgaatcatttcaatttttgcagtccctgtattagtatatgaatacatacttgccatttgaattaataacatgaaaagagtatactgtgtttttaaatccgtgtttctttgaatttaaagggtgtacaggtctttctgtagggaaaattattccatgtaaacatttcaactctgtatgaaaatgttaaatattgtaagaaagttatcctctcattttttcactgctatgatatatttattataaaatagggaatgaatgaatgaatatggattgctgttaactagaaacacttctgtatgtcagtcagcatttaatgaccacctactgtgtgcacagcactactggtaaaattttgaagacattgttaacattaaaaaatattttaaagttgtctacaaatctgagccttgtaatgatgtatatttaagttatttttgtttttatagattaaagtaagattaaaatatactatccagttttattactaaaaaagactggttttaattttaccaatgtgtgaactataaaagctttttgcctacagattttacattttaaaattatctatggctgttttaaattgtctagcaatttatatggttgtggttaactcatttaagaaacaattatctttctatattaagccattttcaaatagcaagacagtgcttgtctttttttgttattacactaactgcaattcagtaagctgcatgacaaaatatgtattatgtaaataaactgggtttactaaaaaaaaaaaaaaaaaaaaaaaaaaaaaaaaaaaaaaaaaaaaaaaaaaaaaaaaaa

SEQ ID NO: 273 - DNA, 1730 bp, Homo sapiens
  ref <308>: DATABASE ACCESSION NUMBER: AL080192
  ref <309>: DATABASE ENTRY DATE: 2001-06-18
gagatgtttctaacatttaaataagaaaaaaatcaaatcgaagtcagcctgctggaaaagtgatcacatggcagttgcagtaacttgtatggaaagagaaaatgcaatgagcccagttactgcacttgccactaccatgctgtccatggaaggaataatcagcagttcagttgtcacaagccgcccttgaagaaaacgcagcaaaatatcttcattttaaaatattttgctgcgttttcttcaagggcggcttgtgacaacgcagcaaaatattttaaaatgaagatattgcagtccccagagccagtgaaggtttcttttggtaaaatgaaattgtgccattgtcaaagtaccccgtagtgatgagcactgactggttcactggccacattttagttcttcataataataggccacaaaagggctctgtggtttgcctccatgtgcactggcccctccccacccctagggggcactcagtagctgctgagaaggcctgtccacgaggctgttggaacccctccaataaatacttagaggtagtgtatctgatgcttgttttcatggagaaaattgtattggagaacttaaaacatcacgaatatttttaataggatccgcagacacccaaaggagaagcttggtcttttccaggtatttccaacttgagttcaacccaaagcctttgaaaggaatgcattaccacatgaccacatgctgagaccccatggggtctaacacgggacctaagaaagtctctgcagccagatagtacatggtgtctccacaaaactaggcattctggagattgcccagaaagggatgtgaggggaccgttaagatctgtcttgcttatctcatgcactcacattccttcagcctcctggagttcctgataaaaggaagccagggtgttgacattttttagctattgatttcccaatagcttgtggatcagttgtacacccacacttccttctctgcctaattccgtttttctggaaaaagtagtatgcccatgtatgtgtgtttttcttaacacaggtccatgaaagtttggcttcctggtttgatgtctgttgcgtggcctggaaaccagggagcagcaactattgagatggtttctgtgttcagtgaaaaattctatttcattgagacaattttttctttatccacagtaattttttgacactgtcatcatgaaactacccttaggaaaataagattacctgcaaaaaaaaaaagaaatgagttatggaataggaacagttatgtgatgattctgaaactttaacttagagcttcattactttaagaatggaaaacaacctctgagtttgatttcccaaagtttcataaagcccctaagctcatgattttcatcaactctttgcccacatagtcatttacctccacagccgtttgttgtcatagaaggggtggtggtgtttggatttgatttttttcaacttgcagtgagaaataggataggtgacaaaaccttacttgttttcttaagacaattcagtgcttgagcatctctgtcagaaatggaatgaaatactgttagccaattagaattattttatgtattgttattgtgttttgctgatttttatatgaaaatataattattcattcttgatctctggaagcaatcattattatgaggatcattttactttggaaacactttcataataaagataagtattaagaaaaaaaaaaaa

SEQ ID NO: 274 - DNA, 1034 bp, Homo sapiens
  ref <308>: DATABASE ACCESSION NUMBER: AL080199
  ref <309>: DATABASE ENTRY DATE: 2001-06-18
gacagactggtctaatatgctcactggtcatcacattcagcttattcttacgtgccagtgaggccctaaggtctcagtgcatagcatacctgccactctggatgttttcctgggcttcatatctgtatggcaaggagggagctgtccttcagcagacaaagtcaagcagctttaagtacaaggcagcttgaaacctctctgatgaaagtgaaaaatgtgggtagcttatactttcaaactaatgccagtgactagagagaggtttcattcatgatgtgtatttccaatttggtcttcaattcaagagatgcttcataaaacacttatagccttaaaccattcaagggctaattaaaaaaatagttatgaaatcttagccacaaaaaataaatcaggtaaacattttaacctgtcgttaagtgttgtaacttcaaaaaaccaaaatgcttattttaatgtgatttttctaaaactattgaaaaattaatatttctataatctattaaaaaaaatggagaatgttttctctcaaatttcctctgacccatgggaatgaaaatacttaaatactgtaaagcatatctattaataattcccccaattttttaaactaacaaaatggaatgttaactgaatggaattaaacatagcaattgtcaagccatcaaaattatatatcgaaccacttaggcatgttacggggtaaagtcctcacccctgcatttgagaaatattttattatttttattttaaggcaaaacagtgtttactgtgatgggcagaacagccttttgtatctaggagtccatttgagttctttccaatatttccatatcgttcataaatgtgtctgggggcttccttgtttggaaaatatggatatcgctttgttttcctttgaaagtaattatatcttaagaacatagtatcatgaatggagtagacagggaggctgcagaagccatttctctttgtagataaaaagcattatctatgattgttgtataataaattgatttttacattaaaaaaaa

SEQ ID NO: 275 - DNA, 4254 bp, Homo sapiens
  ref <308>: DATABASE ACCESSION NUMBER: AL080209
  ref <309>: DATABASE ENTRY DATE: 2001-06-18
agctcgcccaaagagatacaacctaatccccaacctacttttagttttttttgtttttttttttatggttaaaagtaacttttgtagtttaaaaaaatctttcctctttcatataaataagaagtggaaattgcctttttattgtgtaatgtagaaaaccctcaagtgttttttccgagcttgggaaagattttgtgtaggaaatgtgcatagagtttgtattttatttttattagcagctgaaatgcctttggttttggcttctctctctccctctctctctctgtctctccttctctctctccccccaccacccacccccacacacgtcatctgcattgttattggagcctgtacttagagggattaagcccacaccctggcttccattccatatcaggtacaggatttgatgttattaacatttgtcgtcatacctcataagtcggtccctgccttgtctgtctaggcccatttggggctccctgtgagtgattcccctctctctgctatgctggagacggttccagcctggaaagcggccaagttcatcttctcactgtgagtggaagctggatcgggcccccgtagtcctggcagccctgttgtctggagggttcttgttgtccctcccattagccagggcggagactgtctgagctgtgcaggaggagggttgctagtaggttctgcttctgcttctctctgctccactgtctgcagcccagatcctgttgggcctggctggtgtctggtaaccatgggcctccactgacccatccctctcttttaaactgtcaggtcattatcaggcataggcagcctatagggcccaaagaaggcaaaaagataagatttactcaagtagcatttgggcaatgaggaaggaaaggtttcaaatttaggggcagaagtgagagaatgagccaacccatgtacctgctgcaactgaaccagactgggttttcaaggctcccagacgtagagtaggaaacgtgctcttctaaatgaggagggagaagataaaggaaacttctagcccctgtccttagtgctttgaggattttattttctcccttactacgcttgcttgacgtcactctctctcgacctccaaacagcaggactctttctctgggaaaccgtccttccaaaacggaatctatgtagacaatgggacattaggcagagagctcagatggcccttttaagggggctccaagaaccaacatcactgctcttttagataaacctctgccctccactccttgcttgagtgggttaaaggaactaacagttgtccctttaggaggacaaaatggggtcaagaggacacagaagagttgtatagcaccagattggttccaaataattaatggatgtgtgcacattttctgttcagggattaagaccagaatatcagtggatttgttttccccaccaagtggcctcttagactagtcattaacttatggttagctctaaagatttcaaatagtggcagacagtgtcttctgaatgtaagttttgagaaatacgagtctgtcagagcggccataagccataaagagtcaatctcttcattatatttttcatcatgtaaacaagtttcccatttccctttcttagattgcaccagtgaaggagatgttttgcaaagattcagagaactaatttttcactggataagacctgagtaacccagaccccccaccgtggttcttttcacagccctcgactttgcacttaaaaagggatattgtaaatgaaaggctgcagtgccagttttaagaaagaatttctgtgaagtgtgaggactctggagtctagctcacataaagagagtgttatataaaaatccgacagctgaactaggttgctcttttttggcagggagtggggatgagatttgacaccaatatgggcaaaattagataaccttttggttaatataaatgattttgatttggaggcctaatttgtagattgtgaaagcagcttttagtttaacttattcacagaccccttataattaccatgtttttttttttcttcctaaatctcttggttcagcttgtgaatcttacgtgcccgtaaagttgggatgttgaattggctcttctttgttctggcagtgagtcaagtgtccagcattttttcataagtgttttttaaaattgttctccagcattttatggctcctccctcccatgtcctcagacccagcaaaagcgtagaggcagaattagaggcctctccaggccagctcctctgcccacatgtcatacaaggtgtgaatttgagcacagtccagaaatggagacatcccacccccagttgaataatggcccattcatgccaaccttgccaacacggagagggcagagatgcactagaagaccttcatcctccccttcctctgccccaagtcactacagttggttctattgaagccagtctttaagaaacctgggttaaagacaccagcacttctgcttgctgggctggctggacctgtgaagccatgggcaggtagtgccctcttgagagtcattttatttggccaccttcaggtgagactatccatagacacatgctaggataggccccgctgggagggcagttacaggagagagtaggtggtggtgacgtgagggctgtgaaggatccagagacaagacttagatgtttcgttcattcactcattcattcagttactcctaagacttttcagtttcataaggaagagtgttgcctgaggccctagggaatattggggaatagaagggattgaggaaacattaataatagttattcaaaagacccaaatgcttatacttctctctcccttcttctctctctgacacacacacacacacacacacacacacacgtgcacattcctcccttacatgctcatttgtgccttaaatgtgccttataggtaaatccaggatgacaggaatccctcgtcactgggagattttgtatatattcttttattattagattgagttgggtgtggggaaaaatttttttctgaaggctcaaaagtggtttcctaaaagtgagccactatcagatttgcacatcaggagaaaagaaatagggttacgtccattaggaaaatcccagtttgcaggagtgcaatcacatcaaaaaaacaaccagccaggattaaaggtattataaatcctcatagcggaacatttctcagggcaaaggaacctggctcatttgaagattaatgttccatgcctttgtggtcaaagggtcagcacttaacacaggaaaaaactaggtgttgttttgttttgttattttggacaacataaaattcaggaatgttttatttagccttggtttctagaaggaagggaaataatatttcttgagcatttactagggtgttgcgtgctgtgctaagtaaattttaagtctttcagttttatagatacggaaaacaagggtgactctttaccacaggatgaataaagaactaagtaatatgggaaatgcagcaatttctggactagctgagccgattccttcctgtgagcacactgtaagctttcaagttctctgggcaggaattacagcacctgtcccctgcaatggccctgctgtgtgatgctcatcgcttcccttcgtgctggagcagtcccccaggtgtccatctcctatctttttgttccaatcttctgtgagttccagctagcaggctttacatctggggaaaggaaaaccaggggttttagctctgttctctgctcccatccttcgctcaccagctgagtgagaacatgaactttttgcaccatgtacccatggcttacactacttagaaaatcaccttttcagataaaacagtttatgagttcatagagaacaccagcactctttgacaaaactgtgagtgaccctttttaaacaatgctgagcaggccctgagctataatcaacggtgagctttaatgtctatgctgacagttaggttttgctctcttttgtaacaggttacgtagaccagcagtgtttaaatctaaatacgttgtgagtctgttatctgtcctatcgcgttttttaaatgactttttattctttatcatagctaagtaaataccaaaaaaaaaaaaagctttgtaggacacttgtacttagtttgggaaaaaaaaataaattgaaattgttatgcttttgtatttccatttcttgcaaataaatattttttcttaaatagtaaaaaaaaaaaaa

SEQ ID NO: 276 - DNA, 2909 bp, Homo sapiens
  ref <308>: DATABASE ACCESSION NUMBER: AL080222
  ref <309>: DATABASE ENTRY DATE: 2001-06-18
aaggatttatttttttcccccttttctttattttgctggggagaggctaaagggaaaggtagtaggggcgggggtggtgacctttaagtcttctgaggttggtaattttccacaattggattgtcattatagacagcagtgtgttttttagaaagataagagaatcacccctatgctgctgagatgtacatttgtaatttatctgttgcatacttagtttttagtcctgtaaatgcaaacacagcattttttacaactttctttgttcttggtacttatactttgaactatgatgtacatatttatggcttttggcttttaatataatggacttgcaagggctgccagaggttctgatatgtaagaaaactgcaaaaacaaatatagacaaatattttgattctagagaacgtctcagatgtgcttataaagcttccaaatacaactccagtaagacatccctttccctgcaggagtgtggtctatattctttagatagttgtttagtcaaaagaccagacaagttacaaactaagagaaacaatatttcacaacacagtaaagtgtgatgagaggtcaggggaacatcccagtaaaagagaagagtcacaggaagctcatctcctccctggattctggattaggagcttctgaatcttttccagggataggcaggtagctcactcttggtgcaatttcttgaggatgggaacatgtagagctgctggaaggagtaattctgtgcttgacaaaggacgatttctcctttatcgtgaccagtgctgccgatttcctgacagaggagcttacactctgagcaccttgttttagcgaactctagcaaaacttgtttagcttagcaaaaacaaacacacaaaaaactgagaactctgctgtttcagatatgccataacatacatctgaaacacatgtgtaacaatcaaaatggtgggctctagaatggttttggagctcgagatcttcatgggttagacttgctggtcagacccaggagcacctgtggctcacaccttctgttcccctcctggcctgtgcagaatgtaaacagcagactcatactcaatgggcactacaggccttatcagacgttttatacaagcctggattgcttagtaggggaataaggcattctctgagggggctttccacttagattgagaattttatttgaaaagaatctggtttaaatggcattgtggtccgaggtagctgctctccccaccgagagctgagccgaaatataagaataatatatttgtgcttcgagttggtgtttctttcagtgtaatgcatgcagtggtcacaacccagttactcataatatttggattgtatttgttcgtagatatgcccagaagactagagaattagtgttatataccatatagaacttactgtcagtcaactataaacaggcccaattaaaaactgttccattactacgcaaacacatattagaggcctttgctgatgacacattagctggatcttagccaccccagaaagggtttgatttgaagctgattgttgccagatatgcatattggaatcccatctacccatagttcctctgaaggtgattttgtaatttgcaaaagggtataggaaaatatacctaaaagcgaatttgtggctgagaggataaacagaagctgtttgctcatgctctgtgccccacacccaccaatacctaaatctgttaaggaagacagaaaatgttttctttgtgctcattgagtagttccagacagaagaagaatatactctttaaaatgtatttacctgttagttggaagtacccagaattatcagaaacgaatgcaaaaaaaaaaaaaaaaaaaagcttacacagcttcttagcaatttttttttttttgccgaaacaataaattgcctttagcagcagtttaaaatcctatcgtgaacaacctatattttcgccattttacaatggagagttgtgacaagtacaggttatcaagtttgcacttaactatgccaaaaaaagtttgaagcgctctattctcagacatgctgtattattacttctcattcaagattgaaaaatataaaggtatccaaactctgtcttaatgtaaatgtaactatttttccttcaagtgttgactagggagtcggtttctctcttaaagacactcactgtacaactgaaagcagctgtcatatttctggcaaaatgtgtttacgtatctgacaagttgtacatttgtgtatgaactgacataaaatgtgaaagcctgtaagtgtacatgtagtggtgtggtgttctgtctagaggatacaactgaatgtttttaatttgctgacttacagacacaggctgtttacaaaatgctagctggaaagtctgtaatgttcatgtcataacttttagttaattgccattgagcacctgttctgaggaggtgagatgtggacttgtgcttataaactggagagtttagtcataatccctcctggctttgtgtgaatagcttgctcactttgctggcctttgaaatgtgttctccgtgataagctatccatgtgtttgtgataagagtgcttgtcaaccatgaccatctttgagccttcctagtcctccacctggcacagtatttgaaatggcaaaggatgtgcttcatcctctaacagtgtacactcccagagctgatattctggattttgactgtgcacatttcctctagttcatgtctgtagtccctatagaatgatctgtaataaaatagtatactggactgtgcatcaaagggatgtaaaattacagtattccaaaggttgaagttctgctgttttgttataatgcctgatacacatcttgaataaagtcttaacatttttctttcaaaaataaaaaaaaaaaaaaa

SEQ ID NO: 277 - DNA, 2159 bp, Homo sapiens
  ref <308>: DATABASE ACCESSION NUMBER: AL080234
  ref <309>: DATABASE ENTRY DATE: 2001-06-18
ccacgctcggcagtggcacgatcctggttcactgcaccctctgcctcccaggttcaagcgattctcctgcctcagcctcccaagtagctggtactacaggtgcgtgccaccacacctggcttattttagttattttagtagagatagggtttcaccatgttggccaggctggtctcggaactcctgactgcaggtgatccgtcctccttgggctcccaaagtgctgggattataggtgtgagcccccacgcctggccaacttgattatattaattttgggttttttgttttgttttgttttgttttttaatttttcaaagaatttgtggatcttggtataaagtcattggaacatatctgttttaacagcaagagatcctaggcagatacttcaaaaggttaaaaattcttaatcctacagaattttaaatgaatcttatcaatgttttgtaaacaaacaatatgaatggccaaaaaattgccctccattttactggcaggtaatttatattgtcttacttaagaattctcccctagtttttcaattgtactttatcgtgttgttttcaatgagataagtattttcatagggaaagcattttccagcataatatttgcttgggtagcatccgggttttagtatttaaccaagagccttttaaatattgaaaacccatagttcagaaaatgttagtattgctgcccttcttcacataaatttttttttaaattatactattattttgcttaattttatattgggttaaaacaaccttcaagaaggttaactaggaaagaagacctttttgttttatttttactatttatatatagaagacaaatcagcatttggtgatagttttacatgaccagttatcaaacggtcatagtatgaagtgtgcagttgttcattattagtaaattatgtttgatttttaaactatttagtactaatagttgagatgaaaactgaagaaaaatgccaatgtgacgtttgtgtatagctagccttaaaaaacttcccatgtttttaggtgacttttttccccctcttagtactctggagaaacaatgaagatgggccatctcaattccagatgtaaacaaaaagtaatttttatttcaacatttaatgtaactgctattattgtggattcttgtcttgtgtattttctttcccttattcaagtaatatagaataactttccttaaaatgatttgatccaagatacgtcatttctgtattggcaaaatgccactattaaagtgtaattcttgaatttaggttgaattgatgactttttaaaacaaaacaaacactggacagttctacattgtattgcgtttgcgaatgtgcgtgaacacacgcacacgtgcaggagaatgtagtgccataagaacactggcgctttttaaaactttccaagctagctacttattttcattttcagggttgagtactctaagctctctacttactgtgagaagttttctacattgtaaaattaaaagattatatttaaaatacttctttaggatgttattcagccatcaaaaaaaaacccaactaaaatgtcttaccagtaaagtattattaaaagcctcatttgtggagattcgctgacttccttggttaagctgtcttgtatttacttaatttgtcccctcaaccaggtgttttcttttcagcctgttactgtcctgtgccatttttaaaaatagccatcatgagtaagggcttctttaaaataatccctgacaatatctttggcattaatacgacataaagacaagacagtatatgtatgttttcattcctgttttgtacgagtgcctcattttgtagtcatgaaagtaacatagtaccttaaataaaaatgtaatgactaatctaaggtctaggaataactattgtagaagctaagtagaacacttagtttggggtgtcaattttctatcaacgcaaacaccttagggtacccagaccaattttatgtatatatattctgaaatgctccctttttaatgtggtcatttgttgccttctaagttgagaggacaaaactgaataaagtgaatgttaattgtaaaaaaaaaaaaaaaaaaaaaaaaaaaaaaaaaaaaaaaaaaaaaaaaaaagaaaaaaaaaaaaaaaaagg

SEQ ID NO: 278 - DNA, 1130 bp, Homo sapiens
  ref <308>: DATABASE ACCESSION NUMBER: AL080235
  ref <309>: DATABASE ENTRY DATE: 2001-06-18
ggtcgccgcaccggccgcctccggcccgccgccgcccccagcgccgccgccgccaccgccggggcgcccaccgcgctgccagcctaccccgcggccgagccgcccgggccgctgtggctgcagggcgagccgctgcatttctgctgcctagacttcagcctggaggagctgcagggcgagccgggctggcggctgaaccgtaagcccattgagtccacgctggtggcctgcttcatgaccctggtcatcgtggtgtggagcgtggccgccctcatctggccggtgcccatcatcgccggcttcctgcccaacggcatggaacagcgccggaccaccgccagcaccaccgcagccacccccgccgcagtgcccgcagggaccaccgcagccgccgccgccgccgccgctgccgccgccgccgcggccgtcacttcgggggtggcgaccaagtgacccgctccgctcctccctgtgtccgtcctgtgtccgcgcgcgcgggtgcctttcccgccggggactcggccggtgtgcttcgtgctgtagttatcgttagttcctcttcccgagatggggccgccgagagaccccagcgcctttgaaaagcaaggtttgtgctgcgcttccagttccgaaaagcagatgtttaagcccttggactgagggtgggatcgcagctccgaagacggagaggagggaaatggggccctttcccctctattgcatccccctgcccgactccttccccgcacccacgtgccctagattcatggcagaaaatgaccaaatcctgtgtatttgttttatatatttaataactgttttaaatgaaagttttagtaaaaaaaatacaaaacaaaaagattaaattgctattgctgtagtaagagaagctctttgtatctgaacatagttgtatttgaaatttgtggttttttaatttatttaaaattggggggagggcatgggaaggatttaacaccgatatattgttaccgctgaaaatgaactttatgaaccttttccaagttgatctatccagtgacgtggcctggtgggcgtttcttcttgtacttatgtggttttttggcttttaatacagacattttcctccaaaaaaaaaaaaaaaaagg

SEQ ID NO: 279 - DNA, 2310 bp, Homo sapiens
  ref <308>: DATABASE ACCESSION NUMBER: AL096737
  ref <309>: DATABASE ENTRY DATE: 2001-06-18
gtcacataggagtgaggacttggtgggaggaagctggggcgtgatgtaatatgccttttgtttccagagagacagaggtggtagtttggctgggcagggagccttgctttaccccattgcttgtgttaactcacaccttcttgtttcctctcctgtccttttcccccagcctttggctatgggctgctttgtctaggaatggcctatatttcctcccagatgggacctgtgctgcaggcagcaatcagcatctttggcatggttgggggaccgctgctgggactcttctgccttggaatgttctttccatgtgctaaccctcctgtgagtgatgcatctggatccacagtcatgtgtagcaggatggacctgggggttggcagggctgtcaccaggagagctgaggactgccgtgagggctggcaggactggccttgtgacaggcctgcactgtgtctcggcagggtgctgttgtgggcctgttggctgggctcgtcatggccttctggattggcatcgggagcatcgtgaccagcatgggcttcagcatgccaccctctccctctaatgggtccagcttctccctgcccaccaatctaaccgttgccactgtgaccacactgatgcccttgactaccttctccaagtaaggcagggcttgctatcttcttgttttctcaaagtcctcctttgagggctttcacaggggtcttgctaagggatgggccaccagaggccccagggaaatgttgggtattgggtcccaagaccctgggaccatgcgggcaagtagagattggtgcccaaggaatgccctgccaacgaattgctaattgttctcacctctgctcttcccaggcccacagggctgcagcggttctattccttgtcttacttatggtacagtgctcacaactccaccacagtgattgtggtgggcctgattgtcagtctactcactggtaagggtgtgggattgcggtgcagatgagcaccgagggttaacagagggccctaagggactctagggagaaaggctcctgccctctgagctcttgggtgtccgtagctgtcaggcttttctgctgggatgtaggaggtgggtgggggctggggtctctgggggccaagggaggacatggggcccgctgctgtggatggttccacccagagactcagaagcacatttccattcagggagaatgcgaggccggtccctgaaccctgcaaccatttacccagtgttgccaaagctcctgtccctccttccgttgtcctgtcagaagcggctccactgcaggagctacggccaggaccacctcgacactggcctgtttcctgagaagccgaggaatggtgtgctgggggacagcagagacaaggaggccatggccctggatggcacagcctatcaggggagcagctccacctgcatcctccaggagacctccctgtgatgttgactcaggaccccgcctctgtcctcactgtgccaggccatagccagaggccaccctgtagtacagggatgagtcttggtgtgttctgcagggacaggcctggatgatctagctcataccaaaggaccttgttctgagaggttcttgcctgcaggagaagctgtcacatctcaagcatgtgaggcaccgtttttctcgtcgcttgccaatctgttttttaaaggatcaggctcgtagggagcaggatcatgccagaaatagggatggaagtgcatcctctgggaaaaagataatggcttctgattcaacatagccatagtcctttgaagtaagtggctagaaacagcactctggttataattgccccagggcctgattcaggactgactctccaccataaaactggaagctgcttcccctgtagtccccatttcagtaccagttctgccagccacagtgagcccctattattactttcagattgtctgtgacactcaagcccctctcatttttatctgtctacctccattctgaagagggaggttttggtgtccctggtcctctgggaatagaagatccatttgtctttgtgtagagcaagcacgttttccacctcactgtctccatcctccacctctgagatggacacttaagagacggggcaaatgtggatccaagaaaccagggccatgaccaggtccactgtggagcagccatctatctacctgactcctgagccaggctgccgtggtgtcatttctgtcatccgtgctctgtttccttttggagtttcttctccacattatctttgttcctggggaataaaaactaccattggacctagaaaaaa

SEQ ID NO: 280 - DNA, 1465 bp, Homo sapiens
  ref <308>: DATABASE ACCESSION NUMBER: AL110126
  ref <309>: DATABASE ENTRY DATE: 2001-06-18
tgggccctttgaccctgcacaatgacctttgcatcagccaaactcattgccatgacaactctttgtactgtgtccgtgccacagatctgttggtcacattgttaatagtaaaggggacaagttggagacggtcaatttttacattttttgttgcaattttttcttcaatggttgtaagtagttttttttttttttaataataaaggggttcactagttaatactctagaaatatctgtgtgttgcaattcaaatgtatgttgagattgtgaaaagcgcttcagtgccactagcttaccggtacactagactaagcccttgatgacttattgcatgatacagtaccaggaacaacaggtggcctaaatacatgaaaagcagtgtaagctagtgacactaaagccagtcttgtattactgtatttttgacagaatggttttgaaaactgtgctacagggactgatgtggcaaatatatctctttatgcagaaggaagtctttttttttctttttttttttttttaagaagtatggctttttatgcatccttcatcgagggcattggagttgcatggactgataaaagttgatgcaaaacaagaaagaaacaaacaaaaaaaaaaaaaccagcaaaatgtttaccaaaaaactcaaacaaatgagcagtgcctgttcaatttcacagtctctgttgagttcagttgtaaatatgtttcaaatgacattttcttgggaaaaaaaatctctacaacattgtagaatgtgaggggtaactacatcccaggcataggtttctcaaagctgcagtagattatgtcttcatcaagctgttaatttgtgcttatatcatatagaacttttagcatcctgggaagagctgcccccacctcaatgatatttctctgagaacaacttttgtaggactgtgtgtttctttagatacatttagtacaactgtaggtgacgagtagtcagttattgcttgctagctacacaccagggttgatccattttaaaacttttggcattttgtcctcatgggccataaatacagaaccttgtattttaattaaatttttttacaaaaggaggcacatgcacaatctccatgtaacaaacctttagcagtaggatgtattatacgacagttacttaatttctagagttcaggcctctgggatcaaccccagactgggccagaatgttagtgaaggttttattgtgcccggttggaggataacgttctttgggtactttttgtgggttgcaaatgaactcaattgccacaagttttaaactggtgtaaatcaagcttgacttaatgtgattgttactgttatatccagcctatactgctagcagctgctcatactgcagtcaattactggaagcggatatatttcctatgcaaaaactgtttaaacaataaaatgagctatgctacagaaaaaaaaaaaaaaaaaaaa

SEQ ID NO: 281 - DNA, 1345 bp, Homo sapiens
  ref <308>: DATABASE ACCESSION NUMBER: AL110139
  ref <309>: DATABASE ENTRY DATE: 2001-06-18
gggaaaaactgtgcgtgtgtgtgtgtgtgtgcacgtgtgtgcgtgtgcacgtgtgtgatacctataaaacagtttctccttctctgaagggaaaggaaagtgctaggcagcctgtgattagcaacattctttgtgcttttttgttgttcctctgctctgtcacagttctacgttgtttgccttagaaatgtaatttttaaaaaccattttaaaaatgaacggtgatttggctggctggaaaaaatcacactgtcaggggactatatttgaagtcagtctagacggggctggactaggaacccacctggacccaggagaccccacaggacccaggaggtccctgccggaaggcagaggttcaggtgagagtggctcacctctgagctggtgaagtgaggacttgcctgtgacatggcccagggatctgctgctggcttctggagacagggccttgggctgacttctcaggttgattgaggcctcctgactagcggtgttcccaggatagaggtgattggctgcaacaaagatgcttctattagtctattagcagtgccttcgggaccctgggattttgctctctctagaaaggtgttttttatttttttattttttatctcccccttttttcctggctttgctccaaggtttgtgtatttgcctgtttattgtcctgctctttttttttttggatgaaaactccagcctttcctgactcacctccatcttcggttcttcagttttctgagaagagttgggatatgtgggaaggggcatgggagctcggcagcctccgcctgccaggaaggcagtttcgcctctgcaggaaagagcagagcccgtgggaagccctgggtgagggtggcgcagccggcccagcacgcatggtattgccagccacggggggcctgcgtgtagtctctgctccctgcatttcaccttctttgttgactttccttctctgttttcccccatctgtttgccagaggggtgggactggcaacagaacagccgtggctgctttatctctcctctccacggtgtactcaggcctgagtggtgactcacgggagcctggccacctcgcagctgttcgccccctcaacctttgaactggaactgctggctcacacagggttttcgacaactgcagctgaatctcatggaaaagctggattcctctgccttacgcagaaacacccgggctccatctgccaggtgcttgccactggtcctggcagaaatggcggctgctgaaagtgaccttccaaatccttggtggcacttcagcgccacaggctctccaataaaaaccctttacacacaaaaaaaaaaaaaaaaaaaa

SEQ ID NO: 282 - DNA, 1543 bp, Homo sapiens
  ref <308>: DATABASE ACCESSION NUMBER: AL110163
  ref <309>: DATABASE ENTRY DATE: 2001-06-18
agcgtccgtatttatgtaagtctgctaaagttttttagcccacttaaaacttaagacaaccatttaaaataatggatgggttactatgagcaatttcgctttcagaacccccttgttttagtatatgaaaaagcctaatgcgcattaatgaggttgaagagactatgagaaatatgtatagtgtatattttaaaacagctttgcttgtattgtgaagatttaaaaacaaacttgagatttttaacgtaactattaacacagttttaacataagttatcccactgggtttaagagcatcttgaatgtataatcctttttgtaacccaggttggtttctacttttaccagtcacccaaacatatttatgtttttagttttatgtactcatttccctttgttttcctcaaacagcatgatttttttgcacatgtagaaattttttaaaagaaagaaattagtacatcattttctctggattttcttcacttccctcttcctttctactaactccttccttaaaggccatatcactccatttgcattatttgtgcaaatgccagggttggtttttatttttatttttgctatttacctaaaaaaagaaaatgcttcagtcaattgcttttttatttaaaaaaaaaaagaaaaaaagctgtaaccttatcatttctgagtagaccattgagcgatgaatgcacacctgtagtagcccaggaccagctgtggtggctaaagggaatatgttaattaagcaagaggttcttttctaaaagtggtatctgttatccacaatgtattttagttattcccacaagtcaggggtccagataaaatgagggttatcagctaactgatatgctatcattgaggttcatcaatgaatttgtacatttctagttccctttggtgaagggaaaaatgatgattttgcaagacctagattttggcttggtttcttgcctccttttttggcagccttcatcttctcatctcccaaaccccctgagcccgtagggttttcatagtggacaaagaacttgtggtcttttaaaactgggactgatacttttttgagagagtatcgtgtcgaaagtgtgatgttctaccactttaccaataactaattttaaatacacattgtcctctcgatttttggaccaaacagacgctcacagtggaggcttatcaagggttgcattggggaagaagcctctccctctctgtcagcaccagctggtaaaggtgactgtacagatgtgcattttccttttggtataaatggtccacagcactaactggtaaggcttattgtacagtatattgtcagtattcttctggttcagcataccttatagttcatatataacctgtattaattgtatagattgtgcattaaaagctgttaccaagttgtcagaacataagagcgaaaacaaggtcatatgtaatattttgtttgtaagtatcctttgtatcatagcaaaggaaatgtttaaaaaaatcaactgtaataaagtaattttagtaaaaaaaaaaaaaaaaa

SEQ ID NO: 283 - DNA, 2535 bp, Homo sapiens
  ref <308>: DATABASE ACCESSION NUMBER: AL110202
  ref <309>: DATABASE ENTRY DATE: 2001-06-18
accaaggatggaatacagattgatgctgccctatcaattaattttggtttattaatagtttaaaacaatattctctttttgaaaatagtataaacaggccatgcatataatgtacagtgtattacgtaaatatgtaaagattcttcaaggtaacaagggtttgggttttgaaataaacatctggatcttatagaccgttcatacaatggttttagcaagttcatagtaagacaaacaagtcctatctttttttttttggctggggtgggggcattggtcacatatgaccagtaattgaaagacgtcatcactgaaagacagaatgccatctgggcatacaaataagaagtttgtcacagcactcaggattttgggtatcttttgtagctcacataaagaacttcagtgcttttcagagctggatatatcttaattactaatgccacacagaaattatacaatcaaactagatctgaagcataatttaagaaaaacatcaacattttttgtgctttaaactgtagtagttggtctagaaacaaaatactccaagaaaaagaaaattttcaaataaaacccaaaataatagctttgcttagccctgttagggatccattggagcattaaggagcacatatttttattaacttcttttgagctttcaatgttgatgtaatttttgttctctgtgtaatttaggtaaactgcagtgtttaacataataatgttttaaagacttagttgtcagtattaaataatcctggcattatagggaaaaaacctcctagaagttagattatttgctactgtgagaatattgtcaccactggaagttactttagttcatttaattttaattttatattttgtgaatattttaagaactgtagagctgctttcaatatctagaaatttttaattgagtgtaaacacacctaactttaagaaaaagaaccgcttgtatgattttcaaaagaacatttagaattctatagagtcaaaactatagcgtaatgctgtgtttattaagccagggattgtgggacttcccccaggcaactaaacctgcaggatgaaaatgctatattttctttcatgcactgtcgatattactcagatttggggaaatgacatttttatactaaaacaaacaccaaaatattttagaataaattcttagaaagttttgagaggaatttttagagaggacatttcctccttcctgatttggatattccctaaaatccctcctcttactccatgctgaaggagaagtactctcagatgcattatgttaatggagagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctatttttagaataaaattgttctccttctaaaaaaaaaaaaaaaaa

SEQ ID NO: 284 - DNA, 4461 bp, Homo sapiens
  ref <308>: DATABASE ACCESSION NUMBER: AL110212
  ref <309>: DATABASE ENTRY DATE: 2001-06-18
gggcttcatgtataatatcttaatatgtatctaaaagatagcttttttatgttttattttatttttattttttcagacaaagtattactctgtcgcccaggctggcatgcagtggcacaatctcagctcactgcaacctccacctcccaggttcaagtgattcttctgcctcagcctcctgagtagctggcattacaggtgcctgccaccatgcctggctaatgtttgtttgttcttttgtttttgtttctgagacaggatctcactctgttgcctaggctggagtccaatagcctaatcttggctcactgcaacctcagcctcccaggcaactgggactacaggcatgcgccaccatgcccagctaatctgtgtgtgttttttgtttgtttgtttatttgtgtagtagagatggggtttcaccatgttggccaggctggtctcaaactcctgacctcaagtgatccacccgcctcagcctcccaaagtgctgggattacaggcatgagccactgtgcctggcgtagaaagtatttcttataattaaaaacgacacccagtctaactagtataacacctaaaaaattgtcagatctgtattttagatagtacgacacagtgaaatgcaatggcacttaagcagagagaagaaggatttttctttttctttttttaaatagaaggtgttagaacctgaactgggcctggtttgcatttgggaagagtccagtggggaaacaacacaaataaggtcttgagaatgaagaattgcatttatatagggagttgtaacaaatggcctggagagtatctgactctttatgaaacatttaatgagaaatgtgacttgctttggtgcctatggttgaatttgttgcgatgcttctgacattatgaaaattttcaaacatgcaaaaaagttccagtagttatccagtgaattcttatactcaccacctatatctatagttaacattttacttgtattttatccagttatcagctcatctatgagatggcccttatttatttgcctgctgtttttattctctatttgtcctgttatttcttgttagagaagagaaggtgttcttagatcagaagatgccattgtattaggtgacggcaaggttttgctgatttagtggaacaagattctactgggatgtgtgctgagctgaaccaaggaactgcccgaacgtgctgaacaaggacatttgcttctcagatacgtgaattcaattttaagcaagattcttgatctgcttcagagcagctttgatttaaagtaatttcagagcacttttccttgcatgagtaattttctgaatgtataaaatattctatttatgtttgaccttttggataaactgtgttgctgcagtgttggtccacactaccatcctaagtgaagacttagtaagtctgaggatctccaggcactggaaagagtgagaacctgggagtgaaagggttatagttagtgttcatttttcgggttttgtttcatagggagtcctgagtggggtaacctgaaatgttttaacagttgaagatcatcccattcctatccccagtaaaaataggcctttccacaatcttctaccagttaacttagctttttttttttttttccttaatagagtctcattcttgtcacccagactggagtgcgatggcacgatcttggctcactgcaaccctccctcccgggttccagcgattctcctgcctcagcctcccgggtggctgggattgcaggcgcacgccaccatgcccagctaatttttgtatttttagtagacgtggggtttcaccatgttggccagactggtctcaagctcctgacctcgggcgatccgcccgtctaggccttccaaagtgctgggattactggcaggaaccaccaggcccagccaaccagcatttcttaaggtgaaaatacatggtgttaatttatattttgagtgagacccagtccagctgctataactgcttggacacttggcagaggacagagtactgcaaaagtgtctaagggagacagcattttgccttgggtgctgtagatgtacaagagaggttccaggagggggtgatgggcagaattttggtccccatcaccttccctgcccagtgttatgcctatgaatgtgttacattatgtggtaaaagggactttgcagatgtaactaaaatttctaaaatagagatattatcctggattacctgggggaacccagtgtaattacatgaacccttaaaaatggaagaggatgcaggagtcagattcaaaggaaggcccaaggtgctattgctgacttgaagatagaggggccatgtggaaatcaagagaaggaagtgaatccttccagtgagcttggaagagagcaccttgaggcacagatgagaagcttggccttacctgatgccttgattttagcctggtgagaccccgagcatataaatttgctgtgctatgccacacttctcacctacagaaacttagtttaaagccactaagtttgtggtaatttgttggctttaggcccctgagggtagagatttatggcttgtgttacaagtagagagcagtggagagttgggctttgtaattctttcaagggtgattgtagttctggagtcctatctacctgggttcagatctttgttggccagtccctggctgtgtgactccactgctttaagcctctgtcttcatccttaaagtggcgatgatagtacgtacctcactctgatctctgaatgagaacacatgtaagacacttagcacagttcctggtgctcaaagagttccaacacctgaaagcaccatggccctgtttgcttttcagtcaagatttctaaaagccgttattaccagaggttcagtgagaacatgggcagggtaaactcaaaatggagaacataaaaactgggactcccagaccagtcacttagaagactgctgcaggaagtaccaaggtcgttaagaatcagtaataataataagtaatgtgtgaatccattagaatgttgagaagtagacctttgacatttcagaaaaatgtatatctcagacacagccatatgtattgttatccctgagttggaagagcatcacagggcatagtttcacaaaagcttcaaaaaatatactaattgctggtaatatgtgaactaacagaaaaaaatagccatgttaaaataggagtgcctgacaattagctctattcatcttgtctcctagctgtaagcaccctagattcaaattatgcacctagaaaactaaattactatgtatgttataggcctttgaaatggatacatgaaaattagtgaaatcagaatgaacgtttcgcctgccaaagatatgtatttttataagtgatacaagggccccatgagctccatggccacatctgtacaaaacaggccctcctttcaggaactggtctcgagagagcaaaggggtcaactccctaaatggcagctgagacagtcctccctggtggcatggccctgtttcctgttgatatggtgatagttggagagtcaaatttttaccagaatttgtgaatatcatctctggttaatgattacacaaaaccttttaaaattttaaaaaattatttctagttctataaataaactctgcagttgtacagccactgtacagctaacatctcaacactggaaatgaggctggtttcttccagtttggctcagattcttcagggaagcccagttaagacaaacagctctctatactcaatccttactttgctgagaagatacaggcctgcccactcgctcccacctgctcttcatgaggagtcctttattcctgcatgtttcctgttctttgggacctttaggagctaacctccacagatgctgatagtctgtagagtcaggaataccatgtaacatgttgaagtagactaaagattagttctttggcaatagcccagtctggacttactatgtacttttgaaaataaaactgcttatttgtaaactctgtaattaggaccttttgctatttgagttatattcctttctaacttcaaacgtctgcattcatgtataatagccattttatgcacagatgaggtgattcccacacttcttttcgcagatgtttcattatctggatgagtgtattacataataaatttgaataatggtagtcttccaaacgacaaaaagcaagctagttgatttgtcaattttgagtttaaatgttttgactgcttatcagcaaaaaaaatcaaagaatagcatactaatattaatggaaatgcagagtatatttaattggcatgattttttcacggatgtgtgcttcatttgatctattgtatgtagctcgtgatcacattttctgttggttaacattgttcctagcttatatgatggaattaaatatattctgtgcaaaaaaaaaaaaaaaaaaaa

SEQ ID NO: 285 - DNA, 932 bp, Homo sapiens
  ref <308>: DATABASE ACCESSION NUMBER: AL110260
  ref <309>: DATABASE ENTRY DATE: 2001-06-18
ccacgctccgagcaatccaggagtggctgaaggagggcccaccccctgccagccctgcccagctgctctccaagttgtctgttctgctcctggagaagatgggaggctcatctggggcgctctatggcctgttcctgactgcggctgcacagcccctgaaggccaagaccagcctcccagcctggtctgctgccatggatgccggcctggaagccatgcagaagtatggcaaggctgctccaggggacaggactatgctggattctctgtgggcagcggggcaggagctccaagcctggaagagcccaggagctgatctgttacaagtcctgaccaaagcagtcaagagtgccgaagctgcagccgaggccaccaagaatatggaagctggagccggaagagccagttatatcagctcagcacggctggagcagccagaccccggggcggtggcagctgctgccatcctccgggccatcttggaggtcttgcagagctagggtgtgtgactgcctcccttggcctcagctcctctcactgctgtgctgaggtggcctttgtcacttccttctgccttccaaccctcaccttcccccggcctggccccattggcccaccctctaagttgagcaggaaatcctccaccaagcttccagaactacagacagcacccagagtgagctggagtgggtccccatgcctctccagcatgccctttccctttgcaggagggtggagtccctgggtcatgccctcccctgccagctctgggcttcagagataaggcattttccttgtgcagcctttacctggcaatcctaatttggttttaagactccctgtgaaatgctttccgcaccttaaccccagtgagcgtgaaaaagaaagttaataaactataatacatggaagcaaaaaaaaaaaaaaaaagg

SEQ ID NO: 286 - DNA, 2893 bp, Homo sapiens
  ref <308>: DATABASE ACCESSION NUMBER: AL117441
  ref <309>: DATABASE ENTRY DATE: 2001-06-18
gtggataagagctgtcctagaggcatcatcagagtagaggagagtttcaggagtggagctaaaccccctctgagagccagagatttcatggccactaaccctgagcatttagaaatcctgaagaagatgggggtgagtttgattcacctcaaagatgggagagtccagttggtccaacatgcaatccaagctgctagttcaattgacgctgaagatgggttgaggttcatgcaggagatgattgaattgtcaagtcagcaacaaaaagaacagcagctgcctccacgagctgtacaaattgtttcccacccattttttggcagggtagtattgactgctggaccagctcagtttgggctggatctgtctaaacataaagagacaagaggatttgttgcaagcagtaaaccatccaatggttgttcagagcttactaacccagaggcagtgatgggaaaaatcgcactgatacaaagaggacagtgcatgtttgcagaaaaggcacgcaatatccagaatgctggagccattggtggcattgttattgatgacaatgaggggagcagcagtgatactgcccctctgttccagatggcaggtgatggaaaggatacagatgacatcaagatccccatgctgttcttattcagcaaagaaggaagtatcatactggatgccatccgggaatatgaggaggtagaagtgctcctctctgataaagcaaaagatcgagatcctgaaatggaaaatgaagaacagccatcctctgaaaatgattctcagaatcagagtggtgaacagagttcatcaagttctcaggaggttgatttggttgatcaagagtcttctgaggaaaattctctaaattctcacccagaatcattatctctagcagatatggacaatgctgcaagcatttccccttctgaacagacttctaatcccacagaaaaccatgagactacaaatcttaatggtgaatgtacagatttagataaccagcttcaagaacaatcagaaactgaggaagattccaatcctaatgttagctggggtaaaaaggtccagcctatagactccatattagcagactggaatgaagatatagaagcatttgaaatgatggagaaggatgagctatgacttgctaaacaatctgttggtgaagccagtgtactttctcagtgagttctctgcataaagactaatcagtgggaccaggtaaaaaggactggggcttggagaaaatgagcagatgttcctctaagacatcgattacagaagccttatatacatggatttgattttgtatttgtagctgaaagtcactgttgtctaaaactaacttttctaagttatcaaaacaacctaatttcttttccaacaaggagaacttaatggcatgaaggattgtgtgacacattggaaaagccagcttactgccactctcttcctttggccattagagggaggtgttgcctttcattgacgcttagaagcaaattgttcacttgttaagaaaagtaaatccttaaaaaaagaaaaggaaaaaatttaaccaatttttcttaatacccagaaggaattatactcaatatttccctagttaagaaaagaggagataatgttcgtctaaaaaactccaacgttgtaattacaactctacattcatttacttacttgacatactgccacaaagtagtttttgagttcattaaaaattccaaaggcattagttgtttttttttttttttagtgttttgttttttagttaacttttatagacattttagtaacttgctaaagattcaggggattctatgaaaccccgaatttagaaacatctggtctacctcagttaaatgttgactgcttagaaatatagctgaagtgatcaccacagccataaaattgtttaagaaagatttatataatgtttacaaatctggaatcaaggattttagctgaaatcctttaagagatattagagcaagtatttaattcaggtattttcaagttttaaaacttaacctgtttacctactaaaaataaaatagctagtttttttctgcatataaaagttcattgaaatgatatgcccttatttgcaatacttttcccataaagttttaagtgtgaaagaattgtaatttactagatatgtttggtatgggatattttgttaggcaagttttcttttttcttcttaaattgcaataggcttccaaaaagagtataattgtttcagaacaaattaactcttggcattatacgtctccctttttctttacagtattagtaaaatgaaaaattgtacactttctgattttaacttcactaatgtaattactctctcaagaagcttttaaaatttaaattaccatcacacaacctttttatagtaaagccaacatttgttctctcaccaaaccccatgccaaattcatcatgaagaaagctcagcataagtaattcaaatactgcttataattttagaggggggtagaatttagtaaatattccagccggtcgttttatgcacaaggcttcagtcagaacatagaaaaaaaaacattctgtgaatgaaatattgtatgttcagattttataaaagacatttttaaaagcccaatttacagccgtatattttcttatgatgtaatttatgaaaaagatgtctgtactaacaggtgctgtaacactactgttgttggattttattgtttggtgataaatgtatacaatatttctaagggaaactatgtactgtgatgtaaaagtctgggcaaaatgtatataatcctgtatataattatgtatttgattataattactgattgtaaagatttaataaaatatgtaaatattccaaaaaaaaaaaaaaaaaaaaaaa

SEQ ID NO: 287 - DNA, 3164 bp, Homo sapiens
  ref <308>: DATABASE ACCESSION NUMBER: AL117452
  ref <309>: DATABASE ENTRY DATE: 2001-06-18
gcagccccggcggccgaacgcccgcggcgcgggactccatcgtcagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcaggtgtcaacctagatggaaagaagattttggtagtgggggcccatgggtctttggaagctgctctacaatgcctgttccagagaaaagggtccatgacaatgagcatccagtggaaaacacgccagcttcaaagcaagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggatcacacccacccctcttggagaagggaagagcacagtcaccatcgggcttgtgcaggctctgaccgcacacctgaatgtcaactcctttgcctgcttgaggcagccttcccaaggaccgacgtttggagtgaaaggaggagccgcgggtggtggatatgcccaggtcatccccatggaggagttcaaccttcacttgactggagacatccacgccatcaccgctgccaataacttgctggctgccgccatcgacacgaggattcttcatgaaaacacgcaaacagataaggctctgtataatcggctggttcctttagtgaatggtgtcagagaattttcagaaattcagcttgctcggctaaaaaaactgggaataaataagactgatccgagcacactgacagaagaggaagtgagtaaatttgcccgtctcgacatcgacccatctaccatcacgtggcagagagtattggatacaaatgaccgatttctacgaaaaataaccatcgggcagggaaacacagagaagggccattaccggcaggcgcagtttgacatcgcagtggccagcgagatcatggcggtgctggccctgacggacagcctcgcagacatgaaggcacggctgggaaggatggtggtggccagtgacaaaagcgggcagcctgtgacagcagatgatttgggggtgacaggtgctttgacagttttgatgaaagatgcaataaaaccaaacctgatgcagaccctggaagggacacctgtgttcgtgcatgcgggcccttttgctaacattgctcacggcaactcttcagtgttggctgataaaattgccctgaaactggttggtgaagaaggatttgtagtgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagtgtaacggctggtgttcctcttaagaaagaatatacagaggagaacatccagctggtggcagacggctgctgtaacctccagaagcaaattcagatcactcagctctttggggttcccgttgtggtggctctgaatgtcttcaagaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggttccaattgtggacaagataaggaccattgctcaggctgtctatggagccaaagatattgaactctctcctgaggcacaagccaaaatagatcgttacactcaacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacgatgagcaccatgccaggactgcccacccggccctgcttttatgacatagatcttgataccgaaacagaacaagttaaaggcttgttctaagtggacaaggctctcacaggacccgatgcagactcctgaaacagactactctttgcctttttgctgcagttggagaagaaactgaatttgaaaaatgtctgttatgcaatgctggagacgtggtgaaataggccaaagatttcttcttcgttcaagatgaattctgttcacagtggagtatggtgttcggcaaaaggacctccaccaagactgaaagaaactaatttatttctgtttctgtggagtttccattatttctactgcttacactttagaatgtttattttatggggactaagggattaggagtgtgaactaaaaggtaacattttccactctcaagttttctactttgtctttgaactgaaaataaacatggatctagaaaaccaaaaaaaaaaaaaaaaa

SEQ ID NO: 288 - DNA, 3682 bp, Homo sapiens
  ref <308>: DATABASE ACCESSION NUMBER: AL117477
  ref <309>: DATABASE ENTRY DATE: 2001-06-18
cggggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcggaaaggcggcgcgctgaagaagggcgccatcgccaggacgctgcaggccgtgaagatggtgctgtcctaccagcccgaggagctcgagtgggactcgccccatcgcaccaaccagcagcaatgctactgctactgcggcgggcccggagaatggtacctgcggatgctgcaatgttaccggtgcaggcagtggttccacgaggcctgcacccagtgcctcaatgagcccatgatgtttggagaccggttttacctgttcttctgctccgtgtgtaaccagggcccagagtacatcgagaggctgcccctgcgatgggtggatgtggttcacctggccctctataatctgggggtacagagcaagaagaagtactttgactttgaggagattctggcctttgtcaaccaccactgggagctcctgcagcttggcaagctcaccagcaccccagtgacagatcgaggaccacatctcctcaacgctctgaacagttataaaagccggttcctctgcggcaaggagatcaagaagaagaagtgcatcttccgcctgcgcatccgcgtcccacccaacccgccagggaagctgctgcctgacaaaggactgctgccaaatgagaacagcgcctcctctgagctgcgtaagagaggaaagagcaagcctggtttgttgcctcacgaattccagcagcagaaaaggcgagtttatagaagaaaaagatcaaagtttttgctggaagatgctattcccagtagtgacttcacctcagcctggagcaccaaccaccacctggctagcatatttgacttcacgctggatgaaattcaaagtttaaaaagtgccagctcaggccagaccttcttctcagatgtcgactccaccgacgctgccagcacctctggctctgcctccaccagcctctcctatgactccagatggacagtgggcagccgaaagaggaagctggcagccaaggcatacatgcccctgcgggcaaagcggtgggcagctgagctggatggacgctgcccctcggacagcagtgcagagggggcttcagtccccgagcggccagacgaaggcattgacagccacacatttgagagcatcagtgaagatgactcatccctgtcccacctcaagtcatctatcaccaactactttggtgcagctgggcggttggcctgtggggagaagtaccaggtgttggctcggagggtcacacctgagggcaaggttcagtacctggtggagtgggaagggaccaccccttactgactagcccccgggggtgccaggggtcctgaaaaccaaaggaggagcagcagaagccataggctccccagctttctccaggctggggtgggagaaggaagcaggacagagctgcaagtgcctggcagaatgccctgcctgcctgcctgcctgccaggccaaggcctgcgtctctctgctgtaccagctctgttccagggcctcctcaggctcgttacccctgtgcctgtgtctctacacactccacaccccctcaaactctgtttatctgttctctgaccttgtgtcccctgcgctgggacccttcctcctgaggcccaggtctttgtccccagttgtgtgccttgacctctctcgcccctttctgggtgtgttcgcacatcctgtgtgtgcacagctgtccctccactggatccccttcacacgtgacccgtggggcagccagtcctcccagggactacataacaggcacctttgagagagcatgggagaaggtggataagaggatgctgctcagtgcttttctcttccactttcctgccactccccactaccctcggagagaggtggtgggatgggagagagcccctgtgaaagcctgtgaggatctgaagagtaaagggctgggtctgcctcagaaggcaccagcaccagggcccaggtattaaggctgagagtgaaggctgccaatgtcagctttggaggtcccagaagtcttctgttctctggcctcaccccctcagtcgccatagagctgggcctggccttgctggaatggaggcatccttccaaacctgggggacgggggtggggggtggtagtggtgggagggaaaccatgtcttgctaaacctgtttctggtgcctcccatccccagacccaccagacaccacacagcagacaatacacacccactcgcacaagcttccatccacatgtgttgtactttcagctctaggcatgcagacaaccccacacggccacaccaccacatgcccaagtgtacacacacagagccacaccgtccctctgggcctgctggctcctcccttggctttcccttggcccacttccagggcccaggtgctgcaactaaatgtgaaagctcagtggccgctccttctttcagcccatcaaccagcattggtcccatagggaagcacaggggactcaccctctttcatatcccttgccctgccctgaaatggacaatcactttttgggataggttgaaatttttaaagagcctgcatcattcggttccctcaaagggaagcccttgctagtgggggtttgaaagagaatttttggaaccaacattcaaattctgcctcatctggagggaaaccaaaattgggagggggaagaggacccctgatgttttgctgcttccagagatattagaaactgactcacttgattggaaaatggacaaaagtgccttgacgtggagggtgggcaccagatggggaccagccttgccaactgctgctgtggcctccagcttggctggttttgcaggccgccagcaggaaggcgaaggtggtagtacagcaagaggcactggcggggcagcaggcctgcaggagctgtttttccattgctaggcctgacccctctctacctgtgagcgttcagggggtccctgagatagtttagatgccccccccatcttagacctcagctcccacagtgccttttaagggggacctcacctcctgtgcacagcccacccactttcctctgcttccctggcacagcccaggcatagacgagctggcgttggacccagttcttcccccttttcagccccacagctgctgccacaggggccaactagggccaggtggaaggggagctgagaagccaacccctagcccaggggtgctgtgggaactgggatccaatttgtagcttcccgcctggcttcagagagcccagcaaccttctaggcctgctttccagacttctgagatagcctgggatgagcaatcctgttacagtacatctggaccttccctacctgggctctggggaggctgtgggcctggagagggaaaaggagggagggggtgtctgcaccacctgggaagatagcacaaggcctaatgaggtcaccctgactccccaccccagcatttcattcataccagataatagctgcattactgccaactgaccttataaccctctgcaccttcaaaaagattcatggtttttaattgctgcttttaataacatttgtaaagttaaaaaaaaaa

SEQ ID NO: 289 - DNA, 2164 bp, Homo sapiens
  ref <308>: DATABASE ACCESSION NUMBER: AL117502
  ref <309>: DATABASE ENTRY DATE: 2001-06-18
cctttgaagaggagacacagtgctcaccttaattgcgctggtagcagcttatatcccatgtatcattttcaccattgattggaagctgccttgggaattcagtaccaggcattacccctctgggtgggagagggagaagtgtaaagttggagtgggctggaatcaggtgtggcccgcccagtgtcctctgcagagtggtgaagtagtctggccctcttgggagccctgagtccaggaaaatatgtctgatggagtcaatctagggcttgtttcgaaaaagttcagttactctgtgcagctaaatgctttaggaggaaaggtaggcttaggttgcttttcctctgagggttgattgaaatttcttcagtgaggaatagagaaagggcaggaccctcatcatcacacagctggtgtttcaggctgtgaccaatgcagggtgggatttcctaactgtggatgaggggatgaggtgtctctgagggatgaggtgtctcagagaattgagtccatggggcagtcagaatagccttaagagaaaatcatgaaggagaagaggtcctcctttagctgcctctacttggtatcttagagagggcttagagggctctcagtcttctgcccatgaaaagacttctttgagcctctgccttcatggctcttagggttctgatcttgatatcagcagccccaaccactttctttctgaatgtctagtcagtatttttccccttttggtgttttatgaagccatgtggtaacgaatgaatctgtatcatttttcctacctgagtggcccaaagccagcaccaaaccctgggagtccctgaagcctaacagaacaggtagaacttgcaaaaggaatttggctgagagctcacttctaatcctgtactcactgtgtctttgtagatagaaacaagctagctttaccaaagagaaatagtgtcatagaagaacaaaacttcatatagaaagttctaggcaagtatttgatggtttccttaaggatgtgagctttgtatttccacctagccttgtaaaatgttcctgtggtattttgtgtcacacatcctacctttgatgagtctcacatcccaccttcctataaacagctaaattaattttgtttcatcttccccagaccaaaatgtttgataatcttatcaacattgtgggaggtcttgtgcaatggaaattttgccatttctccaaaactggtggcataaaggctgatgcttggggagaaccccattgctcgggacaggcaactctgttcaatgggatcttctttggtttgatgttcccattgttttctcagttctgggaagcctagtacattagtactaatgtaatcactgaaaccttttcttgaaataagggaagcagccaaactttgattaaacttgcaagttctggggacttgcgggggttgtcataaactgtaacagtgggttttggttcagcatgtaaatgcaactttgattttcttgaggaccgattgacctgtcatgtccctgtatcctcatgctcatcatctcagcaggcctgagaggctgggtcagtttgggtgttcatcatgaggattgcttctgccatggagctgatggacgtgggcaggttgctgagaaggtggggtgaaagtgagtgccgggggtgggtgagtgccctggtcttgttcataggggagcctttccctagcagtggaacgctgtggtcattttctctagcatattcccttgggaagtctagatttgctattaatctggctgagaatctaagttctgtgccttagagacagtttgcactttcccatattgtgcctgggacagccatatgattttttttcccaccaaacaagtatgcaaacagaaaccagttcaaagggggatggagtaaaagatgaggcagtagaaatgcctttgaatggttttctgtagctaattctctttaaattttgtcctgctttttttctttatgcagtgctaggtgttttaagttttctagtagtattgcttttgagttacagtataacctgagttactcctctgctctaacattgttgcagaagaactagtttattgttagccaggttgcttgaaaggttgagagtggagtggtttggcatttctgttttaaataaacatttaagctcttaaaaaaaaaa

SEQ ID NO: 290 - DNA, 803 bp, Homo sapiens
  ref <308>: DATABASE ACCESSION NUMBER: AL117523
  ref <309>: DATABASE ENTRY DATE: 2001-06-18
ccgacggctggctctgtgggcggtggcatgggcagacggaacccgcgccagtaccagatcccctctgaacgtcccttccgcccgcctgggcctcttgggcaccagtggattcgtcagctccaaccagcgcaacaccacagctacccccaccatcatgaaacaaggaagacagaacctgtggtttgccaaccccgggggcagcaatagcatgccaagccgcacccacagctcagtccagaggacccgctcgctgcccgtgcacacttccccacagaacatgctgatgttccagcagccaggttcccaagttcacagtggactgtgtttaacagaccttagaggttggttgagcctgagtggagccccttccatgccagcgctgacagtccccaagtcctcccagggaggtacaccagacctttctcctgaaggtggaaccaggtggcaccctgcttatctcctccttgtcaccaacataaccctttatcgcctgcagaattccagcttcccgtgaccgaacctgacatcaacaacaggctggagtcgttgtgcctcagtatgaccgaacacgccctgggagacggggttgaccggacctccaccatctagaagctgaagacgagagtgaccgcgctggccgtgaaatcgactgctgcgggtccagtgtccgccatcttcagggttgcacagaatcctccaagatactttgcagccttttttccccctggtccctctcccgttttgattttgtgagagcgtaggtcatcctcgtaaacatatcagtagacctgggaaaaaaaaaa

SEQ ID NO: 291 - DNA, 1444 bp, Homo sapiens
  ref <308>: DATABASE ACCESSION NUMBER: AL117595
  ref <309>: DATABASE ENTRY DATE: 2001-06-18
gtttctcttatttatgccttgaggactaatttctggttttctagctgttaatgcactgttgaccttcataatggtgccttacgcaagcgatcccttctgtgggggtctcatacaggggtgtgggcgatgcatgctttattaaggctcttgtttcacctggcagtgtactgtatcaacgtataatacagaaaaaaaatctctttaaggtcctccttcacaaagacatagagtgaaactccctttacatgtcagtatttgttcaacactttaggcaacttgactgtcagtgttaaaatggaaaacaggaaaatggaaaaatctgaccaattctgccaccctgagactttcatatagaccttgcacaacaattgtatagatcacacaccggctgtatttaatatgtaacattttcacacatattaaagatacagaagtattaaaaaacccccaatgttaatgtatttgcttaaaaggcacaagtttcacatatctgtctagctatctgttggtaatacagaaagtatactacttttttaaaaaagtgggcagaattcttgtgtatgtatatttgtgtgtacagtatgtgtatgtgtgtatatatatatattatatatatagataatatataaatattttttttaaggagaaactagaacgtttagctagaaaattccacagcctgtgaagaaatatttcaaaatggccataaaggaggtaaaaatgaaaaaccataacctaacttttatagaggctttatctttaatttaacgatgtgcggaggactttcttgcttgaatctgttccgggctgtctgctctgtccatcaaatgggcaggtctggaatgaggcaccttcggccgttcagaagtggcctgaacagaatgctggaacccaggctggactcggacacactaaggttttgattttgaatttcagccttattagaagatctaacctaagagtaagctaaccacagggattcttttgtagaacactttttatgcagatgaagctattttttccagcaagtagattcttccagtttttccaaggagtaatttccccgaattggcataccacggcgtggacagctgatatttcacccagctgctggcttgtgggtgtggctctttgctttatatatatatacacacatgtgagtctggctgggctggtattttgtttgatcttcctggaaatgagcagtgactaacgctcacataactggtttttttttcttatctgggctgatgaatacatttacctaagaaactcatttcgttttacttaagaggggaagtgcagttttcttttggcagttcagaatccaagcacttgatttgctgggtttggaaaactccttttttggccttctatgtgcttagccataacaattccattaagcaagaaggtaagcaaaagacaaaaaaaaaaaaaaaaaaaa

SEQ ID NO: 292 - DNA, 1984 bp, Homo sapiens
  ref <308>: DATABASE ACCESSION NUMBER: AL117599
  ref <309>: DATABASE ENTRY DATE: 2001-06-18
tatggattaaaatttataaaatacagatcagttaatattgcacttaagtaattttacctttttaatgtgatttttatagaataattcagacttacaaatacagagatatgaacaaagtttacagtgggaacaaaggtttaaaaaaaggttgtggttctctctctgtgatccagtgtgcacataaacctttctctgatctttcactgccatcctctggattatgtcttctgacctgtccattttgacccattaactggaaagttggaaaactacattaactggaaagttgaaaaactacattactttggagaataaaaccgaaagttcgtgtataccttcttaaaaaaaaaatcaaaccaaaaatgtgaaaacaatagaactgcaaagatagcagttaaaattttaatctgaaaataacctttgaatctcgggctaggttacgtccatatttgaagtggtcagtgatggtttgaacattttttgcaggatgagttaaaatgcactggattatatttgggatttttgtttttggaattgtctgttttaatcacagccttaattcacaattggcaaaggcagtttactcaaaggactgggctaaatattctgtaattattcatttttgataggaaaatgaaatttttgcaaacagacattttcttttttttggctggagtgcagtggggcatggtcttggctcactgcagcgttgaccacctgggctcaagtgatactcccgcctcagccacccaagtagctggcactacgggcacacgccaccatgcccagctaatttttttgtatttttagtagagatggggttttgccatgctgcccaggctggtctcaactcctcagctcaagcaatctgcctgcgtgagcctcccaaagtggtggaattacaggcgtgggccactgcgcctggcccagacagacattttctgaaacacaactggcaatgagctgtttttacattttgaaagtgattcttcacttcctagttcttaattatagtatacctattaagatctgtaagatcctgaagacataagatcatgaagccatataagaatgaggattgaaagttgagcaaaattttcgggattttgggaaacattcttagctgtgctatctgcctaaaattattccttattacttctctcctttgacagacttcaagttttcttcatagccctttcaaagttttttgagccatccagagtaaaatcatttctaaatgatagttctgtatatctccaactcgtcttaagtgtatttgcctgtgtgcaacgtattgctagactatgaactcctcagcatggctgctggataacttaattgtcctgagttaatagccttcaaaggacaaatcggtttctttgcagatagcttcgtaaaacttcacatggagtttattttatcatatttcccttttttatttctgctcctcctttaattgcccatcttgcttcagagactgacatttcagggtggatattaattaaagcattaattttgttttttggtatattcctatccctagtatttctatcttactgctaaaatacaggaaaagtgccgtatttttaatgcatttagtggttttctttggtgttatctgttccatttttctttttcatacattgaagtgtgtctccttttcaaccaaaataatgaaatagtggagaccatgaaattgttgtgcctggctaattggcaaattaatttaccaatataataagtgtagcgccttgtttgaataccctttttgagaaggtatgatgagaatgggcaagggtgtcagcatctcttcttcttaataattaattgttttcagttttggttcacgaagaatgcttagttaatctgtaatgttgcctagagctgtatttatctgtttttatttatactagtgtagtaaagctgcatatcattacagtaaaaaaaaaaaaaaaaaaaaaaaaagaaaaaaaaaaaaaaaaaa

SEQ ID NO: 293 - DNA, 1848 bp, Homo sapiens
  ref <308>: DATABASE ACCESSION NUMBER: AL117600
  ref <309>: DATABASE ENTRY DATE: 2001-06-18
gctctgcacccctgctgcttctgctttgaaggcggaggctccatgttgtcccctcagcgagtggcagcagctgcctcaagaggagcagatgatgccatggagagcagcaagcctggtccagtgcaggttgttttggttcagaaagatcaacattcctttgagctagatgagaaagccttggccagcatcctcttgcaggaccacatccgagatcttgatgtggtggtggtttcagtggctggtgccttccgaaagggcaagtccttcattctggattttatgctacgatacttatattctcagaaggaaagtggccattcaaattggttgggtgacccagaagaaccgttaacaggattttcctggagagggggatctgatccagaaaccactgggattcaaatctggagtgaagttttcactgtggagaagccaggtgggaagaaggttgcagttgttctgatggatacccagggggcatttgacagccagtcaactgtgaaagactgtgctgccatctttgctctaagcactatgactagttctgttcagatttataatttatctcagaacattcaagaagatgatcttcaacagctgcagctcttcacagaatacggtcgtctggcaatggatgaaattttccgaaagcctttccagacactgatgtttttggttagagataggagtttcccttatgaatatagctatggactccaaggaggaatggcatttttggataagcgtttacaggtgaaggaacatcaacatgaagaaattcagaatgttcgaaatcacattcactcatgtttctccgatgtcacctgctttctcttaccacatccaggactccaggtggccacaagccctgactttgatgggaaattaaaagatattgctggtgaattcaaagagcagttacaggcactgataccgtatgtattaaacccatctaagttaatggaaaaggagatcaatggctcaaaggtcacctgtcggggactactggagtattttaaggcatatattaaaatttatcaaggagaagatctgcctcaccccaagtccatgcttcaggccactgctgaagcctacaacttagcagctgcagcctctgccaaggacatttattataacaacatggaagaggtttgtgggggagagaaaccttatttgtctccagacattctagaggagaagcactgcgaattcaaacaacttgctctggaccattttaagaagaccaagaagatgggtgggaaggatttcagctttcgttaccagcaggagctggaggaggaaatcaaggaattatatgagaacttctgcaagcacaatggtagcaagaacgtcttcagcaccttccgaacccctgcagtgctgttcacgggcattgtagctttgtacatagcctcaggcctcactggcttcataggtcttgaggttgtagcccagttgttcaactgtatggttggactactgttaatagcactcctcacctggggctacatcaggtattctggtcaatatcgtgagctgggcggagctattgattttggtgccgcatatgtgttggagcaggcttcttctcatatcggtaattccactcaggccactgtgagggatgcagttgttggaagaccatccatggataaaaaagctcaatagcatcttaacgtgaagatcaaacaagaacacaacaagcccctactgatttctgggtttctgccacggccacaggttcatatccagaggaatggcagatctgagacgatccaggaagagctaaaacatggccctgtaataaatgagcagacctctataaaagaaaaaaaaaaaaaaaaaaaa

SEQ ID NO: 294 - DNA, 2544 bp, Homo sapiens
  ref <308>: DATABASE ACCESSION NUMBER: AL117609
  ref <309>: DATABASE ENTRY DATE: 2001-06-18
ggtggcggtgggcggaactcctagcggacacctcgtggagtccggccggaagagcaaccgagatgaaggtgaagatgctgagccggaatccggacaattatgtccgcgaaaccaagttggacttacagagaggttggtgatgacaaaactgtgaagcagtggaaaatggatgggccaggctatggagacgaggaagagccattacatacaatattaggaaagacagtgtatactgggattgatcatcactggaaagaagctgtttttgccacatgtggacagcaagtagacatttgggatgaacaaagaactaatcctatatgttcaatgacctggggatttgacagtataagtagtgttaaatttaacccaattgagacatttctcttgggaagttgtgcatctgacaggaatatagtactgtacgatatgaggcaagctactcctttgaaaaaggttatcttagatatgagaacaaatacaatctgttggaaccctatggaagctttcatttttacagcagcaaatgaagataataacttatatacttttgatatgcgtgcactggacactcctgtaatggtccatatggatcatgtatctgcagtgcttgatgtggattactctcccactgggaaggagtttgtgtctgctagtttcggtaaatctattcgaatctttcctgtagacaaaagtcgaagcagggaggtatatcatacaaagagaatgcaacatgttatctgtgtaaaatggacttctgacagcaagtatattatgtgctgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaatccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaaggcgtggcaagccaacgttaagctgttgagtcgttttaagtgtaattcggggcagaattggtaaagagagtcgtgtaaaatatcgagttcgcacattttgttgtctgattattgatttttggcgaaaccatttgatcatatgacaagatgtgtatctaccttaacttaatgattttgataaaaatcattaggggattcatcagtattatgtgtggatctgatgaaatgaacattcgcctgtggaaagctaatgcttctgaaaaattgggtgtgcttacatcacgagaaaaagcagccaaggattataaccagaaattgaaggagaaatttcagcattatcctcatataaaacgtatagctcgtcatcgacatctaccaaaatctatctatagccagattcaggaacagcgcatcatgaaagaagctcgtcgacgaaaggaagtgaatcgtattaaacacagcaagcctggatctgtgccacttgtgtcagagaagaagaaacacgtagtggcagttgtaaaataattggtattcctaacaatcctgatgtataattatttgttacttttgatttgagaactctacaaataaaagtgctgggactagattaattgcaaacaaaaaaaaaaaaaaaaaaaa

SEQ ID NO: 295 - DNA, 1347 bp, Homo sapiens
  ref <308>: DATABASE ACCESSION NUMBER: AL117617
  ref <309>: DATABASE ENTRY DATE: 2001-06-18
gacttggcacttttaaaggtaacttcaccaaagaccgaagagccagtaaccagtagctccaacttgtctcagcatcacatcttctgtgctctttatttttgccggaccagtttgcggttaggagaatgtgccttttttgtacctttgcatttaggttttataattttaattgatgtatggacacacacaaacaaaaaagcatgaaggaagatttggatccaagcagtgccacactttacatcatcactacaagtgttcaagtgtaaagaaaaccaattttgaaactatgaaattcctgattcataaatacacagttatttctactttagtacatataagataattcactgttattaaagctcttttattaaggcaattgcatatgttttaaaagcaatggtaaattaagttgtcttccaaaactgtgtacttgtctggtcagctgtgtatgatcagttatctacctcagagtctattttcttttgtgctgggacaggttgctggccctccctgtttccacagaccaaatcctcctagctcaggagctagggctaagcagttatttctttcaagtattttttagttcttaaattttatgcttgtatttgatgatagatgtcagtgacatttcatagtttcaaaagtccttgctgctctgaggagtgtagattctagtgaaaattacatagtcataagagaaatgtgtttttgtttttgtttttgtttcatttttttaaagttgtggtattattggttctatgctccctggaatattactgctttgtgaaagtccagactgaacgcagcaccctctgtgtacctagtacagttataaacctgggtctctcactacttgatatttttgcattagttaagacagaaatttgatagctcggttagaggggaggggaaatctgctgctggaaatgtctgaactaagtgccatactcgtctgggtaagatttgggaaacataacctctgtacataaaaaaaaaaaatcagttaaacatcacatagtagacagccattaaattataaaaaaattaatttatgaagaaagaccttttgtacagattgaaaaaaaaaagattttcatagagatatctatatgatcaagagagttaattttttatttttgttttactagtgccacagacttgccagtggtaacttatttgtccggttcaagataactctgtagttttctttcctaggacttgttgttaaacgccaaaagacatttttgaactgtacatttgatcagattgttagcttttctgttttatttcttttgagaacctttgaataaaaaacatctgaaattttaaaaaaaaaaaaaaaaaaaa

SEQ ID NO: 296 - DNA, 2958 bp, Homo sapiens
  ref <308>: DATABASE ACCESSION NUMBER: AL117666
  ref <309>: DATABASE ENTRY DATE: 2001-06-18
acgcgtccgcaccgtggcccgcctcgaatgtgctgccacaggtcacccaaaccctcagattgcctggcagaaggatggaggcacggatttccccgctgcccgtgagcgacgcatgcatgtcatgccggatgacgacgtgtttttcatcactgatgtgaaaatagatgacgcaggggtttacagctgtactgctcagaactcagccggttctatttcagctaatgccaccctgactgtcctagagaccccatccttggtggtccccttggaagaccgtgtggtatctgtgggagaaacagtggccctccaatgcaaagccacggggaaccctccgccccgcatcacctggttcaagggggaccgcccgctgagcctcactgagcggcaccacctgacccctgacaaccagctcctggtggttcagaacgtggtggcagaggatgcgggccgatatacctgtgagatgtccaacaccctgggcacggagcgagctcacagccagctgagcgtcctgcccgcagcaggctgcaggaaggatgggaccacggtaggcatcttcaccattgctgtcgtgagcagcatcgtcctgacgtcactggtctgggtgtgcatcatctaccagaccaggaagaagagtgaagagtacagtgtcaccaacacagatgaaaccgtcgtgccaccagatgttccaagctacctctcttctcaggggaccctttctgaccgacaagaaaccgtggtcaggaccgagggtggccctcaggccaatgggcacattgagagcaatggtgtgtgtccaagagatgcaagccactttccagagcccgacactcacagcgttgcctgcaggcagccaaagctctgtgctgggtctgcgtatcacaaagagccgtggaaagcgatggagaaagctgaagggacacctgggccacataagatggaacacggtggccgggtcgtatgcagtgactgcaacaccgaagtggactgttactccaggggacaagccttccacccccagcctgtgtccagagacagcgcacagccaagtgcgccaaatggcccggagccgggtgggagtgaccaagagcattctccacatcaccagtgcagcaggactgccgctgggtcctgccccgagtgccaagggtcgctctaccccagtaaccacgatagaatgctgacggctgtgaagaaaaagccaatggcatctctagatgggaaaggggattcttcctggactttagcaaggttgtatcacccggactccacagagctacagcctgcatcttcattaacttcaggcagtccagagcgcgcggaagcccagtacttgcttgtttccaatggccacctccccaaagcatgtgacgccagtcccgagtccacgccactgacaggacagctccccgggaaacagagggtgccactgctgttggcaccaaaaagctaggttttgtctacctcagttcttgtcataccaatctctacgggaaagagaggtaggagaggctgcgaggaagcttgggttcaagcgtcactcatctgtacatagttgtaactcccatgtggagtatcagtcgctcacaggacttggatctgaagcacagtaaacgcaagaggggatttgtgtacaaaaggcaaaaaaaagtatttgatatcattgtacataagagttttcagagatttcatatatatcttttacagaggctattttaatctttagtgcatggttaacagaaaaaaattatacaattttgacaatattatttttcgtatcaggttgctgtttaattttggagggggtggggaaatagttctggtgccttaacgcatggctggaatttatagaggctacaaccacatttgttcacaggagtttttggtgcggggtgggaaggatggaaggccttggatttatattgcacttcatagacccctaggctgctgtgcggtgggactccacatgcgccggaaggagcttcaggtgagcactgctcatgtgtggatgcccctgcaacaggcttccctgtctgtagagccaggggtgcaagtgccatccacacttgcagtgaatggcttttccttttaggtttaagtcctgtctgtctgtaaggcgtagaatctgtccgtctgtaaggcgtagaatgagggttgttaatccatcacaagcaaaaggtcagaacagttaaacactgcctttcctcctcctcttattttatgataaaagcaaatgtggccttctcagtatcattcgattgctatttgagacttttaaattaaggtaaaggctgctggtgttggtacctgtggatttttctatactgatgttttcgttttgccaatataatgagtattacattggccttgggggacagaaaggaggaagttctgacttttcagggctaccttatttctactaaggacccagagcaggcctgtccatgccattccttcgcacagatgaaactgagctgggactggaaaggacagcccttgacctgggttctgggtataatttgcacttttgagactggtagctaaccatcttatgagtgccaatgtgtcatttagtaaaacttaaatagaaacaaggtccttcaaatgttcctttggccaaaagctgaagggagttactgagaaaatagttaacaattactgtcaggtgtcatcactgttcaaaaggtaagcacatttagaattttgttcttgacagttaactgactaatcttacttccacaaaatatgtgaatttgctgcttctgagaggcaatgtgaaagagggagtattacttttatgtacaaagttatttatttatagaaattttggtacagtgtacattgaaaaccatgtaaaatattgaagtgtctaacaaatggcattgaagtgtctttaataaaggttcatttataaatgtcaaaaaaaaattttttaaaaattaaaaaaaaaaaaaaaaa

SEQ ID NO: 297 - DNA, 5736 bp, Homo sapiens
  ref <308>: DATABASE ACCESSION NUMBER: AL122055
  ref <309>: DATABASE ENTRY DATE: 2001-06-18
gttgccaagatctatggttaaatccttactttaccagattcttgatggtatccattacctccatgcaaattgggtgcttcacagagacttgaaaccagcaaatatcctagtaatgggagaaggtcctgagagggggagagtcaaaatagctgacatgggttttgccagattattcaattctcctctaaagccactagcagatttggatccagtagttgtgacattttggtatcgggctccagaacttttgcttggtgcaaggcattatacaaaggccattgatatatgggcaataggttgtatatttgctgaattgttgacttcggaacctatttttcactgtcgtcaggaagatataaaaacaagcaatccctttcatcatgatcaactggatcggatatttagtgtcatggggtttcctgcagataaagactgggaagatattagaaagatgccagaatatcccacacttcaaaaagactttagaagaacaacgtatgccaacagtagcctcataaagtacatggagaaacacaaggtcaagcctgacagcaaagtgttcctcttgcttcagaaactcctgaccatggatccaaccaagagaattacctcggagcaagctctgcaggatccctattttcaggaggaccctttgccaacattagatgtatttgccggctgccagattccataccccaaacgagaattccttaatgaagatgatcctgaagaaaaaggtgacaagaatcagcaacagcagcagaaccagcatcagcagcccatagcccctccacagcaggcagcagcccctccacaggcgcccccaccacagcagaacagcacccagaccaacgggaccgcaggtggggctggggccggggtcgggggcaccggagcagggttgcagcacagccaggactccagcctgaaccaggtgcctccaaacaagaagccacggctagggccttcaggcgcaaactcaggtggacctgtgatgccctcggattatcagcactccagttctcgcctgaattaccaaagcagcgttcagggatcctctcagtcccagagcacacttggctactcttcctcgtctcagcagagctcacagtaccacccatctcaccaggcccaccggtactgaccagctcccgttgggccaggccagcccagcccagagcacaggctccagcaatatgtctgcattgaaaagaaccaaaaaaatgcaaactatgatgccatttaaaactcatacacatgggaggaaaaccttatatactgagcattgtgcaggactgatagctcttctttattgacttaaagaagattcttgtgaagtttccccagcaccccttccctgcatgtgttccatcgtgacttctctgataaagcgtctgatctaatcccagcacttctgtaaccttcagcatttctttgaaggatttcctggtgcacctttctcatgctgtagcaatcactatggtttatcttttcaaagctcttttaataggattttaatgttttagaaacaggattccagtggtgtatagttttatacttcatgaactgatttagcaacacaggtaaaaatgcaccttttaaagcactacgttttcacagacaataactgttctgctcatggaagtcttaaacagaaactgttactgtcccaaagtactttactattacgttcgtatttatctagtttcagggaaggtctaataaaaagacaagcggtgggacagagggaacctacaaccaaaaactgcctagatctttgcagttatgtgctttatgccacgaagaactgaagtatgtggtaatttttatagaatcattcatatggaactgagttcccagcatcatcttattctgaatagcattcagtaattaagaattacaattttaaccttcatgtagctaagtctaccttaaaaagggtttcaagagctttgtacagtctcgatggcccacaccaaaacgctgaagagagtaacaactgcactaggatttctgtaaggagtaattttgatcaaaagacgtgttacttccctttgaaggaaaagtttttagtgtgtattgtacataaagtcggcttctctaaagaaccattggtttcttcacatctgggtctgcgtgagtaactttcttgcataatcaaggttactcaagtagaagcctgaaaattaatctgcttttaaaataaagagcagtgttctccattcgtatttgtattagatatagagtgactatttttaaagcatgttaaaaatttaggttttattcatgtttaaagtatgtattatgtatgcataattttgctgttgttactgaaacttaattctatcaagaatctttttcattgcactgaatgatttcttttgcccctaggagaaaacttaataattgtgcctaaaaactatgggcggatagtataagactatactagacaaagtgaatatttgcatttccattatctatgaattagtggctgagttctttcttagctgctttaaggagcccctcactccccagagtcaaaaggaaatgtaaaaacttagagctcccattgtaatgtaaggggcaagaaatttgtgttcttctgaatgctactagcagcaccagccttgttttaaatgttttcttgagctagaagaaatagctgattattgtatatgcaaattacatgcatttttaaaaactattctttctgaacttatctacctggttatgatactgtgggtccatacacaagtaaaataagattagacagaagccagtatacattttgcactattgatgtgatactgtagccagccaggaccttactgatctcagcataataatgctcactaataatgaagtctgcatagtgacactcatcaagactgaagatgaagcaggttacgtgctccattggaaggagtttctgatagtctcctgctgttttaccccttccattttttaaaataagaaattagcagccctctgcataatgtagctgcctatatgcagttttatcctgtgccctaaagcctcactgtccagagctgttggtcatcagatgcttattgcaccctcaccatgtgcctggtgccctgctgggtagagaacacagaggacagggcatacttcttgtccttaaggagcttgtgatctgtgacagtaagccctcctgggatgtctgtgccatgtgattgacttacaagtgaaactgtcttataatatgaaggtctttttgtttacttctaaacccacttgggtagttactatccccaaatctgttctgtaaataatattatggaagggtttctatgtcagtctaccttagaaagccagtgattcaatatcacaaaaggcattgacgtatctttgaaatgttcacagcagccttttaacaacaactgggtggtccttgtaggcagaacatactctcctaagtggttgtaggaaattgcaaggaaaatagaaggtctgttcttgctctcaaggaggttacctttaataaaagaagacaaacccagatagatatgtaaaccaaaatactatgccccttaatactttataagcagcattgttaaatagttcttacgcttatacattcacagaactaccctgttttccttgtatataatgacttttgctggcagaactgaaatataaactgtaaggggatttcgtcagttgctcccagtatacaatatcctccaggacatagccagaaatctccattccacacatgactgagttcctatccctgcactggtactggctcttttctcctctttccttgcctcagggttcgtgctacccactgattccctttacccttagtaataattttggatcattttctttcctttaaaggggaacaaagccttttttttttttgagacggagtgttgctctgtcacccaagctggagtgcagtggcacgatcttggctcactccaacctccaccttccaggttcaagtgattctcctgcctcagcctcccgagtagctgggactacgggcacgcaccaccacgtctggctaatttttgtatttttagtagagatggggtttcaccctattggtcaggctggtcttgaattcctcacctcaggtcatccgcctgtctcggcctcccgaagtgctgggattataggtgtgagccaccgcacccagttgggaacaaagcctttttaacacacgtaagggccctcaaaccgtgggacctctaaggagacctttgaagctttttgagggcaaactttacctttgtggtccccaaatgatggcatttctctttgaaatttattagatactgttatgtcccccaagggtacaggaggggcatccctcagcctatgggaacacccaaactaggaggggttattgacaggaaggaatgaatccaagtgaaggctttctgctcttcgtgttacaaaccagtttcagagttagctttctggggaggtgtgtgtttgtgaaaggaattcaagtgttgcaggacagatgagctcaaggtaaggtagctttggcagcagggctgatactatgaggctgaaacaatccttgtgatgaagtagatcatgcagtgacatacaaagaccaaggattatgtatatttttatatctctgtggttttgaaactttagtacttagaattttggccttctgcactactcttttgctcttacgaacataatggactcttaagaatggaaagggatgacatttacctatgtgtgctgcctcattcctggtgaagcaactgctacttgttctctatgcctctaaaatgatgctgttttctctgctaaaggtaaaagaaaagaaaaaaatagttggaaaataagacatgcaacttgatgtgcttttgagtaaatttatgcagcagaaactatacaatgaaggaagaattctatggaaattacaaatccaaaactctatgatgatgtcttcctagggagtagagaaaggcagtgaaatggcagttagaccaacagaggcttgaaggattcaagtacaagtaatattttgtataaaacatagcagtttaggtccccataatcctcaaaaatagtcacaaatataacaaagttcattgttttagggtttttaaaaaacgtgttgtacctaaggccatacttactcttctatgctatcactgcaaaggggtgatatgtatgtattatataaaaaaaaaaacccttaatgcactgttatctcctaaatatttagtaaattaatactatttaatttttttaaagatttgtctgtgtagacactaaaagtattacacaaaatctggactgaaggtgtcctttttaacaacaatttaaagtactttttatatatgttatgtagtatatcctttctaaactgcctagtttgtatattcctataattcctatttgtgaagtgtacctgttcttgtctcttttttcagtcattttctgcacgcatccccctttatatggttatagagatgactgtagcttttcgtgctccactgcgaggtttgtgctcagagccgctgcaccccagcgaggcctgctccatggagtgcaggacgagctactgctttggagcgagggtttcctgcttttgagttgacctgacttccttcttgaaatgactgttaaaactaaaataaattacattgcatttattttatattcttggttgaaataaaatttaattgactttgaaaaaaaaaaaaaaaaaaaaaaaaaaaaaaaaaaagg

SEQ ID NO: 298 - DNA, 8434 bp, Homo sapiens
  ref <308>: DATABASE ACCESSION NUMBER: AL133033
  ref <309>: DATABASE ENTRY DATE: 2001-06-18
aggccacattgcagttgggcagcaagggcttggtagtgtgaaggacccaagtaactgtgggatgcctctgacccctcccacctctccagaacaggctatcctaggtgagagtggaggtatgcagagtgctgccagtcacctggtttcccaagatggagggatgataacgatgcacagtccaaagagatcggggaagattcctccaaaactccacaatcatatggtccatcgagtctggaaggaatgcatcctcaacagaacccagtccaagaggagccaaatgtcaactccaactcttgaagaagagcctgctagcaatcctgctacttgggattttgtggatccaacccaaagagtcagctgttcttgttccaggcataagcttttaaaacgttgtgcagtcgggcccaatcgacctcccacagtatctcaaccagggttcagtgcaggaccatcatcatcttcatctttaccacctcctgcttcttctaagcacaaaacagcagaaagacaggaaaaaggagacaagctgcaaaagagacccttaataccatttcaccataggccctctgtggccgaagaattatgcatggagcaagatacaccaggacagaaactagggttggcagggatagactcctccttagaggtgtctagcagtaggaaatatgataagcaaatggccgtgccttccagaaatacaagcaagcaaatgaatctgaatcctatggattcacctcattcccctatatcccctctgccaccaacactcagccctcagccacgaggtcaggaaacagagagtttggacccaccatcggtccctgtgaatccagccctttatggaaatggactagaactccagcagttgtctactctggatgacagaactgtcctcgtaggccaaagactgcctctcatggcagaggtcagcgagacagccttatattgtgggattaggccctcgaacccggagtcatcagaaaagtggtggcatagttatcgtctcccacccagtgatgatgctgagttcaggcctccagagctccagggtgagagatgtgatgccaaaatggaggtaaactcagagagcactgcattgcaaagactcttagcacaacctaacaaacggtttaaaatctggcaagacaaacagccccagttgcagccactccacttccttgacccattgcctctatcacaacaacctggagacagtttgggagaagtgaatgacccatatacctttgaagatggtgacataaaatacatctttacagccaacaagaaatgcaaacaagggacggagaaagattccctgaaaaagaataagtcagaggatggatttggtaccaaggatgtcactacaccaggtcattccacgccggtgcctgatgggaaaaatgccatgtctattttcagttctgctactaaaacagatgtccggcaggataatgctgctggcagagctggctccagtagccttacacaggtaacagatttggcaccttccctgcatgacttagacaacatctttgataattctgatgacgacgaacttggggctgtatcacctgctctgcgctcatcaaaaatgcctgcagttgggacagaagaccgacctcttgggaaggatggaagagctgctgttccttatccaccaacagttgcagacttgcaaaggatgtttcccactccaccatctttggaacagcatcctgcattttctcctgtgatgaattataaagatgggatcagctcagagacagtgacagcattaggcatgatggagagccctatggtcagtatggtttcaacacaactcacagaattcaaaatggaagtggaagatggattaggaagtcccaagcccgaggaaattaaggacttttcatatgtgcacaaagttccatcctttcaaccttttgtgggatcctccatgtttgctccactgaagatgttgccgagccattgtttgctacctctgaagatacctgatgcctgtctgtttcggccttcatgggcaattcctcctaaaattgaacaactgcccatgccccctgcagccactttcattagagatggctacaataacgtgcctagtgttgggagcctagcagatccagactatctgaacacaccacagatgaacacacccgtgacgttgaacagcgctgccccagccagcaatagtggggcaggagtcctaccatctccagcaacccctcgcttctctgtccccacaccacgaacccccaggaccccaagaactcccagaggtgggggcactgccagtggtcaagggtctgttaagtatgatagcaccgatcaaggatcaccagcctccaccccctctactacacggcccctcaactctgtggagcccgccaccatgcagccaattcccgaagcccacagcctctatgttaccctgattctctccgattccgtgatgaatatctttaaagacagaaactttgacagctgttgcatctgtgcctgcaacatgaacatcaaaggggcggatgtcgggctttacatccccgattcttccaatgaggaccagtaccgctgtacctgtgggtttagtgcgattatgaaccgcaaacttggctacaattcaggactcttccttgaagatgagttggatatttttgggaagaattctgatattggtcaggctgcagagaggcgcttaatgatgtgtcagtccaccttccttcctcaggtggaaggaaccaaaaaaccccaggagccacccataagccttctcctcctcctccagaatcaacacacacaaccttttgcttcactgaatttcctggactacatttcctctaacaatcgccaaactcttccctgtgtaagctggagttatgaccgggtgcaagcagataataatgattactggacggaatgctttaatgcgttggagcaggggcggcagtatgtggataaccccactggtggaaaagtggacgaagctctggtgagaagtgccactgtgcactcttggcctcacagcaatgtgctggacatcagcatgctctcctcccaggatgtggttcgtatgctgttgtccctgcagccctttctccaagatgccatccaaaagaagcgcacgggcaggacctgggagaacatccagcatgtgcagggaccactcacttggcagcagttccataaaatggcaggacggggaacctacggttcggaagaatctcctgagccgttgcccatccccactctgctggtaggctatgacaaggatttcctcaccatctcgccattctccttgccgttttgggagaggctcttgttggacccatatgggggccaccgtgatgttgcctatattgtggtgtgtccagaaaatgaggccttgctcgaaggagccaaaactttcttcagggacttgagtgctgtatacgagatgtgtaggcttgggcagcacaagcccatctgcaaagtgctacgtgacgggatcatgcgcgtgggaaaaactgtggcacagaagctgacagatgagcttgtgagtgagtggtttaaccagccttggagcggcgaggagaatgacaatcattccagactcaaactttatgcgcaagtttgccgccatcacctagcaccttatttagccactctgcagcttgatagcagcctattgataccacctaaataccagaccccaccagcagcagcacagggacaagctacgccagggaatgctgggcccttagctccaaatggatcagcagctcccccagctggcagtgcatttaatcccacctcgaatagtagttctacaaatcctgcagcaagtagttctgcatctggttcctctgtgccaccggtctcatcgtctgcctctgctcctggtattagccagataagcactacctcttcttcaggattcagtggtagtgttggagggcagaaccccagcactgggggcatttctgcggatagaacgcaagggaacataggctgtggtggagacactgaccctgggcagagctcttctcagccctcacaggatggacaagagagtgttacagaaagggagagaataggaattcccacggagcctgactctgcagacagccatgcccaccctccagctgttgtcatttacatggtggacccgttcacgtatgctgcagaggaggactccacttctgggaacttttggctgttgagcttgatgcgctgctacacagaaatgctggataatttacctgagcatatgagaaattctttcattctccagattgtgccttgccagtacatgctgcagacaatgaaggatgagcaagttttctacattcaatacttgaagtccatggcattttcagtgtactgccagtgcaggcgaccactgcctacacagatccacattaaatccctcacgggatttgggcctgcagccagcattgagatgaccctcaagaaccctgagcggcccagcccaatccagctttactcccctccctttatattggccccaatcaaagacaagcagacagagctgggagagacgtttggtgaggcgagccagaaatacaatgtgctcttcgtgggctattgtctgtctcacgaccagcgctggcttttggcttcctgcactgacctccatggggaattattagagacctgcgttgtaaatattgctttaccaaacaggtcacggaggagtaaagtatctgcacgtaaaattggactacagaagttatgggagtggtgcatagggattgtccaaatgacatctctaccctggagagttgtaatcgggcgacttgggcgtcttggccatggggagcttaaagattggagtatcctccttggagaatgttcactacagacaatcagcaaaaagctcaaggatgtgtgccggatgtgtggaatctctgccgcagactctccttctatccttagtgcctgcctggttgccatggagccccaggggtcctttgtagtgatgccagatgctgtcacaatgggctctgtttttggccgaagtactgcactgaacatgcagtcatctcagctcaacacccctcaagatgcttcttgtacacacatcttggtgttcccaacatcatcaaccatccaggtggctccagccaactaccccaatgaagatgggtttagccccaacaatgatgatatgtttgttgaccttccattcccagatgatatggacaatgatattggcatattaatgactgggaacctccattcctctcccaactcttccccagtaccctccccaggctctccttctggaattggtgtgggctctcacttccagcatagtcggagccagggtgagcgtcttctttctagagaagcaccagaggagctaaagcagcagcccctggcccttgggtattttgtatcaactgccaaagctgagaatcttccccagtggttttggtcatcgtgtccccaggctcaaaaccagtgccctctcttcttaaaggcttcgctgcatcaccacatttcagtagcacagacagacgaacttctgcctgccaggaattctcagcgggttccacaccctcttgactccaaaaccacgtcggatgttttaaggtttgttttggagcagtacaacgctctgtcctggctcacgtgcaatccggccacccaggaccgtacttcctgccttcccgtccactttgtggtgctcactcagttgtacaatgccatcatgaatatactttaattggaaaagcacttgttctctctggctcagttccttctccctgcaacctcagtccaaggaacctgctacactctgcaaataacccacatccttttcttcagaccactctccacagtcctgcactgtgattccttctcagcaggcacatgtcaattctgcagtgttcattaccagagtgactccttgacacttctctcatggacctggaaacttccataagtggtgactttcagccagtgcggtggtgtgtgtagccccaaccactggtccccaggaagtggtggtggttgatggcttttcagcgggaaacagaagagacagtgtccttttgcacaagagtctgtgttttcagcctctgtatacaattgagggcagtctagccctttggatgaaatcctcttagttactggtgtatggcctgtgggttacctgaactccataatcggggactttttaaaaataagaaccagctcaagtacatggtttcatactggggtttctgtctccctagtgttcccatccagattagcatgagtgctttggttgacttcaaacctgtgtgtcaatgcagaaggtctggagacagcttcattttgtttatttattttaatttgttttgtcatatggtttttgtgactttatttttttaattcacaaggaccaggtacagtagctgaaacccaattcagatccaccataggattctttgactacatacctctgtcctagaagccggaaaaggagtaaaaacacattggggagatcatgcctaaaagtaatatattcaaaaccacccagcagtaggttttgttaacaacaaactggattttaaaagttctgccatgttaagtggccagcatttcatgaaggataacatttttatacagaaggcagtcaagctcaactcagagccatggaggcaagtaccttaattagttttatatagtcacaacggaaatatattttctagtgaattcttattggaagccaggtctctcctctcattagatcaaaagggacttatgtacatacaacaattgaaagtgtttgctcatgaaatcagttataaatatggtgaattttttctggaccataggaatattatttcaaagaaatattacaacttaaccattaaattagtacttgaagttgagcctttgtggtgggactttttaaaaaaatgcctttttaaagcattaatggctaattgaagtattttatgactcctcattcctggcccagagggttgtctttgaaaccctgtttctaacccttgtgttgtgtgtttctgtctgaggacagtgggtgtgtactggcctcccgggagccactgtgaccaggcctttgagctcttgtcatctgtggagagaatcatgcaaattttaaaagttcttccaagagacttccatgtcctggttattaacaaaaaaggaaaaatgtaataattgatatgattttgtaaaagtatttttcttgaaataatctaaagtttaaaacattatattaaaaaaaaaagttgtgtggtgggaatgtgaaagcagagaaataacttgtaaatggataattttgttctctgtaccaccagttgaagggggggttgactttcgcaatgtataggataaaaaatctgatatatcaaaccatttgtatctaatgtgtacagtgtaaaattgactttaaaaatattgcagtgctattttttcttaatcagaaaggaaaattctcaaggccttttgaagagcataagaagatgaagattgtaaacttgtataaaattatcttggtgagaagacaaattgtaaagtagatatttgtaatcttttaccactttggggttgcttttttcccggaattcatcagaactttgaattttttttttaaatgggctgtttttaatgcaggggcttttcttccctagaaacccaattctaagcagaaaaagaaaaaaaacacaaaaaataaaaaacccctacaaaaaaactttaaaaaaaatggcagcaaagggtagttttcatctggtgtcttttatttaagttttttaagttaagaaaagctggtgacatatttatacgtttttgtgcaaaaataaatgaatggcaatagattttaaaaaatcttattatgtacttctgtgtgaaaaagtctgtataatatttcccttaaatatgcattattttacttgtgagttttttactgaattaatctgaaatgtacaagccctggatttgctacagagtgagaagttattttatttttttttatttttaattttggaaattctgcagaaatcagaactcttaccatggtttgaacaaaaaaaggggaaatggggaggggaaaagggtgggattgtccagcatgcttgtatgtatatttcagaaccttttttaaatgtaaaagctgtacatttctgggaagttctgaatttcttttgtttccttttttccttcaagcattttgcagtgagcttcttttatatatagcaaacaatttgaaagaatacaaaaatatgtgaagttcatttaaaaaaataactacagtatagcgctggtacagtacactaaaagactttgataaaaagaaacaataataaaaggcctccattttaaatgtcattcatatataccttgtggatgagagctatatacttttacacacttttttagaggaataaattattgaattactgaaaaaaaaaaaaaaaaa

SEQ ID NO: 299 - DNA, 2537 bp, Homo sapiens
  ref <308>: DATABASE ACCESSION NUMBER: AL133035
  ref <309>: DATABASE ENTRY DATE: 2001-06-18
ggttgagaaaggggcatccacagacatctgtgccttctgccacaagaccgtgtccccccgagagctggctgtggaggccatgaagaggcagtaccatgcccagtgcttcacgtgccgcacctgccgccgccagctggctgggcagagcttctaccagaaggatgggcgacccctctgcgaaccctgctaccaggacacactggagaggtgcggcaagtgtggcgaggtggtccgggaccacatcatcagggccctgggccaggccttccacccctcctgcttcacgtgtgtgacctgcgcccggtgcattggggatgagagctttgccctgggcagccagaacgaggtgtactgcctggacgacttctacaggaaattcgcccccgtctgcagcatctgtgaaaatcccatcatccctcgggatgggaaagatgccttcaaaatcgaatgcatgggaagaaacttccatgaaaattgctacaggtgtgaggactgcaggatcctcctgtctgtcgagcccacggaccaaggctgctaccccctgaacaaccatctcttctgcaagccatgccatgtgaagcggagtgctgcggggtgctgctgagagtgcccgctgggcagtgaacagaccactagccccggctggggcccttccctgacttggtttcccttcctaacctgctcttgcacactttccttctgagcctccatggagaccagcctgcaagccggcccagcctgtccaggatacagtggggctgagcacccccaggccttccactcctctaccctctgggcaccagaaggctcctggaccatgagcttcacccccagaattccctgctgaccctgccccacttccagggaaaagctgggggaggttggacccctctcactgactagctgtctggtaggggtgctaggaccagcctcgcctgtggggttgagctgtttgaggacaaactccaaggtcccttaaaaagtgccttttagaggctgggcatggtggctcacgcttgtaatcccagcactttgggaggccaaggtgggtggatcacctgaggtcaggagttcaagaccagcctggccaacatggtgaaaccctgtctctactaaaaatacaaaaattagccaggcatggtagcaggtgcctgtaatcccagctactggggaaagctgaggcaggagaattgcttcaatctggaaggcagaggttgcagtgagattgcaccattgcattccagcctgggcaacaagagggaaactccgtctcaaaaaaaaaaaaagtgccttttaggccggatgtggtggctcatgcctgtaatcccagcactttgggaggccaaggcaggcagatcacttgaggtcaggagtttgagaccagcctggccaacacggcaaaaccccgtttctactaaaaatacaaaaattagctgggtgtggtggcgtgcgcctgtaatcccagctactcaggaggctgaggcaggagcattgcttgaacccgggaggcagaggttgcagtgagctgagatggcaccactgcactccagcctgggagacacagcgagactctgtctccaaaaaaaaaagtgctttttgaaaatgttgaggttgaaatgatgggaaccaacattctttggatttagtggggagcataatagcaaacacccccttggttcgcacatgtacaggaatgggacccagttggggcacagccatggacttccccgccctggaatgtgtggtgcaaagtggggccagggcccagacccaagaggagagggtggtccgcagacaccccgggatgtcagcatcccccgacctgccttctggcggcacctcccgggtgctgtgttgagtcagcaggcatggggtgagagcctggtatatgctgggaacagggtgcaggggccaagcgttcctccttcagccttgacttgggccatgcaccccctctcccccaaacacaaacaagcacttctccagtatggtgccaggacaggtgtcccttcagtcctctggttatgacctcaagtcctacttgggccctgcagcccagcctgtgttgtaacctctgcgtcctcaagaccacacctggaagattcttcttccctttgaaggagaatcatcattgttgctttatcacttctaagacattttgtacggcacggacaagttaaacagaatgtgcttccctccctggggtctcacacgctcccacgagaatgccacaggggccgtgcactgggcaggcttctctgtagaaccccaggggcttcggcccagaccacagcgtcttgccctgagcctagagcagggagtcccgaacttctgcattcacagaccacctccacaattgttataaccaaaggcctcctgttctgttatttcacttaaatcaacatgctattttgttttcactcacttctgactttagcctcgtgctgagccgtgtatccatgcagtcatgttcacgtgctagttatgtttttcttcttacacatgaaaataaatgcataagtgttagaaaaaaaaaa

SEQ ID NO: 300 - DNA, 2254 bp, Homo sapiens
  ref <308>: DATABASE ACCESSION NUMBER: AL133057
  ref <309>: DATABASE ENTRY DATE: 2001-06-18
ccttccggtcgttaacgcccacgggctcgcgcggcgccgcctcctgggctcagttaccgcggacgccagtgccgggctccaggagacgcagggcgacgccacacgccggggtggccgactgggtcagcgcgggctgcgcctcctcgccatgggccccctctcggcgcggctgctaatgcagcgcgggcgccccaagagcgaccggctggggaagatccggagtctggacctgtcaggattggagctgctttccgagcacctggaccccaaactcctgtgccgcctgacgcagctgcaggagcttgacctgtctaacaaccacctggagacgctgccggacaacctgggcctgtcccacctgcgtgtcctccgctgcgccaacaaccagctgggggatgttactgccttgtgccagttccccaagctcgaggaactcagcctggagggcaaccccttcctgacggtcaatgacaacctgaaagtctcctttctcctgcccacgctccgtaaggtcaatggcaaggatgcgtcctcaacttactctcaggtggagaacctgaatcgggagctgaccagcagggtcacagctcactgggagaagttcatggccacactgggtcctgaagaggaggctgagaaggcccaggcggactttgtgaagtcggctgtcagggatgtccgctacgggcccgagtccctcagcgagttcacccagtggcgggtgcggatgatctctgaggagctggtggccgccagtaggacccaggtgcaaaaggctaacagcccagagaagcccccagaagctggagctgcccacaagcccagggccagactggcggccttgaaacggccagacgacgtcccactcagcctctctcccagcaagcgggcgtgtgcctccccgtcggcccaggtggagggcagccctgtggcaggctccgatggcagccagcctgctgtgaagctggagcccctgcacttcctgcagtgccacagcaagaacaacagcccccaggacctcgagacccagctgtgggcctgtgccttcgagccggcctgggaggagggggccacatcccagaccgtggccacgtgcggcggggaggctgtgtgcgtaattgattgccagacgggcatcgtgctccacaagtacaaggcacccggcgaggagttcttttctgtggcctggaccgctctgatggtggtcacacaggctggccacaagaagcgctggagtgtgctggcggctgcaggcctacggggcctggtccggctgctgcacgtgcgtgccggcttctgctgcggggtcatccgagcccacaagaaggccatcgccaccctgtgcttcagccccgcccacgagacccatctcttcacggcctcctatgacaagcggatcatcctctgggacatcggggtgcccaaccaggactacgaattccaggccagccagctgctcacactggacaccacctctatccccctgcgcctctgccctgtcgcctcctgcccggacgcccgcctgctggccggctgcgagggcggctgctgctgctgggacgtgcggctggaccagccccaaaagaggagggtgtgtgaagtggaattcgtcttctctgagggctccgaggcatctggacggagagtggatgggctggcatttgtgaatgaggacatcgtggcctccaaggggagcggcctgggcaccatctgcctgtggagctggaggcagacgtgggggggccggggcagccagtccacagtggcagtggtggtcctggcgcggctgcaatggtcgtccaccgagttggcctacttctcgctcagcgcctgccctgataaggggattgtgctctgtggggatgaggagggcaacgtgtggctctacgacgtcagcaacatcctgaagcagccacccctgctgccggcagccctgcaggcccccacacagatcctgaagtggccccagccctgggcccttggccaggtggtgaccaagaccatggtgaacacagtggtggccaatgcctccttcacctacctcaccgccctgacggactccaacatcgtagccatctgggggaggatgtagcctcacaccatcgcaaaggaccagggacacagctaactaacttattcagctttgggccgatgggggtggggggggtctttcagtgaatatttttattaaactctactgtggacaagaaaaaaaaaaaaaaaaaaaaaaaaaaaaaaaaaaaaaaaaaaaaaa

SEQ ID NO: 301 - DNA, 2939 bp, Homo sapiens
  ref <308>: DATABASE ACCESSION NUMBER: AL133074
  ref <309>: DATABASE ENTRY DATE: 2001-06-18
atatttttcaataaccctgtagtggcttgatgcagggaaccctgggggactttcagcgaagagctgtgctcttttctgactagattagagcgtttggagtggaagacgtcaaatgtgtagtgagatggaggttttacattgttcttctactggctgtgatgaagtgccagaatgtctctttagaacaagagttagattccccctttctccttattgccccttccgttttgacttcccctttatttatttgctgtctaattaggggccaagtctgtaaagttttgtcaaagtgagttagaagttgttttctcttactatttgtgtttaccagagttgggagataagatagtttccatgaaggtgtgtatgttttatacgatgtttgttatagggccatgcattggtaacttgaaaatagaccagcttaatgtcttcaggatgtaaaactctgaatacacggcgtctctttttcatacattgcatgtaagttgttagtacctcacaagctacagaagttcagccatgagattttgtttggcaacatgaacagatttgtgtataactgcaatggccttttttccagatttccttattgactttttgtttgccttacctggggctagttttttatgctttgtacctagaaaacaaaaaattacattcgttgggctttttttcaaggttgggattaccacaccacctggaatatcatactgtggtttctgcctaaaattggcacatgtaagtattgaagaaaatggttatataattcagttgaaactcttggttattagatgttaggcatctcctgtatgtaagacacaaggccaaccacaacacagaacgatgttgacctgttaagtattctctgaaacatggccaaaatgcattttatgagcttttttttttttgctattgtaaatattagtggtttacaatgcgctttagacatatttctttaaaatgcaagcagtgagaaataagacctctctgaattagtagctctaaactgttaacatagaatgttacttggaaaaagtctggaatatgtggtgtacacaagcagtgcttcgtgaatgagtttcttagcttttatagtgcgccatgtttctcaaagtttgtttttgttgacaaaacattttataatatatatcttatgtttattttttttctcaactaattgtgtactgcactgtaaggtgaaaattagccatccattatttatcttctgtggcaatgcatttatatggttgattgggtggggaattttttgcagaaagatgcaaagtgattgggttttcgacttcctatcgcagggagcttttaagaaatattaatttcctatacatttttccaatccccatgcaaactgttcctgtttacataccttctctgttgtatcagtactttgagtgagaagacagtttatttaaaacttgagcaggctgttcagcattttttctgcttctgaaatctgtatagtacactggtttgtaatcattatgtcttcattgaaatccttgctacttctcttcctcctcaatgaaatacattatatattatctttatgtactcttaagaaaaacgagcaaggaagagtatcttcattattctcattttctctgagttggaaacaaaaacatgaaggactccaactagaagacagatatttacatttaaatagattagtgggaaaactttaagagtttccacatattagttttcattttttgagtcaagagactgctccttgtactgggagacactagtagtatatgtttgtaatgttactttaaaattatctttttattttataaggcccataaatactggttaaactctgttaaaagtgggccttctatcttggatggtttcactgccatcagccatgctgatatattagaaatggcatccctatctacttactttaatgcttaaaattatacataaaatgctttatttagaaaacctacatgatacagtggtgtcagccttgccatgtatcagtttcacttgaaatttgagaccaattaaatttcaactgtttagggtggagaaagaggtactggaaaacatgcagatgaggatatcttttatgtgcaacagtatcctttgcatgggaggagagttactcttgaaaggcaggcagcttaagtggacaatgttttgtatatagttgagaattttacgacacttttaaaaattgtgtaattgttaaatgtccagttttgctctgttttgcctgaagttttagtatttgttttctaggtggacctctgaaaaccaaaccagtacctggggaggttagatgtgtgtttcaggcttggagtgtatgagtggttttgcttgtattttcctccagagattttgaactttaataattgcgtgtgtgtttttttttttttaagtggctttgtttttttttctcaagtaaaattgtgaacatatttcctttataggggcagggcatgagttagggagactgaagagtattgtagactgtacatgtgccttcttaatgtgtttctcgacacattttttttcagtaacttgaaaattcaaaagggacatttggttaggttactgtacatcaatctatgcataaatggcagcttgttttcttgagccactgtctaaattttgtttttatagaaattttttatactgattggttcatagatggtcagttttgtacacagactgaacaatacagcactttgccaaaaatgagtgtagcattgtttaaacattgtgtgttaacacctgttctttgtaattgggttgtggtgcattttgcactacctggagttacagttttcaatctgtcagtaaataaagtgtcctttaacttcaaaaaaaaaaaaaaaaaaaaaaaaaaaaaaaaaaaaaagggcggccgctctagaggatccaagcttacgtaaaaaaaaaaaaaaaag

SEQ ID NO: 302 - DNA, 2986 bp, Homo sapiens
  ref <308>: DATABASE ACCESSION NUMBER: AL133096
  ref <309>: DATABASE ENTRY DATE: 2001-06-18
atttttaaaacctcctctttaaagatttcctcttgaagagacagctcactttctacatagtcccgtatggaagtggactgctgaagaaattagtgtttccattcccctccaccgtctcccccattttttccgaacatttctttgtctttgtccattttcatcgctgagctgaagagcatgctttatcagaaacccttttgtccctttccttttccatgcttagagggaagtttctgacttgggagaacgccttagagttcttggggtctgaactcctctgatgccttccaaagtcacgtagctgtaagacccagcgggtgccagccgggagggtgactccagctcagcagcatgtatggaagtgcattgtgaccatgaaggagtctgccagtggccaagccacctagtgagctccctaccaaggaacctgggtgtcacctgcaggtggccaagagccagtttttatgccaggcaggggactggttggactctattgaggcttcttcctgtctgtggggagcactcctgtccccctcgtggtagggatacctgtcaccccacaaagaggcagggtgacaggtgttggccccattttaggcagacttgggtgtcatgacttctagttcacttgttttaaacctacctgtgatggcagctgcaccatgctgccctcttgacacactgctggagcccagagcacaggccagagtctcagcctgagccccttccccaggcagtacctgacaaggatacctgggattggggccagctttccagtcagatgccacgtttcctttgcccactgccacggggcactagggcctgccgcaggctctcccatgagggagaacgacctctgcaggcccctctgccttcctgcttcctaattgaccctttctctggcaggtgaggtgataaagcacggggacctgagatgcgtgcgcgatgaaggaatgcccatctacaaagcacccctggaaaaagggattctgatcatacagtttttagtaatctttcctgaaaaacactggctttctctggaaaagcttcctcagctggaagctttactccctcctcgacagaaagtgaggattacagatgacatggatcaggtggagctgaaggagttttgtcccaatgagcagaactggcgtcagcacagggaggcctacgaggaggacgaagacgggccccaggctggagtgcagtgccagacggcatgacgtggtgcggggcagcgtggccccaccggactagcacatgatgaatgtaaagttggcacaatgaaaatgacatcgctttaatggccttgtgtttgggatgtcctgtgtatgtgttcagcattcttaattgctgagtgtctttttggcttttcttttggttgtaacttaagttatagcttaatttatatttaaatgttttaagtataaatcacctctagtctgcatatggaatctgttcatttctattttcaggatatacttttgagatgtcagtgattgcaccaacactttgtgcttctagtggctttgccataattcagtgtcaccaataaggcacagcccagttagcagcttagcccccctagcaaaccccaaggcacaaagtgggcatcctgactcatctctaggtctgtggtttctcccctcttcccttggcagagttattgagggcatgatctcagggctgctaagataacatttctgaggattctagatgatcctcttaaagaataaaagcacatccgtggatcggacatggctgcatgtgcctgcttaacagggccaacttagttcctactgttctgtgcccttcagtggatggaacgtgagtgtctgatcatctctcttggaagttttctgaaccttccaagctctgtggtgaggacaaaccagtgtttgaatcatatgctgataactgtttgcctgtgaccctcacaccttgttcttcagggttttaatgattttctgttgacaacttttgcaatgctttcccaccaaagtgcttacttgtaaagaaaactaaatccttctgtgtccccggcagcctcagtgcagcaacagaagccaagggagaatgctgctggtttggcccatggcacagccagcttctctgaccagtaatccggggtgacttgagggtctgcaaaggcatagaactccccactgttttccacctcattctcccagattgagctcccttccaaaggatcgttcctctcattgcacagccatattacaaagggtttcctgctcaagtgatgttttggtaagaacttcgctgagttccactgtggattacagtttgtatggactactactgtaaattatagcttgtttggagggatattagtcattattttattcatgacaggtagactacaattcgaacttagggttacctcagtctttagccattactgcttatttcttttccccaagtcacaaaaaacttgtaagctgctgggttaaagcagaggccacctgtcagatctaccctacccttatttggttacatggcacctgagagtttcactcagaccagggatcttccttaggagggtcaaagtgcagatcagaccatgcaggtaaggtgaaccagctgcacggaccaggttcccgcaaaacattgccagctagtgaggcataatttgctcaaagtatagaaacagcccacctgtgcccactttgaccattggtgaggatagatataaaatcacttcttccaacgaagcctaggtgaaaatctatttataaatggaccacaactctggggtgtcgtttttgtgctgtgacttcctaattattgctaaagaactactgtttagttggtaatggtgtaaaattacattcagctccttcttgtcatataaaaggaatttggagggtgtcgcttaaaattttattccacctgtacatttgtcactttaaaattaaaattgagctggtatgagagataaaaaaaaaaaaaaaaaaaaaaaaaaaag

SEQ ID NO: 303 - DNA, 1410 bp, Homo sapiens
  ref <308>: DATABASE ACCESSION NUMBER: AL133105
  ref <309>: DATABASE ENTRY DATE: 2001-06-18
gagaaagccttgctgggggcatgtgactgcacccagattgtgaaacccagtggggtccacctcaagctggtgctgaggttctcggatttcgggaaggccatgttcaaacccatgagacagcagcgagatgaggagacaccagtggacttcttctacttcattgactttcagagacacaatgctgagatcgcagctttccatctggacaggattctggacttccgacgggtgccgccaacagtggggaggatagtaaatgtcaccaaggaaatcctagaggtcaccaagaatgaaatcctgcagagtgttttctttgtctctccagcgagcaacgtgtgcttcttcgccaagtgtccatacatgtgcaagacggagtatgctgtctgtggcaacccacacctgctggagggttccctctctgccttcctgccgtccctcaacctggcccccaggctgtctgtgcccaacccctggatccgctcctacacactggcaggaaaagaggagtgggaggtcaatcccctttactgtgacacagtgaaacagatctacccgtacaacaacagccagcggctcctcaatgtcatcgacatggccatcttcgacttcttgatagggaatatggaccggcaccattatgagatgttcaccaagttcggggatgatgggttccttattcaccttgacaacgccagagggttcggacgacactcccatgatgaaatctccatcctctcgcctctctcccagtgctgcatgataaaaaagaaaacacttttgcacctgcagctgctggcccaagctgactacagactcagcgatgtgatgcgagaatcactgctggaagaccagctcagccctgtcctcactgaaccccacctccttgccctggatcgaaggctccaaaccatcctaaggacagtggaggggtgcatagtggcccatggacagcagagtgtcatagtcgacggcccagtggaacagtcggccccagactctggccaggctaacttgacaagctaagggctggcagagtccagtttcagaaaatacgcctggagccagagcagtcgactcgagtgccgaccctgcgtcctcactcccacctgttactgctgggagtcaagtcagctaggaaggaagcaggacattttctcaaacagcaagtggggcccatggaactgaatctttactccttggtgcaccgcttctgtcgtgcgttgccttgctccgtttttcccaaaaagcactggcttcatcaaggccaccgacgatctcctgagtgcactgggaaatctgggtataggtcaggcttggcagccttgatcccaggagagtactaatggtaacaagtcaaataaaaggacatcaagtggaaaaaaaaaaaaaaaaaaaaaaaaaaaaaaaaaa

SEQ ID NO: 304 - DNA, 2492 bp, Homo sapiens
  ref <308>: DATABASE ACCESSION NUMBER: AL133108
  ref <309>: DATABASE ENTRY DATE: 2001-06-18
cagagcgcagccaacaaagcagcagatagcagtgtacagaaagcaaaaaaggaactgtatgtgaggcacttgtttctgttaatatccatattcctgttaacacacaccctttctcatgtaaaaagaaaaataaataaatggtctgaactttgaaaactttgtgctgctaaaacatagattttggagacaaataaatagatgctttgctgtttcactttcatagctaaacatcaacagaaaccatctccccttgcccccaaagtgtgaaatccttcttcccttcgttttcttcctttatgtttcaaaagggaactttgaagactgtgaatacaggttccattggtcacctttcgggcttctttccccagtgctgaagccactcatcgactttgcaaaagactggagcattccaagatctgaaaatggattttttttctttttttcttttttagccgggactattttatttttatgaatttgtttttagtttaatgaaatagtagatcctgaaatgttgtacatatttctaactaggctgatgcacagtgcaaattccttttttaattgttttttttaagtagaaatactaaagaaagaataccatctaactattcataccagtatccagttgtagcataaggtgtcaaaagcaagtacgcaaaacatttactgttttaacaagctatttccttttaacaagaaatcttgtatttcttcctgtgtttgagatgaacatttttaaattttaaagttgtacagttttttgttttccattattttatcttgtttgtaactctatgaaatatatatatatatattttttgccatttaactgttgtatgttactctgtgtctgtaccatatagaaaaaaaattgtttttgtttttggttctctatgtgatatcagttaacaatgtaacactagctttacctgtcaaattctgctaggtcttctctgaaaacgttgtttttaaaaatgatattgcttggtaatagtgcaatttctatccttttccctcccccctcaacttttaagttcttttctttataattttgctgccccctccctgatggtttgggtttttgtttttgtttttgttttttttttcatggagctactatgccatcctccctctgtgaggcagagtgactgtcagtgttttgttatgccatgccttgagctgtgggtgtttggcgacaataaggtggttgaatagattggctgagcacacttccacccacctagtgttctcagaggggttatgtgattgtttcaacctggagtgggttgcacccttaatgctttcctctgcaactaaaccgcccacatatatgttcattgaaaaaagtaagaataattctcagcactaacccagaagtagcaaagcagtcagtgatggtgaacattagaggtcaaacatgagatagatgtttgtgggctgacagccatcgtggctatgaccagtactatttacaaagcatgaattcactacaatgctcaactgtttgtttagctttatctcacttggggaatttattcctgtctgctgcattgtaggtagctgggtaggatatatttccacttgctttttaaattagttcttcacctccattgacactcgttttttggttttctccctatagtgtgggttggtgctagacaccagtctgacccacggaatgggagttatttcatccatctttcctccatccttccaaaaaccacatatctacacaaggaaaaatttaatacatctaggaattttttttttaattacaagctatttaaagagatgaatgtggccaaagttttacacaattgaaaataaagtaaaacagacggcatgtgtttaaacctgagtttatcaggcatggcaggaagttgcaggagagagaggcagtgacccaagccagtgcacttgatgttcatggacatatattttttttaaataataaattaaaacattttaaatagaagcataaattgagttgtttgttggcgctgagatactgcccactgtgaaacaaagctttgactagttttttgtttgtttactttcttcaggggggaggggggcaagtttgggtaggaaagaaagcataaatgaacgtgaccctgaggtgaagaggtatatgaacagcctttgcaatgtataaaaagaaaaaaaaacaaaaaacaacaaaaaaaatagagcaagtgaaaccaaaaatgatgttcttggtgtttttctataatgtagtcttgttagcttttttgttactgtaacaatgctgatctcgaactgttccaaaatacatggagactaacaaacagaaccacatggaactttcaaactgaaaaaaaaatttgtcacaaaaactttgttgtcatagttaagttgattgtagatggtaattgaatatactcctttgaaaatatttcatcaagtatgtttcctgctcattgtgatacattaaaaaaaaatatgagcaaaaaaaaaaaaaaaacaaa

SEQ ID NO: 305 - DNA, 7028 bp, Homo sapiens
  ref <308>: DATABASE ACCESSION NUMBER: AL133572
  ref <309>: DATABASE ENTRY DATE: 2001-06-18
caaactcctagtggggagccggcggcttgtggacgtgatggatgtgaacacccagaagggcacggagatgagcatgtcccagtttgtgcgttactacgagacgcccgaggcccagcgggacaagctgtacaacgtcatcagcctagagttcagccacaccaagctggagcacttggtcaagcgtccgactgtggtagacctggtggactgggtggacaacatgtggccccagcatctgaaggagaagcagacagaagccacgaacgccattgcagagatgaagtacccgaaagtgaaaaagtactgtctgatgagcgtgaaaggttgtttcaccgacttccacatcgactttggaggcacttccgtttggtaccatgttttccggggtgggaagattttttggctgattcctccaacgctgcacaatttggcgctgtacgaggagtgggtgctgtcaggcaaacagagtgacatctttctgggagaccgtgtggaacgatgccaaagaattgagctgaagcagggctacacatttttcatcccttccggttggatccatgccgtctacacccctgtagactctttggtgttcggcggaaacatcctgcacagctttaacgtgcccatgcagctgcggatctacgagatcgaggacaggacgcgggtgcagcccaaattccgttaccccttctactatgagatgtgctggtatgtcctggagagatacgtgtactgtgtgacccagcgctcccacctcactcaggaataccagagggagtcgatgcttattgatgccccgaggaagcccagcatagacggcttctcttcggattcctggctggagatggaggaggaggcctgtgatcagcagcctcaggaggaggaggagaaggacgaggagggcgagggcagggacagggcacccaaaccgcccaccgatggctccacttcacccaccagcacgccctctgaggaccaggaggccctcgggaagaagcccaaagcacctgccctgcgattcctcaaaaggactttgtctaatgagtcggaggaaagtgtgaagtccaccacattggccgtagactaccccaagacccccaccggctctcccgccacggaggtctctgccaaatggacccatctcactgagtttgaactgaagggcctgaaagctctggtggagaaactggaatccctcccggagaacaagaagtgtgtccccgagggcatcgaggacccccaggcactcctggagggtgtgaagaacgtcctgaaggagcacgcagatgatgaccctagtctggccatcactggggtccctgtggtgacttggccaaagaagactccaaagaaccgggctgtgggtcggcccaaggggaagctgggcccggcctccgcggtgaagttggccgccaaccggacaacggcaggagctcggcggcgccggacgcgatgccgcaagtgcgaggcctgcctgcggaccgagtgcggagagtgccacttctgcaaggacatgaagaagttcgggggccccgggcgcatgaagcagagctgcatcatgcggcagtgcatcgcgccagtgctgccccacaccgccgtgtgccttgtgtgtggcgaggcggggaaggaagacacggtggaagaggaggaaggcaagtttaacctcatgctcatggagtgctccatctgcaatgaaatcatccaccctggatgccttaaggtgagtggcccagtggggacaggtggtgctgacgctctggggcaggtagggttgctggagatgctggtgagatggtgggatgcaggtcgtgcagtgaattcctggaggacccctgagtctgggtgatcctgtgtgtcaagggataagcccggggcaaggagggcctggagtacctcagagacccagtgtcatcaaaggaataaacacacccccacctcccaggatgtcagaaccagagagggtttccagagcctcagcggatggcaaacacaggctgcttgtttgtagctgggccagagggagggcctccaggtggctccaggcttctgggagaacaaggccccacaccacacttcttcccccagcacccagtagagtcctctgcagagtcctttctgcatgccaggcgctgagctggtggctttacctgggtcatacccccccagtgagatgggcacactaacttttatggccgagggcaccagcccacagagacggagtgtcttgcccagggtcccagagaagcaaaggggctcagcctctgaaccctggcctggatccacagctgcccgtctctgccagcctctgcagctgtgttttcttttggctggaaacgggatagatgtgacgttggggagggggtgctgctgcttctggaagacgtggcgtcacagagccttgtgcccgtgggccatcttctccgcccgtccctcttctgagtcctggtgttccccgcagattaaggagtcagagggtgtggtcaacgacgagcttccaaactgctgggagtgtccgaagtgtaaccacgccggcaagaccgggaaacaaaagcgtggccctggctttaagtacgcctccaacctgcccggctccctgctcaaggagcagaagatgaaccgggacaacaaggaagggcaggaacctgccaagcggaggagtgagtgtgaggaggcgccccggcgcaggtcggatgagcactcgaagaaggtgccgccggacggccttctgcgcagaaagtctgacgacgtgcacctgaggaagaagcggaaatatgagaagccccaggagctgagtggacgcaagcgggcctcatcgcttcaaacgtcccccggttcctcctctcacctctcgccgaggccccctctaggcagcagcctcagcccctggtggagatccagtctcacttacttccagcagcaggtgctcccacgacgcacgccctcctgaggccccggggactggcgagtcctgggctgtcccccaccccaccccgctggtcctccaccccactgctgcctctcctgaggcttcccaggtctcggccccagatctctggctcgtggttctggcttggggcctgggaagctgtctgtgcctagagcctctgttggttgggatggaagctgtgagtccagggaacctctgaggagcctggtggccctgctccacccacgggccgtgctgtcaccagccacaaggtggcgccaggagtctctcccagctctagccattcctgctgggccggggattcccacagggctgtgctccagaactggctcccagagccgaggatgatttgaatgggcggctgcacatctccaggtctgtggggtgggaggtcagttgggtgggaacagttcaactgtactcctacttccagcttcttccttgaaagctgcaggcagggctcgcccgtctgtcggtcagacgtggagatggcatttgtggggaaggcctccctccagcccctcctctggagactgtggactcgtggtggggtggggtgtcgaggagaccaaatcccacgagcccggggagcaagctctgcgtcctttctttttcgtgacagctcaaacctggcaaagaagataagcttttcaggaaaaaggtaccatcttcccctccctcctgtgccccaggcctgagcggttagagctgcaccgcagctccctgggccacagtcccgtggcaggggggcgggaggccttgggcgggcgcagccctgagccccagaggctgacgcgtctccgctctcgccctcagcggcggtcctggaagaacgccgaggaccgcatggcgctggccaacaagcccctccggcgcttcaagcaggaacccgaggacgaactgcccgaggcgccccccaagaccagggagagcgatcactcccgctccagctcccccaccgcgggacccagcaccgaaggggccgagggcccggaggagaagaagaaggtgaagatgcgccggaagcggcggcttcccaacaaggagctgagcagggagctgagcaaggagctcaaccacgagatccagaggacggagaacagcctggccaacgagaaccagcagcccatcaagtcggagcctgagagcgagggcgaggagcccaagcggcccccgggcatctgcgagcgtccccaccgcttcagcaaggggctcaacggcaccccccgggagctgcggcaccagctggggcccagcctgcgcagcccgccccgtgtcatctcccggcccccaccctccgtgtccccgcccaagtgtatccagatggagcgccatgtgatccggccaccccccatcagccccccgcctgactcgctacccctggacgatggggcagcccacgtcatgcacagggaggtgtggatggccgtcttcagctacctcagccaccaagacctgtgtgtgtgcatgcgggtctgcaggacctggaaccgctggtgctgcgataagcggttgtggacccgcattgacctgaaccactgcaagtctatcacacccctgatgctgagtggcatcatccggcgacagcccgtctccctcgacctcagctggaccaatatctccaagaagcagctgagctggctcatcaaccggctgcctgggctccgggacttggtgctgtcaggctgctcatggatcgcggtctcggccctttgcagctccagttgtccgctgctccggaccctggatgtccagtgggtggagggactaaaggatgcccaaatgcgggatctcctgtccccgcccacagacaacaggccaggtgagttgccaggctgggggtttctgtgggggtggggtgagcgagctagactgttggatctgcttttaccctcagaccccagctgttccccaaaggacatagggatgagtctctgctgccatgttctcagtttgcttcaggcacagaggggatctgggaggaggcaggggctcctgtgcacacgtgagactcgctcctggggctccgcgtgcgtctctctgctttcctgttgactcgctcatggggctctgcgtgtgtctcactgctttcttattgactcgctcatggggctctgcgtgcatctcacttcttttctgttgacttgcccctcgttggtttcaagcctccactgccatcgggatcagtgtggttgtgcaaaggcttccaggatggcacctccccctggactgggctggactgcctaggtccgtgcttctcgccaagccatggggatcggagatgctgcgcagcctctgcactggttggctgatgactactgggtggaatgtgggcatagtgtttctaggtcttttagtttttcaagagaatctgaaaatctaagttttgatgtggagtctgatttttcactgttggaattatgattttgggaggaagcagtttataactaaatgaaatctgagtgttctgtctggctggtgggccttttagagtgtcatgtcagcatgaccaggcctcctcggtcagattgacgggttgccccctccttcctgccccaccaggtcagatggacaatcggagcaagctccggaacatcgtggagctgcgcctggcaggcctggacatcacagatgcctccctgcggctcatcatccgccacatgcccctgctctccaagctccacctcagttactgtaaccacgtcaccgaccagtctatcaacctgctcactgctgttggcaccaccacccgagactccttaaccgagatcaacctgtctgactgcaataaggtcactgatcagtgcctgtccttcttcaaacgctgtggaaacatctgtcatattgacctgaggtactgcaagcaagtcaccaaggaaggctgtgagcagttcatagccgagatgtctgtgagtgtccagtttgggcaagtagaagaaaaactcctgcaaaaactgagttagtccaaggataagtatgtaaatacggggcgggctctgggaggggagagactttacaaaaatgagggcttttattttccatttggaacgtgggacaacagaccacaacgcaattccattttgcaagtctttccaagggagaagctgttcaaccacccgtttgggggatgagtgagccgacactttcctttggtctttctgaatcgtaactgcactgctttctggaccatttctaaggcggcctttacaagaagacattcctgtcggagaggagggtggacttcggagaaattctcatactgaagcatgagcttaggagtttctgttagtggtagtggtgttttggacacttcattccttgcaacaccgaggttttgggtgttgacataaagtggaccacacaccacatctgctgccgtcttgacacttttttttgtttggttggttttgttacatcttacattatgcagaactatttttgtacaaattgtttaaaagttatttatgcaaggtttgaatgcataccagtgtttttattgttttgagattgccaattttcctgatttccttaaggtaggagagaatttaacgtgtacttcatcgacacaacccatctacaaatgtgcccagatctaacaaagtaggctaagaccttccacttaaaagcatgtttaactggaagttgagagtctgctttgtacctcaagagttacatgagcatgttgtggataaatgtaaattatagtcaaagtaagatactctgccaagtttcctctgtagagaattcacttttctcaaattttaaaatttcgacttcagcctttgcactcaggaggttctgctccagcatgagctcttgtacttacatagatctaatttatacagtgagtcaagacgtagaataaatgctcccacatagcctttcttttgcttttgcttctctcctctgaagtgtgagttgagttctcatttaggtttgtaacatggctatttcctagttgtaaagttctgcatttataagtgccattgttgtaaggtggtgtttcctagaccttccctgatgcgattttacctttgttgaatttgtataaacaattgtacaaaaaaaaccaaaaaaaaaa

SEQ ID NO: 306 - DNA, 2224 bp, Homo sapiens
  ref <308>: DATABASE ACCESSION NUMBER: AL133603
  ref <309>: DATABASE ENTRY DATE: 2001-06-18
atccaaaatatctcagtatcatctgtctgaagcattgtgtgttctcattcgggtggtaacaatgtatgtgtaatatttttttcttagtgattttgacagtttaaatgtttaacaacttaaagcattaaaaatgcttattaataactttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaatcttgaggtgacttattttgcatagaggatatggatagaccaacagtaagggttgtgggttataccggcatagagaaaagaagaaaactagaattgaaacaactgtgtcttagacatttgtttgaaaaagcttcatcaggccttggagcagtcactgctttattccgcaaaaattatttggtaggaaatttttgggagatctgattttcttatccaagttttgtaaatagttgttatttctatatttggattggtgaaagacctcaagtttatatgtaaagacataactgcccttagtcatgaaattgttgtgacctctactttttgtcactaatagcctacattcaagtgcctgtgttttttcatcttgtttaggaatgttttgagattaatgtgcttaaaagtcctacgtgactgattttaaacattgtgataaaattaattttcagtagaatagttgaatgtgttaagataggattttatgttagagataccagaatgctggtattctactacttgtgcaatatatatgttttaaaaaacaaatttgagaatacatttaatcatagggatatagatataagcacctctctaaagaatctttagtttccgacgttgaattatagaccagtttgagtaagtactgctttttttttttggagacgggctctcgctctgttgctcaggctggagtgcagtggcgtgatctcagctcactacagcctccacctcgtgggttcaaacagttgtgctgcctcagcttcccgagtagctaggattacaggtgcatgccaccacacctggctaatttttgtattttagtagagatggggtttcaccatgttggccaggctcgtctcgaactcctgacttcaggtgatccacccatctcagcctcccaaagtgctgggattacaggcgtgagccaccatgcccggcccataagtaccgtttttgaggttcagtcttaaacatttgctttaagaaaacagtcttgaatttcacatgctgctatttttatattttgccattttacagtactgttttgttttgaattcatgcatatcattgaaaatttctcgttttcattttcttagatgacttcttgtctgagacagaaaaatttcctactacagcagtgcagtccagaggttaagatgtattagaattatacaatatcagtttaaaaatctgtatgcataaagaatgcaccactcaacttttttattcataagctaatatttttttaaagttacattaagattttttctcttttgcagctacatttgaaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggtggcaaaatattagctctgttttgggacattttaaaatagaactatccttgttcgatagcataggaaaatgttctggtgattgtcagggtctcctaatatttatctcaattcttttataagtctatggaaattatttaattattttaaaacgtacacacttttcttgtaaatatgtcacatctgagttcaaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgcacagagtttaaaaaaaaaaaaaaaaaaaaaaag

SEQ ID NO: 307 - DNA, 3447 bp, Homo sapiens
  ref <308>: DATABASE ACCESSION NUMBER: AL133619
  ref <309>: DATABASE ENTRY DATE: 2001-06-18
gggcacagggtgctccccagacctccctcctccaagtagagctgaaatgggaaggaacccctgggacagcccctgccctgctagatctttgcctcagattgctgctgtggccaggcccaggatctccagccctatggctctgagtcctgacatgctgggggcccaggggctctggacacactccatccagggatcccttcctgccatctgggcagcaaccatggggacaaagggaggaagcagagtcctgtttccttgccacttgtccaaggcacttccccatcctgacagcggcccccacccagcccaggattctgggttgtggtctcgagctcacttcccgttatctttggggctggggctgacatcaggaggacatctgactggtggatggagccagcctgggaacatcgtagctggggcagtgcctagggctctcccttcccagagagacatggagaatggggttgagggagggcccttccctagccgctgtggcaactccagtgagctgttctgggcaaagtgtggcccaagtcggcagccccagccctgcagtgctggggacgctgacaggacacgggaagaggccatgctctccctcgggacctgctgttccatgtgtcccaagccctcctgctttccagatggcccctcaggaaaccacctttccagggcctctgctcccttgggcgctcgctgggtctgcatcaacggagtgtgggtagagccgggaggacccagccctgccaggctgaaggagggctcctcacggacacacaggccaggaggcaagcatgggcgtcttgcgggcggtagcgccgacactgtgcgctctcctgcagacagcctctccacgtcaagcttccagtctgtcaagtccatctctaattcaggtgagcaggctggcgtccatgtgctcacaggggtgagtgccccacggggaccccagcctgggtggcctctaggggtgctgaccaggtaccctctgctgggccaagctccaggatttggggatgaaggtgcagctgaaaagagccctgcaagctgaagccaccgggaggggattaagggggggtgggcaggaccagggaccagtcacagggcagtaaggcctcacagcaggcaccccagggtggggcagcaagcaggcaggaggggcctccccgggtggccgcctagggaggacgtaccctggctgcccagcagcagccctgcttggccgtgtccccgccacaagcaggcaggacacaggagggatggcactgcccacggagccctgggctcatggcaccttctgcagagtgaactgggagcagagagcctcttttccccactctgtgaggccgggcattttcctcagcccagccctaaccctcaccattcctgtgatgggcccaggtgctggacgggccttgtccttgccgaggaaacccatgcaggctgggtcccaagcctctcatgcagtttcattttacccaagatggggccagcttccactatgttgattgttctagagtgttcacaggcaccacccatgggcttcaccctcagaaccacattgattccccccagaaccctccaaggcaggcttccctttacagaggaggaaactgaggcagggacaggggcttcttgggtacacacagctgttcctggaaaacttgggcggtgactgttggtgcctgcagtgaccggccttgtagggtctgacttgcagccaactctcaaggcaaggccaggccccagcccggctccttcaacaagcaagattcaaaagctgacgtcccccagaaggcggacctggaagaggagcccctacttcacaacagcaagctggacaaggttcctggggtacaagggcaggccaggtaaggcttgggtgttcctggggtgcaagggcaggccaggtaagtcttgcctgcaccctaagggccccatgactacatttactaggctcacgccctgcagtcagccaactgctctgcccctagctccaggggcctgtctccagggctcatgatagcagatgacggccacgctctacccatcggtgggcgctgtcttcctcccttcccctgggggtcctgcagagtacctgtgctgacctgagcccacgaggggggccagtagcggcccctaaaccacttcctcagagaaaagtaaagtaatattctgaccaagagaaggcttgctgcccctggccacagcctgcctttggagggcactaggccagcaggtcagagtaggaacaggttctggtgatccctgagtttgcgggactgccctgagatgctacagagcgcacactttcagcagcgcaaccagcaggacaggctcctgcatctgcacatcccgagaccaggcctggagcaagatgccccactgggtgtggggtcacgaccaagagcagcctggcagctagctggtcacccactgaagcccatctgacccttagggcaccttcagaggggagaaagggacaggccccagtcccagagacccccacctggtgcccagagcaccctgctcagtgggagaggggaaccaggccctcttccccacattggcctgggcgctgcctggggaggtatgctgggtgggtggttagacgcacctgggcaggtcacctctggctgctgcaatgactgtttcagaaaggagaaagcagaggcctctaacgcaggagctgcctgtatggggaacagccagcaccagggcaggcagatgggggcggcggcacaccccccaatgatcctgccccttcccctgcgaaagcccaccacacttaggcagtgcgaagtgctcatccgcgagctgtggaataccaacctcctgcagacccaagagctgcagcacctcaagtccctcctggaagggagccagaggccccaggcagtcccggaggaagctagctttcccagggaccaagaagccacgcatttccccaaggtctccaccaagagcctctccaagaaatgcctgcttctgagcccacctgtggcggagcgtgccatcctgcccgcactgaagcagaccccgaagaacaactttgccgagaggcagaagaggctgcaggcaatgcagaaacggcgcctgcatcgctcggtgctttgagctacccgcatctggtcagtgccaggcccaccaacctgcagctggagattggctctctatagcatttcctgacacttccgctacttttaggcctggctaaattccaagatagataacactcaagatagataaagtacttgatctccaaactgacaaactgtttattttctagctgttattttgctatttggcatttacataaaagcacacgatgaagcaggtatcgccttacctgttgaaactgaaaataaagcttgtttatttccaaaaaaaaaaaaaaaaaaaaaaaaaaaaaaaaaaaaaaaaaaaaaaaaaaaaaaaaaaaaaaag

SEQ ID NO: 308 - DNA, 4018 bp, Homo sapiens
  ref <308>: DATABASE ACCESSION NUMBER: AL133622
  ref <309>: DATABASE ENTRY DATE: 2001-06-18
ggcagcaggccgaagctcttcttcttccgctcgctcttggccttggttggccgcagcttgcccccggtgctgggcccaggccctgcagccatggaggagagccccctgccggcaccccttaatgtcgtgccccctgaggtgcccagtgaggagctagaggccaagcctcggcccatcatccccatgctgtacgtggtgccgcggccgggcaaggcagccttcaaccaggagcacgtgtcctgccagcaggcctttgagcactttgcccagaagggtccgacctggaaggaaccagtttcccccatggagctgacggggccagaggacggtgcagccagcagtggggcaggtcgcatggagaccaaagcccgggccggagaggggcaggcaccgtccacattttccaaattgaagatggagatcaagaagagccggcgccatcccctgggccggccgcccacccggtccccactgtcggtggtgaagcaggaggcctcaagtgacgaggaggcatcccctttctccggggaggaagatgtgagtgacccggacgccttgaggccgctgctgtctctgcagtggaagaacagggcggccagcttccaggccgagaggaagttcaacgcagcggctgcgcgcacggagccctactgcgccatctgcacgctcttctacccctactgccaggccctacagactgagaaggaggcacccatagcctccctcggagagggctgcccggccacattaccctccaaaagccgtcagaagacccgaccgctcatccctgagatgtgcttcacctctggcggtgagaacacggagccgctgcctgccaactcctacatcggcgacgacgggaccagccccctgatcgcctgcggcaagtgctgcctgcaggtccatgccagttgctatggcatccgtcccgagctggtcaatgaaggctggacgtgttcccggtgcgcggcccacgcctggactgcggagtgctgcctgtgcaacctgcgaggaggtgcgctgcagatgaccaccgataggaggtggatccacgtgatctgtgccatcgcagtccccgaggcgcgcttcctgaacgtgattgagcgccaccctgtggacatcagcgccatccccgagcagcggtggaagctgaaatgcgtgtactgccggaagcggatgaagaaggtgtcaggtgcctgtatccagtgctcctacgagcactgctccacgtccttccacgtgacctgcgcccacgccgcaggcgtgctcatggagccggacgactggccctatgtggtctccatcacctgcctcaagcacaagtcggggggtcacgctgtccaactcctgagggccgtgtccctaggccaggtggtcatcaccaagaaccgcaacgggctgtactaccgctgtcgcgtcatcggtgccgcctcgcagacctgctacgaagtgaacttcgacgatggctcctacagcgacaacctgtaccctgagagcatcacgagtagggactgtgtccagctgggacccccttccgagggggagctggtggagctccggtggactgacggcaacctctacaaggccaagttcatctcctccgtcaccagccacatctaccaggtggagtttgaggacgggtcccagctgacggtgaagcgtggggacatcttcaccctggaggaggagctgcccaagagggtccgctctcggctgtcactgagcacgggggcaccgcaggagcccgccttctcgggggaggaggccaaggccgccaagcgcccgcgtgtgggcaccccgcttgccacggaggactccgggcggagccaggactacgtggccttcgtggagagcctcctgcaggtgcagggccggcccggagcccccttctaggacagctggccgctcaggcgaccctcagcccggcggggaggccatggcatgccccgggcgttcgcttgctgtgaattcctgtcctcgtgtccccgacccccgagaggccacctccaagccgcgggtgccccctagggcgacaggagccagcgggacgccgcacgcggccccagactcagggagcagggccaggcgggctcgggggccggccaggggagcaccccactcaactactcagaattttaaaccatgtaagctctcttcttctcgaaaaggtgctactgcaatgccctactgagcaacctttgagattgtcacttctgtacataaaccacctttgtgaggctctttctataaatacatattgtttaaaaaaaagcaagaaaaaaaggaaaacaaaggaaaatatccccaaagttgttttctagatttgtggctttaagaaaaacaaaacaaaacaaacacattgtttttctcagaaccaggattctctgagaggtcagagcatctcgctgtttttttgttgttgttttaaaatattatgatttggctacagaccaggcagggaaagagacccggtaattggagggtgagcctcgggggggaggggcaggacgccccggtttcggcacagcccggtcactcacggcctcgctctcgcctcaccccggctcctgggctttgatggtctggtgccagtgcctgtgcccactctgtgcctgctgggaggaggcccaggctctctggtggccgcccctgtgcacctggccaggggaagcccgggggtctggggcctccctccgtctgcgcccacctttgcagaataaactctctcctggggtttgtctatctttgtttctctcacccgagagaaacgcaggtgttccagaggcttccttgcagacaaagcacccctgcacctcccatggctcaggatgagggaggcccccaggcccttcgggttggtagtgagtgtggacagcttcccagctcttcgggtacaaccctgagcaggtcgggggacacagggccgaggcaggccttcggggcccctttcgcctgcttccgggcagggacgaggcctggtgtcctcgctccacccacccacgctgctgtcacctgaggggaatctgcttcttaggagtgggttgagctgatagagaaaaaacggccttcagcccaggctgggaagcgccttctccaggtgcctctccctcaccagctctgcacccctctggggagccttccccaccttagctgtctcctgccccagggagggatggaggagataatttgcttatattaaaaacaaaaaatggctgaggcaggagtttgggaccagcctgggctatatagcaagaccccatcactacaaattttttacaaattagctaggtgtggtggtgcgcacctgtggtcccagctactcgggaggctgtggtgggaggattgcttgagtccaggaggttgaggctgcagtcagctcagattgcaccactgcactccagcctgggcaacagagcgagaccctgtctccaaaaaaaaaaaaaagcaatgtttatattataaaagagtgtcctaacagtccccgggctagagaggactaaggaaaacagagagagtgttacgcaggagcaagcctttcatttccttggtgggggaggggggcggttgccctggagagggccggggtcggggaggttggggggtgtcagccaaaacgtggaggtgtccctctgcacgcagccctcgcccggcgtggcgctgacactgtattcttatgttgtttgaaaatgctatttatattgtaaagaagcgggcgggtgcccctgctgcccttgtcccttgggggtcacacccatcccctggtgggctcctgggcggcctgcgcagatgggccacagaagggcaggccggagctgcacactctccccacgaaggtatctctgtgtcttactctgtgcaaagacgcggcaaaacccagtgccctggtttttccccacccgagatgaaggatacgctgtattttttgcctaatgtccctgcctctaggttcataatgaattaaaggttcatgaacgctgcgaaaaaaaaaaaaaaaaaaaaaaaaaaaaaaaaaaaaaag

SEQ ID NO: 309 - DNA, 8281 bp, Homo sapiens
  ref <308>: DATABASE ACCESSION NUMBER: AL133623
  ref <309>: DATABASE ENTRY DATE: 2001-06-18
gaccaatgaagactcaccaattatagaatattacccacctgattttaaaactgacctaaatgggaaacaacaggaatgggaagctgtggtgttaatcccttttattgatgagcgattattggaagccatggagacatgtaaccactccctcaaaaaggaagagaggaaaagaaaccaacatagtgagtgcctaatgtgctggtatgatagagacacagagtttatctatccttctccatggccagaaaagttccctgccatagaacgatgttgtacaaggtataaaataatatccttagatgcttggcgtgtagacataaacaaaaacaaaataaccagaattgaccagaaagcattatatttctgtggatttcctactctgaaacacatcagacacaaattttttttgaagaaaagtggtgttcaagtattccagcaaagcagtcgtggagaaaacatgatgttggaaatcttagtggatgcagaatcagatgaacttaccgtagaaaatgtagcttcatcagtgcttggaaaatctgtctttgttaattggcctcaccttgaggaagctagagtcgtggctgtatcagatggagaaactaagttttacttggaagaacctccaggaacacagaagctttattcaggaagaactgccccaccatctaaagtggttcatcttggagataaagaacaatctaactgggcaaaagaagtacaaggaatttcagaacactacctgagaagaaaaggaataataataaatgaaacatctgcagttgtgtatgctcagttactcacaggtcgtaaatatcaaataaatcaaaatggtgaagttcgtctagagaaacagtggtcaaaacaagttgttccttttgtttatcaaactattgtcaaggacatccgagctttcgactcccgtttctccaatatcaaaacattggatgatttgtttcctctgagaagtatggtctttatgctgggaactccctattatggctgcactggagaagttcaggattcaggtgatgtgattacagaaggtaggattcgtgtgattttcagcattccatgtgaacccaatcttgatgctttaatacagaaccagcataaatattctataaagtacaacccaggatatgtgttggccagtcgccttggagtgagtggataccttgtttcaaggtttacaggaagtatttttattggaagaggatctaggagaaaccctcatggagaccataaagcaaatgtgggtttaaatctcaaattcaacaagaaaaatgaggaggtacctggatatactaagaaagttggaagtgaatggatgtattcatctgcagcagaacaacttctggcagagtacttagagagagctccagaactatttagttatatagccaaaaatagccaagaggatgtgttctatgaagatgacatttggcctggagaaaatgagaatggtgctgaaaaagttcaagaaattattacttggctaaaaggacatcctgtcagtactttatctcgttcttcttgtgatttacaaattctggatgcagctattgttgagaaaattgaggaagaagtcgaaaagtgcaagcaaagaaagaataataagaaggtgcgagtaacagtgaaaccccatttgctatacagacctttagaacagcaacatggagtcattcctgatcgggatgcagaattttgtctttttgaccgtgttgtaaatgtgagagaaaacttctcagttccagttggccttcgaggcaccatcataggaataaaaggagctaatagagaagccgatgtactatttgaagtattatttgatgaagaatttcctggagggttaacaataagatgctcacctggtagaggttatcgactgccaacaagtgccttggtgaacctttctcatgggagtcgctctgaaactggaaatcagaagttgacagccatcgtaaaaccacaaccagctgtacatcaacatagctcaagttcatcagtttcctctgggcatttgggagccctcaaccattcccctcaatcactttttgttcctactcaagtacctactaaagatgatgatgaattctgcaacatttggcagtccttacagggatctggaaagatgcaatactttcagccaactatacaagagaagggtgcagttctacctcaagaaataagccaagtaaatcaacatcataaatctggctttaatgacaacagtgttaaatatcagcaaagaaaacatgaccctcacagaaaatttaaagaagagtgtaagagtcctaaagctgagtgttggtcccaaaaaatgtccaataagcagcctaactctggaattgagaactttttagcatctttgaatatctccaaagaaaatgaagtacagtcatctcatcatggggagcctccaagtgaagagcatttgtcaccacagtcatttgccatgaagggaacacggatgcttaaagaaattctaaaaattgatggctctaacactgtggaccataagaatgaaatcaaacagattgctaatgaaatccctgtttcctctaacagaagagatgaatatggattaccctctcagcctaaacaaaataagaaattagcatcttatatgaacaagcctcacagtgctaatgagtaccataatgttcagtctatggacaatatgtgttggcctgcccccagccagatccctcctgtatccacaccagtaactgaactttctcgaatttgttcccttgttggaatgccacaacctgatttctcctttcttaggatgccacagacaatgaccgtttgccaagtaaaattatctaatggcttactggtacatgggccacagtgccactctgaaaatgaagccaaagagaaagctgcactttttgctttacaacagttgggctccttaggcatgaatttccctttgccttcacaagtatttgcaaattatccttcagctgtaccacctggaaccattcctccagcctttcccccacctactgctaatataatgccttcgtcgtctcatctctttggctcaatgccatggggaccatcggtgccagttcctgggaagcccttccatcatactttatattctgggaccatgcccatggctgggggaataccagggggtgtgcacaatcagtttatacctctgcaggttactaaaaaaagggttgcaaacaaaaagaactttgagaataaggaagcccagagttctcaagccactccagttcagactagccagccagattcttccaacattgtcaaagtaagtccacgggagagctcatcagcttctttgaagtcctctccgattgctcaacctgcatcttcttttcaagttgaaactgcctctcaaggccatagtatatctcaccataagtcaacaccaatctcttcttcaagaagaaaatcaagaaaactggctgttaattttggtgtttctaaaccttctgagtaaatttggctcttagaattaagttaatttcttctctttccatctacctttttataaatacatatctatgtctcataaaaattagaatgtactattttaaaataatatgtgtaaattgaaatttttttcatttttaagttatcaggcacttttcatgctgtttaaaagactgtgtatcaaattgtgcactttaagtatgtgcagtttgttgtatgtcaattatacctcaataaatctgtaataaaaaactaaattaaaccttgcattaaaataatatcacagtatcagtggactaaacattaaaatgtaccactctaatcattggcctcatgattgaagcatcctgaactatgaattagacatcagttagcaataataagcattttttacactatcattgaggaataattacatggagcatgaaatttgggcctccagtataacttactgaatgtggattttatttctctttttaatgatgtaagaaaattgtcaggagaatggctcttatttatgtgtgttttaacttatgctttgttgcctctgagggtctttagacctgctgtgaaaggatcacatttgttgtggtgctgccagttttgctttattctaaattttgtaccaaagcaactttagaataatcagaatatttcatctaactgcttagaactataaatagcattctaaatttgagtaaatacaattttttaggttactcaagaaccagcattagtaatttctagtaaaattgtttcaaaatctacagggtacaatgattacaaattaatcttctaacaaaataaaatatgaaatattagtcatgttaattaataaactgtattattttgtatagctttttatttgcttacctgacattttatgagagcttcatagttggtcggtatgtagtgcttcttgggactgaagaaattctaattgttgtttaagttccaaggtgtgctacaatataggaggcacagtcatcagtttgtgacatacattatttactgcctatttcattctgattctatatttttagctttatgctgaactgttcaatgatgctgggattctctctttgcatgtcatatgtgaatgtgtggttcaagctgtaactgttgaaattattttagaatttatgacgatttctcagcagggcctatgtttatatatatatatatatttattctttagtttttgtgatatgcttatatttttaaggaagtaagttatagcatacttttttaaaagtaggaaccacaatctttatatggagcagcttgttatatctgattttcatgtaactcattggaaactctgccatgactcttaaagtagtcttacttgttttttaaaatgctggtattaaactaaatggactcctttcactaactgctgatttcagagtttaaatgttagcaggatatttgtgtattagcagtgccttcagtataagagagaaatattcattatctgtcatttatcatagtcgtataagtttccatgattttattttctgttattttcataagttcagatgtttatcagttcccaacattgtttctttatctgtagtgggatcttgagtaatgaggctcaagtaaatcctcaatgtgtataattattgcctcataaactctctctttgtttttaaaggaaacatctattatggtaatacaaagaaaagttaaattgtgacagtaatgttatattaacctcttcctactttaaagtgtgaaatgtttcacctcagctgtacaaactccagcattgagaatttgcctcactcattactcctgtgtgacagttatataaatagcatgcagctcacatctgttttagagcatagaagaagcggcacctgccatcttctgaaaactccaaagggaaatttcagtagacatagtgcactaaacccataaggatacttgaccaatatttgagcacagcaagctgacagttctatacagataggcagtgaaagagttttattttccagccaggcgcagtggctcaaatcccagcacttcgggaggctaaggcaggcggatcacttgaggtccggagttccagacaagcctggccaacatgatgaagccctgtctctactaaaaatacaaaaaaaaaaaagaaaaaagttttattatccttactttttttttaacattattattctaaaggtcaaaactgagaagagattaagataggagagagctccataatggctggatagtggtcaggcattctctattcttttccccctgtagacccattctaaatgtgggcctgaggtcaatgggagatgtgccctccctatggaggatgtaagaagcagaggccatttctgccccatgttgaggaaacaatctgttgatagacctggaatttagagtacatctgaaaagcagttggacttcaagaaatttaaaattctctctttgagatggggtggactaagaccacccccaaagtttaaaaatatgctcattcaacttgaatcttctgaggactttttgtgaaaatggtggactgtttagggcataggacagattccccaaattgctttatgcttccacataactagagcacttcaatctatttaagcctttgtctcctaactgaaacattatttctaaatatttctattcaataagttttttcttttttgagcaacttaagtgaattttgaagattgctccttccagtctcgttccttttcacattttcctgcattacctaataattacctcagcgttagaatttgaatgtattaattgatttaaacatcatgtagactaaagtcttaaacatctaagactcagttgtagttgcagaaaaaaattaaagtcacctctactgaaccttggtttcaatttaagatttttcttgcttttcaaaggggtaactaataaagattgaagggtttttttcccgattggtggaggaatgaagaactattgatgcaagtttttttattgtttctttctatgatcaggtacctgctttcattttagactgctacttccaaactaagctagattcttggttttaatgagaggaggcagagagagggaggcagatggaagaagaaaaacagttaaataagacatacccagtcactgcatttttggactataccgtatctttctagcacaaggaaatagataaactgtaaggtcttttttactcactttttatttatgtgttctatttgtgttagtcataactgtttatagtggttgtctaatttttacttttattatatgagatagagctgtgcagatcttcactcaagttctgtcacgcttcttcccattatttagagcacagttttttaaagcaactgtacaatttctcagccttatgagcttgctgtatttcttggtatcatgttgcttccaaattttgtttttactgtagaagacaattaatttattgtagagaagtggctgtgaaagtcgttctctgtctttaaaaatcaattgcagaagttcatttgtcatttttctagagataaattatagtactcaaactggcagtgctcagtatatacattttgtaagctttgtcagtgaaaccatcagttttgcaggagcttcctttcctagtcaagataaagcttaaaattccagaaattaatgtcgttcggactgactttattcatatttccatcaaacttctccaatacagtaagagatagtgttgaaccagcatcaagtctccagaaacatggcagagcagacaggccgttaagtttcacagacatcatagatccttttcttaaagaagaaaaacatgtataaaatagttttagtagtccaaaatgtcaactatctgtagctgcttttgtgtgtgtgtcagtgaacaaataataatgccttgctcaatcaatgcattcagccatctcaagtgcaatttgtgaaggagactatggtttccaaaagatacatttttttacaaagttaaacctgtaaaaagtctttttttttttccctccagccgtacaccaactgcacttggttgtttcagcagttggtatactattaaattgtccaggccaaataggtttctgtagctgttttagtaatttgaagccaaattctcatgctgtttctcattaaaaagaatgagaatttggtccatagttagctttaagttctctcttcctttctttcccttacagttaagggtttggtgggggatggggaggttgttttcgttttttggatttttttgtcttttggctttaagtatcatattttcttttgcctgtatccaactgcttctttgagtattttcatctagtttaatgtgagtaatagatgctgtgctgtcattgaagtgttcaacattttgttcatttaaacaaaagtgtaattcatacatatatagatacatatcttaattgatttctcaactattttataagtaactggaatttttcattagatcttatacagagaagtattttattaaaaattcaaaagggaagacttttatgtgctcattttgtaatttttgattttaaatatctttacattgtctgccaattaaagtgttttaaacttgcattggaatggactccgaatgtatttttgtggtgttacgttatccgtagatttctagcatgaagttagcctcacgatgctgtgcaaaggattttaaaatatgagagtcactgaaagagtttaaacatctgttcatgttaaatgctctatggattttaattaaagacttgagaatgattttaaaaaaaaaaaaaaaaaaaaaaaaaaaaaaaaaaaaaaaaaaaaaaaaaaaaag

SEQ ID NO: 310 - DNA, 2049 bp, Homo sapiens
  ref <308>: DATABASE ACCESSION NUMBER: AL133624
  ref <309>: DATABASE ENTRY DATE: 2001-06-18
gtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgaggccaaccaatcaatggctcagacagataagccaacatgcatcccgccggagctgccgaagatgctgaaggagtttgccaaagccgccattagggtgcagccgcaggacctcatccagtgggcagccgagtacgtgctcctttctcgccttcaccccttggaggacggccggagacagagggtcctgtaaaaccgcggaggttgtcatggctgcagctaggaagtccggactaactggcatcgtctttgttttagctcttgcattgctttgatgctttaaaatccacacataaatgctacatctagctgggcaaggatgggatgcctcccctaagggagccagattgagcagtaggacgccaggtcaataggccgtgtcctggggcaagcagcaagttagatgaccgcgtcacaccagcgtatgcacacccacctcctccctgcacgccttttcccactcccggtggaaagaagggctgggaatctccgaagcttaatctgcctttcttcgttctcctgtctcaccactagatggcagcagtgcagccgggggagggaagcgacagccctgggtggatggggtgggaccagtcctgctagttcactcctttaaggagacacttcctcccctgctgttaaaactcatacttggacccaaccaaagaccctttatatcttgtcttggaggaaattattgttattttctttagtgtttctctgaactgattttgttctgccaacataaagatgtccgcacagtacacactgcattctggggaaaggccaagcagagtgatggggtcctcaggcatggctgaaaacagtgtgcctcaaacacgggtgccttctttcaggagagacctccagaggctgctcagtagatggagcttacacaacaatcgctgcgggcctggattgaagtagctttgcacagaaagcctctcagctatgaaattgctccttggacaaacttgcctgcttgaaactggggaaccaggacttgagacaggagttggaagataactagacctcacggaccattttcaggctatttttactgtttgatgattccctgcttaggagggtttcagtgggaaagtgagagtgagagaggccgttgagagaaagccagtgagttggggaagggaagatgtcctcaggctgaggttgtgagtgggtgtcctgggcagatggtggggagagtgtggacacctttgagaagacacaaaatggcatctaagaggggcctttcggagtctctgggccagtgctgtgctcctggactggattaggatgtagcttttacaattggaaggaaaataagccagtggtgctcataaaaagaaacataaatgggggttgctttgcctagtaatgagccctgtttagttctccattttaaattttatatattgcctctaagattgaactttagcttcagaagactaatttattttggcatagtcagatagacagactttatcttatacgttagtttcaaacccatttgattgttcttgtgctgccgttttatagtaagcaaactgacattgcttagtattgtccctgacatttatggaagaggcattccactattgtagactgcttgctctcgtattgtatcacgtgctataatttttttagacatccatgaaaacttagtttgtagtttaaccacaatgaaaaaggagggcatgacctaagagccccctccattctatccagacatgaaaagcactgctcagatggttgtatgtgacttacttaaaacctgtagcattttagagaataaaactctgcaaagtgtttccaagacaaaaaaaaaaaaaaaaaaaaaaaaaaaaaaaaaaaaaaaaaaaaaaaaaaaaaaaaaaaaag

SEQ ID NO: 311 - DNA, 1337 bp, Homo sapiens
  ref <308>: DATABASE ACCESSION NUMBER: AL133632
  ref <309>: DATABASE ENTRY DATE: 2001-06-18
ggggaagaggaggagtgcccgatctgcacagagccctacgggcccagagagcgccgcctggccctgctgaactgtagccacggcctgtgtgtgggctgcctgcacaggctgctgggctcggcctccagtgccgacctgggccgggtgcgctgcccgctgtgccgccagaagacgcccgtgctggagtgggagatctgccggctacaggaggagctgctacaggccgacgggccctcacgccagccccgccgagaggcccctgcatcctatcaccgcaaccctgggccctggggctccctggagcaccgctaccagctgcgcttcctggcagggcccgtgggcggccggggctgcctgcccttcctgccctgtccaccctgcctgggtgcccggctctggaccctgcgggagcggggaccctgtgcccgccgcctggcgctgctgagcctgctggcccttgagcttctggggctgctgctggtcttcacgccgctcctgctgctgggactgctcttcgtgctcctggaccgctctggccgctgagcagagcccaggacagccccgccgccaacaggccagggggcccagactggcccacgtccccatgcctgggtgctgtgaggcctgatgaccaggctggaaaaacccaaggttgggtccagggcagtggccttcaatcaagacctcccattgctgaacccacaaccagggctacccagaggcctgaccctgccagagtccatggctgcactgctgcccagacactagctgaacccaaggacaccagcgcccaaggacagctcctggaggaggccagcccagcaggaaagtctgtgagcaggaccccattcaccctgcggcagacgggcaccgtactggccacgggctgacgccggccacacttcccctccgagggccagctgagcacagcaggcatgaaagcaaacagagatacagcagtgagtcagttccttggagagggcagggactccgcccaccctgtgttcagataagggccagtgtgtgtccctgaaggtcaggccagccgggggaggggtccatgctgcgaaaattcagcctgcaaaggctcctctccccacttgatcaggcccagaccaggtgggggttggcgctggcctgtgttgcaggggacaagggcccacccaggccttggaacataagctctgcccctgcacaccctcatgtcaccacacctgggatggagacatcaggtggcccagcgagagatggaggactgatcctggaacgtgaagcagctttcaataaaccagctcctggggaaaaaaaaaaaaaaaaaaaaaaaaaaaaaaaaaagg

SEQ ID NO: 312 - DNA, 2518 bp, Homo sapiens
  ref <308>: DATABASE ACCESSION NUMBER: AL133644
  ref <309>: DATABASE ENTRY DATE: 2001-06-18
gggtgcgctcggccgtggcgcacctggtgagctccgggggcgctccgcctccgcgccccaaatccccggacctgcccaacgccgcctcggcgccgcccgccgccgctccagaagcgcccaggagccctcccgcgaaggctgggagcgggagcgcgacgcccgcgaaggctgttgaggctcgagcgagcttctccagaccgacctttctgcagctgagccccggggggctgcgacgcgccgatgaccacgcgggccgggctgtgcaaagccccccggacacgggccgccgcctgccctggagcacaggctacgccgagtgagcgccccctggggcacccaaaccaggatggggctcccacccctctccccagctccgcatccccggcgctaggacgcgttccccacgccgcgtccgggccaggagctcccttttccgtggacctttgctatcctctggtcttcgggccgcaccccctcccaacccattttccagtggggggcagcctgtgtcaccttcttcacgtccttcccgctcattgactgccctcgcccacgccgcctcaggaccctgttctgccccagagcccggagggcggagagcccggcgaaggatgagttggccagttccccgtcgcggcccggcagcttaaaggctaagggaaaaggggtttcacgaaggagcggggttctttttaataggggacatagcggttgggaagactcgctcacccgcttcccggctccagcgccccagttccctgtccctcttaccgtagttcccctccccctccacacccagaaatagcccgcgacaccaggaggccgccagcttccccaggagcggggagggggacgcccggggtagaggagggtcccatttagatgcccttcagcctgccaactcgtgctggcctggcaaagaagcggaccccctgcccggagcggccggctggcccccgggctgtgtgtattttaaatgcatctgccgggaacgcagagcaccgagggagatgggggcgctcagttcgctgaggaaggtggctggtggcccatggacccaccaccacctcccttagcctcctgtgtgggaggagtttatgggtatgtggctcctgcccagtccaggtgggctttcacttctactctatttcagttcctctttcccgatctgggctggagagcttcctcattgttaaggcagcagaaactttcgctggatggttttaggataaggggtcatcaatgctggcaagagtcggcacaatgaggaccaggcttgctgtgaagtggtgtatgtggaaggtcggaggagtgttacaggagtacctagggagcctagccgaggccagggactctgcttctactactggggcctatttgatgggcatgcagggggcggagctgctgaaatggcctcacggctcctgcatcgccatatccgagagcagctaaaggacctgaaggaagtgagccacgagagcctggtagtgggggccattgagaatgccttccagctcatggatgagcagatggcccgggagcggcgtggccaccaagtggaggggggctgctgtgcactggttgtgatctacctgctaggcaaggtgtacgtggccaatgcaggcgatagcagggccatcattgtccggaatggtgaaatcattccaatgtcccgggagtttaccccggagactgagcgccagcgtcttcagctgcttggcttcctgaaaccagagctgctaggcagtgaattcacccaccttgagttcccccgcagagttctgcccaaggagctggggcagaggatgttgtaccgggaccagaacatgaccggctgggcctacaaaaagatcgagctggaggatctcaggtttcctctggtctgtggggagggcaaaaaggctcgggtgatggccaccattggggtgacccgaggcttgggagaccacagccttaaggtctgcagttccaccctgcccatcaagccctttctctcctgcttccctgaggtacgagtgtatgacctgacacaatatgagcactgcccagatgatgtgctagtcctgggaacagatggcctgtgggatgtcactactgactgtgaggtagctgccactgtggacagggtgctgtcggcctatgagcctaatgaccacagcaggtatacagctctggcccaagctctggtcctgggggcccggggtaccccccgagaccgtggctggcgtctccccaacaacaagctgggttccggggatgacatctctgtcttcgtcatccccctgggagggccaggcagttactcctgaggggctgaacaccatccctcccactagcctctccatacttactcctctcacagcccaaattctgaagttgtctccctgacccttctttagtggcaacttaactgaagaagggatgtccgctatatccaaaattacagctattggcaaataaacgagatggataaaaaaaaaaaaaaaaaaaaaaaaaaaaaaaaaaaaaaaaaaaaaaa

SEQ ID NO: 313 - DNA, 1644 bp, Homo sapiens
  ref <308>: DATABASE ACCESSION NUMBER: AL133645
  ref <309>: DATABASE ENTRY DATE: 2001-06-18
caggctttcagcagccacccctacactagtgggcccagtgcctgcaccagctccttgagcttctccctagtggggagcttcactgtgcagcttctggggtggcctgggcggaggctatggtggggccagcagtatgcgaggcatcaccaccatcacggtaaaccagagcctgctgagcccccttaacctggaggtggactccaacatccaggctgtatacacccaggagaaggagcagatcaagaccctcaacaacaagtttgcctccttcacagaccaggtatggttcctggagcagcagaacaaggtgctggagaccaagtggagccttctgcagcagcacaagatggctgggagcaacatggacaacatgttcgggagctatatcaacaaccttaggcggctgctggagccaggagaagctgaggctggaagcggagcttggcaacatgcaggggctggtggaggacttcaggaacaagtatgaggatgagatcaataagcctacagagatggagaattaatttgtcctcatcaagaaggatgtggatgaaacttacatgaacaacgtagagctggagtctcacctggaagggccgactgtatgaagtggagatccgggagctgcagtcccagatctccaacatgtctgtggtgctgtccatggacagcagccactcctggacatggacagcatcatcactgaggtaaagaggcagtacaaggaggttgccaactgcagccgggctgaggctgagagcacgtaccagatcaagtatgtggagctgcagacgctggctaggaagcacagggatgacctgcggcatacaaagactcagatctccaagatgaaccggaacatcagccagctccaggctgagattgagggcctccaaggccagggggcttccctggaggccaccatcccagatgctgagcatcgtggggagctggccgttaaggatgccaatgccaagctctccaagctggaggccactctgcaacgtgtgagtaccaggagctgatgaaagtcaagctggcctggaaatggaggtcgccacctacagaaagctgcgggagagctaggagagccagctggagtctgggatgcagaacatgagtatccatacgaagaccaccagcggctatgcaggtgatctgagctcggcctatgtgggcctcacaactcgtgacctcagctatggcctgggctccagctttggctctggcacaggcttcagctccttcaggtgcaccagctccaccagggccgtggttgtgaagaagatcgagacccgcgatgggaagctggtgtctgagtcctctgacttcctgcccaagtgaacaactgtggcagctcctcctagtctgcccctcccgtggctgccacagactccaggagggaggctgctgtgtggggaagcacagacaacaggagaccccccacctgaggctcaacccacccgtgggggagtttactgtctggggaccccccttgcccatgcttccagctagaaaacaattgtggttttttttttggtccaaaataaaacctcagctagctccaccacaaaaaaaaaaaaaaaaaaaaaaaaaaaaaaaaaaaaaaaaaaaaaaaaaaaaaaaaaaaaaaaaaaaaaaaaa

SEQ ID NO: 314 - DNA, 2051 bp, Homo sapiens
  ref <308>: DATABASE ACCESSION NUMBER: AL133651
  ref <309>: DATABASE ENTRY DATE: 2001-06-18
gcagagcgggccggccaagagcccctcaagaccatcctggatgcccaggacctggattgctactttacccccatgaagcccgagagtctggagaactccattctggattcactggagccacagagcctggccagcctgctgagtgagtcagagagtccccaggaagctggccgcgggcacccctccttcctgccccagcagaaggaatcatctgaggccagtgagctcatcctctactctctggaggcagaagtgacagtcacagggacagacagccagtattgcaggaaggaggtggaggccgggcctggagaccagcagggcgactcctacctcagggtgtcctccgacagcccaaaggaccagagcccgcctgaggactcgggggagtcagaggccgacctggagtgcagcttcgcagccatccactccccagctccgcctcctgaccctgcccctcggtttgccacgtcgctgccccatttcccaggatgcgcaggtcccacagaagatgagctgtccctgcccgagggacccagcgtccccagcagctccctaccccagactccggagcaggagaagttcctccgccaccactttgagacactgactgagtccccctgcagagctctgggagacgtggaggcctctgaagctgaagaccacttcttcaacccacgcctgagtatctccacgcagttcctctcaagcctccagaaggcatccaggttcacccataccttccctccccgggcaacccagtgccttgtgaagtctccagaggtcaagctcatggaccgaggcggaagccagcccagagcaggtactggctacgcctccccagacaggacccacgtcctcgctgcagggaaggctgaagagaccctggaggcctggcgcccaccacctccctgccttacgagcctggtcctgtgtccctgcttcctccgtgctgcccacagacaggaatctcccaacgcccacatctgcacccaccccaggcctggctcagggtgtccatgccccctccacctgttcctacatggaggccactgccagctcccgtgccaggatatcacgcagcatctccctcggtgacagtgagggccctatcgtggccacactggcccagcccctccgtaggccatcgtccgttggggagctggcctccttgggccaggagcttcaggccatcaccaccgcgacaacacccagtttggacagtgagggccaagagcctgccctgcgttcctggggcaaccacgaggcccgggccaacctgagactgaccctgtcaagtgcctgtgatgggctcctgctgccccccgtggatacccagcctggcgtcaccgtccctgcagtgagcttcccagcccctagccctgtggaagagagcgccctgaggctccacggctctgcctttcgcccaagtctcccagctcctgagtcccctggccttcctgcccaccccagtaacccccagcttccagaggcccggcctggcatccctggcggcactgcctccctcctggagcccacctccggtgcacttggtctgttccagggcagccctgcccgctggagtgagccctgggtgccggttgaagccctgcccccatctccccttgagctgagcagggtggggaacatcttgcacaggctgcagaccaccttccaagaagccctcgacctttaccgtgtgttggtctccagtggccaggtggacaccgggcagcagcaggcacggactgagctggtctccaccttcctgtggatccacagccagctggaggctgaatgcctggtggggactagtgtggccccagcccaggctctgcccagcccaggacccccgtccccaccgacgctgtaccccctggccagcccagacctgcaggccctgctggaacactactcggagctgctggtgcaggccgtgcggaggaaggcacgggggcactgagggcgcacctccaccgcagccctgctgcttctgaggacttaggtattttaagcgaataaactgacagctttgaaaaaaaaaaaaaaaa

SEQ ID NO: 315 - DNA, 1035 bp, Homo sapiens
  ref <308>: DATABASE ACCESSION NUMBER: AL137295
  ref <309>: DATABASE ENTRY DATE: 2001-06-18
ttttcttttgagaattgctttctttagtgttaagacctactcatattttgaagaaatcttgagttaagtgagttctgaggctgctgggggaaccagatcaattcaaagctaaatacttctttcagaaaggggccactgtggaaagtgctggtggggtttgcccttgatcaagtgcctccattgtgctgcaagggctgtagacagcagggtgggacagtcagtcctccgagcagcaggaatcatcccgtcacctgcagccttcccatgcttccgcctttattcagaactttctgtgccactgtagatagctcaggcaaaactattacctgggtatttatccactaatgagtcacaagaaaaggagtggatttggtaagaatagagatttgttttatttaaaccacttcccattactgaccattaaaagctcaccactagagttcctgaaacaggtgaaacctgtatgacagcccttccactttggggagccacgcttttgatgtgacagtaccgcagagtgattcccccactgaggatgtcatcatcaaactcttctttggtgtgtgaattattagtggaaaagacccagctgtaattagacctccactgtgtacttagctggaagaacatgttaattctgcaatatgtttcttggttaaacattgcacagttcttacctcatttctgtaaataaagttttgtgaatctgttttgtattgtgacaaattcataagataacattgatattttgatttgtaatatttctaattggtagatttaattgaaaagtaaaattaatttatttttatatgttcaggggaattttaaagtcaaatcttttgtagataatttaaaaaatcagtgtggtttattttacttatttaacccactggttgttattctgtaacagtttgtataaatggtaaattttgaatgtgttgttattttacctagatgtaaaattccacatgtattaaaatgtacaaaatgttttgttaataaaatttaataatgttaaaaaaaaaaaaaaaaaaa

SEQ ID NO: 316 - DNA, 3758 bp, Homo sapiens
  ref <308>: DATABASE ACCESSION NUMBER: AL137310
  ref <309>: DATABASE ENTRY DATE: 2001-06-18
gggctgtgtcatccgggattgttggaattttgcatgtgtctgttccatatcccgctggtaaccagcttacagaccttctgtcaggttggcttacattatcatcaacaggttgccgtagtgatgatatgatgctggacacaatcattgtgcactttgttaatttggtatggtggtgccacacattatcactgtacagcattaacaaggctggaatatggccctctgctgtagggggcgtggcacctgtgacttgcactggaataagtaggaggctttccccaaaggatatggagactgatgtgtgctccatatcttgaggggagctctcttggtttcctttggccgggtctgttagttacttttgaaggccatgccaacccttttaggccattaaatttttctcaaacaatagccagcctcatttctgcttcatctctgtggtaggaaccattccctactcttactccctcctcttgtccaacttccaccaaacactcaatccgagtcctggctgctttcttgcttaggtctgtggctggtaactgtggtgaaagagtcaaggtgggcagtgtttggggtaggaaatgagtagtggtgaagcagcagcagtgtgtgtgtgggtgtgggtgtgtgtgcatgcgtgtgcatttgcatgtgtgtatgttgacaaatgagagtgtagccataagatttcattgttactactagtctttgtgtacctatctggagggacattaaaaaaatatggccattctcccatctagggggttcccatctcagacttctctgataagagtaatttgagaacaaatacagattcatctatgggaaaagatgtttaaactcagcatgaaggagaaacaaatttaggagtggaaagcaaggcaggtagttaggtgatttccatgaccacatttgcttgggccagggaagtggtgcacctcttttataacaatgggagatttcagaaacagtttgagtgttggcagaccaatgccctgataagcttgtggtatagaggtaggaagggagggaggccagagattagataaaatgatggtgggtgggatcttagctctaaatgaaaagaactggacttactaagtgggtggattacttgctagccataacttttagggaagggtaggtctggagagaaggtgaagaccagcagaaatatactgtgaaattgccaaatatgtttggttgcagaaaacacagcctggctctttgtggctagatgtgacttccaacttctgaagacaggattgccaagagatgtgatctttccacatacagctcctgtccccatctctttatgtgtagagacctggatttggggtagtggggtagtaaaccatatatttccaaaagatggtgtgaagagtcgtttctcttcgtctgggatgtgattggcttttgttttttgttttttgtttttgagacggagtctcgctctgtcgctttgtcaccaggctggagtgcaatggcacaatctcagctcactgcaacctccgcctcctggcttcaagtgattctcctgcctcagcctcctgagtagctgggactataggcgcgcaccaccatgcccagctaatttttgtatttttagtagagatgggatttcaccatgttggccaggatggtcttgatctcttgacctcatgatccacccgccttggcctcccaaagtgctgggattacaggcttgagctactgcgcccggccagtgattggcttttaaattaatcacaaatgtttgataaaattctggtatgtgctaagtcccaggcttggttgatatctcagactatgatagctgtgaccttcaagaaatttctggcttggggaatctgtagtttctggttgtccaaaaaagatagttcttagtcctactttattttctacccactcaactctccagacttccctcttagtaaaggaattcataattctccctgcatcttctctgtttatttcaatgtccatgttctgagtctcaagttttcctgaagcacaggagcaggcttggccccagagcccctggctttttcaacgagcatcagaaatgctatcaatatattctctctgttgctttatcagcttctctaaatttattttgtaaggaagttagcacctccttccaggactttaaacagttgtctttgccaatttgttcctggattttccttgaacttctcaggtttccaagccacatcctagcagggcatccaggagccttgcactgaacctctcagctcttttgactttcttctggtcataggtgttgggcctcccattaggtagaagtcctttgagcagacccgaaatggccaaatgagacatcatccaagttcctccctcctttactgtctcggctttttcaagcacccctttcacctctcttttctgccttttcctcagtctgtcaagttctttggaggaaagaagttcttggtcagaggtcctaaaaccaccaccagctgggggtgctgagaatggtgaggagttggacagtcccggggcttttttgaaaggggactttatggtcatttcccctgtttagggtgagggactaagaattctcaagccttcagtttcatccatatttcaatgtaagcagaaaagcacatctcaaagccaaatagaaatgattttctactaagcctatcctttgtgattcttggttcccttggtctcttaatattaattatagagaatgggcagttgagtcagttaacatcttttcatcagaaaggagggtaatattcataaccaaaagagatgtaaaggaagtatattactgcttgaagtgtgaaaagaggaaaggagtgttatgtgaaccttttcagtagggaaattcagaaaatggaatgattcatccataggcataattcttttaggagattctgtgctcaaagggaagggaatggtttctgatccttctgaagagaaaaggaatagcatttttcttaaacctaacccagtttcagcattggagaatacagaactttttcttctagctgatggcattaatatttcttgagagagagaactcacccatggcacttttctgagcccagcagaaatcagcggagcttgggcttcgcttagcaggtttgcaattgacttcaacatgcaggcttttcacatgtgcaataatgctggaaacagaagcaccaaactgattgtgcaattactccttttgtagaagaggccaaaatcctcctcctccttcctttctcctatattcactcctccaggatcataaagcctccctcttgtttatctgtgtctgtctgtctgattggttagatttggctccccttccaagctaatggtgtcaggtggagaacagagcaaccttccctcggaaggagacaattcgaggtgctggtacatttcccttgttttctatgttcttctttctagtgggtctcatgtagagatagagatatttttttgttttagagattccaaagtatatatttttagtgtaagaaatgtaccctctccacactccatgatgtaaatagaaccaggaataaatgtgtcattgtgataatcccatagcaatttatggtaagaacaagacccctttccctcaccaccgagtctcgtggtctgtgtctgtgaaccagggcaggtaattgtgacactgcatctcatagaactctgcctgcccagatttttgtgtgctcacctcaatgggtgaaaaataaagtctgtgtaaactgttaaaaaaaaaaaaaaaaaaa

SEQ ID NO: 317 - DNA, 2295 bp, Homo sapiens
  ref <308>: DATABASE ACCESSION NUMBER: AL137316
  ref <309>: DATABASE ENTRY DATE: 2001-06-18
acgaccactacatgtacttgaaccatggacagcagacgatcccgaacggactgggtatgggggggcagcacaattactttgggctttgggtggatgttgattttgggaaaggacacagcagagccaagcccacgtgcaccacgtacaacagcccgcagctgtcggctcaggagaacttccagtttgataagatggaggtgtgggcggttggagacccctcagaggagcagttggccaagggcaacaagagcatcctggatgcggaccctgaggcccaggccctgctggagatcagtgggcattcgcgccacagcgaagggctccgggaagtcccggacgatgaatgaggagccgcctgagccttcctggagccaggacctggattcctctgggtagagggcaccgcctgcagcccctcttccctcccacatggtttaactgtaatagcgtaccgcacgggtcacagcctggtagtcccacatgtgccaagaagacgccctctgaagccatgtcctgactcatgggtggatctcccagaaatagatgttttttaagttttcttttttgccctacagggtcaccctcaggatctctccaagaaatcttgtgtcaaattagtaactcagtcttatactttgttcttttttaccaacgaaatcctaagcagctgagacctttcagacccccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagggaattccgctggcattagcattgctgggatctcaacttctctattgaggagggggttcctcccgctggggttcatatggcctcactcaggccatccctgttagaaggtggtacctgatggtctgttctgacgggtgagggacagaggcatctggatgaaaatctcgacgctttctgggaacagcttccaatggcatgggagttctgtatttaaaagcatgaactgtgtataaaatggggaaatggaggcaggagactttgaggtaacatggtctggtggtggcatgagtcctcagaaggtatttgtaataaggttccacacccagctctctcagctgtttttaaatgaatgtgtgtgaggaacagatgggaaagttgggagatctgtctacagagaagcaaagttgtggttctcttgctaacttcaaggtgagggacattgggcaccctaagtttgggaacttggttgataaatacgtatatggtccattccataaatcagtggtgagtgactggcctgggttctagacctctgggaaccagcacctgagtcacagctgtctaggcctcggtgctggcctgggttctagatctctgggaaccagtgcctgagtcacagctgtcagtgcagccatttgcccagggctgctcccgagggggatgatgggaaattcagcagtgtagactcactttaaacaagctccggtgatcctgaaatgctgaagatcgtgtaggtgggttgtggggtcagcagagctgccatctgcccacgtctggaaaacaacacacggtgagtcaccggttggccatgagatctccccacttaaaggtgctgtgagcttgtctctaagatatatacctcttccttttgtcttttgctgtaagctttgaccttttgcagatctgatgaaaatacaacctcttattgtatagtttgccttgattataagccatagtaaatcgagctgttcgcatttttgcaggccttgcattttttactgggaggttcatcaaaccttccatttagcaatagccctgactcaggcagaatgcctcataaattagccttcgaaagaaaagtgcacgctcagacagtgtgtggaggggcaggagcgtgatgcagacaaggacttagtcatgactgattttccttagccagtttgtaatggcttatggggaacattgtgagcttcctacctgacatgttggcagaagtagaatattaggatcctcaagcatctctaccgtaagtccaaagaatttaggtccctattgtcactttgttttgcaatgttttttataaaaatgcaattaaatacctcactattaaactgccatgatgccttcagtttaaaaaaaaaaaaaaaaa

SEQ ID NO: 318 - DNA, 1721 bp, Homo sapiens
  ref <308>: DATABASE ACCESSION NUMBER: AL137332
  ref <309>: DATABASE ENTRY DATE: 2001-06-18
ttttttgcttcaaatgatttgcactaattgattttctggagagcggagttacgttaacaacaaaattcttttatagttcctttgatactatttcaaataaggattacacattgaaagtttttatagaaattatgaaaattggataatcttaactatggtaaccattactattatccatactactttctccccactgaactttcaaatttgaaaattggggtagcttttgtaggtcactttcttataaagatgctgatggtcacagatctcctaagtatccagaataatatttttatcatgagaaggattccacacaaaattggggtcttgcaccccatatttcagaggatctgaacagaaattgtggcttcattgcacattttaaatctctgtagattcttgaaatcacccaacctctcacatttgaaaacccaacggcctggagtattctggtggcactggagccagcactagctttttggaatccaagtggggagagaaacaaaaatagacttttcaagggactgtcccagactacccagggcaaatgtcttcccttcccttcctgaagccacaggaaagcaccctggagtcctttgtataccactatggaaatttttaaggcaagctctcaagacttgaagagttggaattctcggcatttaaatgatgcctgaagtttgttttgaaaaagcaatatttcattgctcttttcaattgtgaagcaactgctcagcaaatattactcatttttttaaaaagttgaattaaagggaaatatatttttaaaaccaaaatagatcaaaatgatcccagttttaagggattttgcctattttggaagaataaaactaaaatgttaaaactgttgaattacagagaacagatgtactctgagacataattttaaacaaatatttaaaataaggcaggttaacatttgcgtttaggcaataaatctgtattaaagggaagcacatcaaggaaatatatacatgttgaataatgtaactgaaaaatattttttaaaaaccacttaaaaagaaaaataatttgatgggtactttaggcattgtagatagaaattaatgtataatagtgtcctcccagtctttgtatgaaaaattaaaactctctagtcctttaatgagcatgaatttatacttctacatttgttgcttagtaaaattatactcagtactttgagttattcagatttatgtttaatattgttaaattcttcatcagagagcataaatatattgtcttctatactttgtaacttgtgcatatctaaagaaactaacaacgaacattttgggagatgtttttgtgtttttttatagtagagttttagagtacatttgtcttaataggaagtttttaccataaacccaagattttatttcacgtattgttgctttctcttatatggaacttattgtgtacctcttacctttatttctaatcatttagtgatactaatcttttcatagtaaatatatttgtttctaattgtattcctagagtttacattcctaaagaataaacgacgactttggctatttttgtgtgttccctaccttcttaaggctatggaaataaactggagtttagttttttgaatttttgtatatttgtgtaaatgttctccatatgtagtacttgttatacaacaagtgttgcctcttgttttattgaaataaaaactgaaaaaaaaa

SEQ ID NO: 319 - DNA, 1642 bp, Homo sapiens
  ref <308>: DATABASE ACCESSION NUMBER: AL137342
  ref <309>: DATABASE ENTRY DATE: 2001-06-18
tcttaataatgtgtgtgtgtgtatgtgtgtgtgtgtgtgtgtgtgtttgtgtgtgtgtgtgtgtgtcctaattaagagaatttttactggctgcttgttacatttgttgagggtacaacacactcaagaataaagtaaaaggatagtcaggatccagatgtttcttttctagcatttaatgtgtgtgaactcagaacactaccatgaaagaacacttccccccaaaactggatgcagaggaagaaaaaaaaaaaaagaaatggcacagttttttgtatttttttttttagttattttttgttgttgttgtttgtattgtttctcttttctgatagagtatggccacttctgggggaaaaacatgtaattaagtaaatgtatacattggttttcacgttttacttttgttttcccactaccaataattttcctctggaagaattttatagttttttctatttcattttaatgagtaacaatatgttaaatgcataattaagacaaagcaatgaaattctgactttattcaaagtactgaagattattgcttctagggcatttttaaacagcaccattgtattgttgaatgtttatgtaactgatggcttttctataatgtaatttttgaatgttcaggtgttacatttccaaagtttaacttttaaaaaaccatcttctgatcccttttattgtctgggccatacaatctatattacataggtgccaacatttaattcttttaaatggaacatttgcagttttccatattggtacctgctttttctggagaggtttgagatcttgttaacaaatcagactttacactatatacagatgtgacagataaattgaaccacttgtttgtgaaaatgagttcctgtcatcttcctcattcactcagccctcaccccagcagccttttccggtcattgtagctgacatggagcagtgacagtattcatttgagaacagggatgcaagtcacagacatcataaaatcagggtctccctgctgaagcattcactagttggcaactatgaatttattccatgtcattctgtttacttagcacttgcactacccttgttggttgagtgtatgctttatttgtttctagtttgaaatcccacatctgatagctgagagtaggcaaatacaacatttacctaatgtcattcactaacatggaagagttgtgaaaattctagagtgctgtaaatccttggcatacactatgacaaacaacttcattactctcccaccaggagctgctctcctgcacttagaaataatgtcacaagtagttttctaatgtacaatgcagacaaatgtactgctctctgaatacttgaagaaatggtattatacatacatagaaacttattagttataccttttcacaatcttattacgatgttgccgttaaaagggaaaaaagacacaggcaatgaatggtgggatagtaagaggacttagagtgtatgaatgagttgattttacttttttggaatttgattaagttgacagtaggcactgattggatgattaaacataagttaatctccactgtgataaaaacttaaataataaacatgatttaaaatagaaaaaaaaaaaaaaaaaaaaaaaaaaaaaaaaaaa

SEQ ID NO: 320 - DNA, 1537 bp, Homo sapiens
  ref <308>: DATABASE ACCESSION NUMBER: AL137347
  ref <309>: DATABASE ENTRY DATE: 2001-06-18
cctaggccccgtgatcaccaccccctcaagcggggccccagccccctgagcaccccctcacgtgacccagccctcggctgttccaggctcactgcccatggtgtgctcttctgggccacagcagccagggctccagggcgaggacaggggacacctgaaaacaccccgttgttcatggtcttgtgcccattcattcggagactcctgaaaaactgggctgtttgcaaagcaaatccagctccttgtcctagcaggttctcagaacggggagtcccctgggatggagctgctcccctcacggcagcaccacgtttccagtccctcgatgccactaatcagcatggactgtgttcaggacacagggtgaacttttctctgacccccggtgctggtcctgtgccagcacgtagtagttactcagtagaggtttgctgagtaaaccagaaatcagattatgagtgttcaggggtttgataaaacagcaccacataacgcacacaaagatactccagaaacatttgctgagtacctagtacgtgtgaggtgctgtgaggatagagcagagaggactgtgccccagctgtgatgctggcagaggtgacactaagagggaaatgagatatttggggcagaatccactgggctctcttggccatccgctgccttgggtctgttgaggtgggtgccaaaggctgccttcttgaccagaacctgctgtgcgcttcacagaacctcctcttcattggaaatgctgggcacattgcagtcagtgagctgctgccaaaacggcgttaagtagaacccccagaggccccgccggttggtgatcaccctcaggtcctgccagggagacacagtgaggaggttggctaattgctgctttcaggccctggaaatcagtcgccaaggcccaggagaaccccggtgagtccgtccagttgaggcagaggcaataacctcccattgctcggccctgcgcctgccccagtcctggcagggggcaccggctcaggaacatgcggcctcctggcatttctcggtatttaactgtctcgctgtcttatccgagtccctaatgaaacgacttgtgtgacaatctgtctgtgccttacgaaagtgtctgtgcactttttatcctttttaaaagcaacttttaaaagtggatggggaggggggctagcatacgtggtagggttctagaaatctgtggtcatcgctgaaatcctttttgcatcatgttttttgatgttggagtgatgaagtgtacatcccccaccccacacaccactacctgtgtacagacctttaaaacatgtcttctttttctgattcaatactgtgacctctccgatacagtctaatccttggggatctgtaatcaaggttttaaaacctgggaagtgggttgggaagggtttgcactggtcttgagtgttgtgcttttctgtgtgtgtgttttgattttggtcttttatctgttttatattgacataattttcctgtttaaaaaatacaactttggcttgttaaaaaaaaa

SEQ ID NO: 321 - DNA, 1379 bp, Homo sapiens
  ref <308>: DATABASE ACCESSION NUMBER: AL137362
  ref <309>: DATABASE ENTRY DATE: 2001-06-18
gcccttcggacccagacaggaggaaccataatggcggggaagctggctgtggagcgaggctgggccatcaacgtggggggtggcttccaccactgctccagcgaccgtggcgggggcttctgtgcctatgcggacatcacgctcgccatcaagtttctgtttgagcgtgtggagggcatctccagggctaccatgcattgatcttgatgcccatcagggcaatgggcatgagcgagacttcatggacgacaagcgtgtgtgacatgcatggatgtctacaaccgccacatctacccagggtaccgctttgccaagcaggccatcaggcggaaggtggagctggagtggggcacagaggatgatgagtacctggataaggtggagaggaacatcaagaaatccctccaggagcacctgcccgacgtggtggtatacaatgcaggcaccgacatcctcgagggggaccgccttggggggctgtccatcagcccagcgggcatcgtgaagcgggatgagctggtgttccggatggtccgtggccgccgggtgcccatccttatggtgacctcaggcgggtaccagaagcgcacagcccgcatcattgctgactccatacttaatctgtttggcctggggctcattgggcctgagtcacccagcgtctccgcacagaactcagacacaccgctgcttccccctgcagtgccctgacccttgctgccctgcctgtcacgtggccctgcctatccgccccttagtgctttttgttttctaacctcatggggtggtggaggcagccttcagtgagcatggaggggcagggccatccctggctggggcctggagctggcccttcctctacttttccctgctggaagccagaagggcttgaggcctctatgggtgggggcagaaagcagagcctgtgtcccaggggacccacacgaagtcaccagcccataggtccagggaggcaggcagttaactgagaattggagaggacaggctaggtcccaggcacagcgagggccctgggcttggggtgttctggttttgagaacggcagacccaggtcggagtgaggaagcttccacctccatcctgactaggcctgcatcctaactgggcctccctccctccccttggtcatgggatttgctgccctctttgccccagagctgaagagctataggcactggtgtggatggcccaggaggtgctggagctaggtctccaggtgggcctggttcccaggcagcaggtgggaaccctgggcctgaatgtgaggggcggtcaggaaggggtacaggtgggttccctcatctggagttcccctcaataaagcaggtctggacctgcaaaaaaaaaaaaaaaaaaaa

SEQ ID NO: 322 - DNA, 1071 bp, Homo sapiens
  ref <308>: DATABASE ACCESSION NUMBER: AL137381
  ref <309>: DATABASE ENTRY DATE: 2001-06-18
ggccctcagctatgctcggcacttccagccctttgctcggctgcaccagcgggagatccaggtgatgatgggcagcctggtgtacctgcggctgggcttggagaagtcaccctactgccacctgctggacagcagccactgggcagagatctgtgagacctttacccgggacgcctgttccctgctggggctttctgtggagtccccccttagcgtcagctttgcctctggctgtgtggcgctgcctgtgttgatgaacatcaaggctgtgattgagcagcggcagtgcactggggtctggaatcacaaggacgagttaccgattgagattgaactaggcatgaagtgctggtaccactccgtgttcgcttgccccatcctccgccagcagacgtcagattccaaccctcccatcaagctcatctgtggccatgttatctcccgagatgcactcaataagctcattaatggaggaaagctgaagtgtccctactgtcccatggagcagaacccggcagatgggaaacgcatcatattctgattcctacctggaaggaattttgttgaaaggggttttcacctgtgagccttggtctgtctcggtagggtggtcaacttcagtggactgtggttggtttcagagcgcctggctgaggagttccactgaggggagcactggagcagccctttggcagaggctgaggagggagatggaccagcccacgcctggcacctggctccatggcataaggaaagggagatgctggcctctgtgctcctgctgtcttttcctgtttctgtttgcgtttgacttagtagcaaccgacagagtggcaagggatttggtcttcagcagtagacatccttccacccctgccctcagccaagtctcttgctgccatgccaatgctatgtccacccttgcccctcggcccaagagtgtccagcggtggcccacctcttcctcccactacagcctcaacagtatgtaccatctcccactgtaaatagtcccagttagaacggaatgccgttgttttataactttgaacaaatgtaaaaaaaaaaaaa

SEQ ID NO: 323 - DNA, 2480 bp, Homo sapiens
  ref <308>: DATABASE ACCESSION NUMBER: AL137407
  ref <309>: DATABASE ENTRY DATE: 2001-06-18
gagatttgctggtgaagtcagtgacgaaaaaataaaccttcccttatcttcctactctgcccctccccctaatgaaatcatattaagttgttttttttttttttttgtaatatacagctttttttttaaggcatcattttcgagggtctaaaattatctggtaaaacaaatgaaattaagtgatccaaagctgctgaagtatgtttgaactctccagtgccctatagctgcaagagttgaattagtcatgcagtcatatggcagcaggttggtgattcagtccgaccttctttaggtaaccgagcatttatttaaccaactataccactgcattgggacgtctgcacttgagcttctacaatctgatataaatctgaatacaggattattctgtttgaaaactttgctatgtgtgaactgtaatacttgatacatttttggtttgaagactttgtctaagcctcattatactgaagttgaagaaaccaaatgagctccaccctcactttgcctgccctgatatgatcacttgttgagtcactggagttcctttcattttggcactgatgctgttttctcttgtctgatttgaaacagtactggtaataatatggttgttgaaaatgtgatcacctttatctaaagtgggagaagatacatacacagtatggcaaatggataaaatattgtggcatcaactacttttaaagtagaaaagctatccattttatacaatcactgatacagtctatgtcaaaaaaccaacagaccattattcctcttgaagttagtttgattttatctttgtatggttgtctacaatttgttttcctgtaaatgcagatagttaaaatctaaaggatagaatgctttcctaaaacagaacattagcctttaaggttaaatagactttacattgtatctaagttaatctttataaagcactagaatttttggtcaaaagtcaaaatagtattagaatattgaaattattgatagctttcataatctcagcttttttgaacttccacaatttttggaatatgtcataatttttttccctgtttcaaatgtgttcagaggaaatagaatgtaaaacatcacaaaaaaaattgcagtacataaaatttctggactatgttagttacttgatctggaagtttaaaatttggactaaaaggttttattgaaataaagcctcttaaaatgaaaaatcatatacttttaacatcacttttaagctaataaatataagaattcttttggaaattagaggtggaaacacactggaacctcatgataattgaccctctggatcaccagattagtttaatttaacagatatgtccaaggaagttgagctatagggagtaagaaaaagcatcatgataacgtctagtcaataacatggcacttcagcagagattcatagatgatggtatgcccatgcatcatttgctcttcaaatatctatgtgcttggagccacagtttcctaagcgcatagtttttggtcctgcctcatgtaaaatagttaatgattatcatttacttggaaagattttacctgtgaagtgaaattctttcattgggggtaagggtatgaggtgatcaggaagtttcttctggaattttatcaagtccttgtattctaaaatagccaagcaaaatgatagtaaattctttgtctttgttctttcagtcagaggtatttattaagtacctactgtgtgctcagcactaaaggtttgttgataaaatgacaattaaaaaatggcatttagccaaaggccttttcagccaggagtaagaaaagatggttagtgatatttggaaatacctggatatttgctagaggaaaaatgaaagcaaaacttcgtacacagtgccttgcccataataggtactcaataagcaattgttcctcatagagtcttttgccatgatttatggtgttttttgaaatttgtcttaattgaaaaaagaccaaatatttcaaatgagcttataggcagctgtggccagtgaaaatatggggttgtacagttagttcctagaatgttattttgcactagttgtcacttagaaagatggggttcctgtagattttttggtgctaagggatactttgtcattatgatgaagtaagtgttaagtgtcagataaatagcacacagaatagttctttctgctggtctgttttttctcttcgttgttgttgtttttaattgtaaattgttatcaatcaaactattgtagcagctacaaagtaattcaccagcatgacaaaatggtcaaaaaataagtcatcagcacttaagaaatgaaagcaacttttgaaattttctgttaaaattgtcaaatatattttatgaagaatttataaaaggggaaaatgattgtaatttattgttcatgacttttttttttaaataaagtgagtttcaacaaaaaaaaaaaaaaaaaaaaaaaaaaaaaaaa

SEQ ID NO: 324 - DNA, 2691 bp, Homo sapiens
  ref <308>: DATABASE ACCESSION NUMBER: AL137448
  ref <309>: DATABASE ENTRY DATE: 2001-06-18
gccacgctctgacctttgcctctcctctccctgcagatctgggtaccacagacgtccagaagaagaagcttgtggatgccatcgtgtccggggacaccagcaaactgatgaagatcctgcagccgcaggacgtggacctggcactggacagcggtgccagcctgctgcacctggcggtggaggccgggcaagaggagtgcgccaagtggctgctgctcaacaatgccaaccccaacctgagcaaccgtaggggctccaccccgttgcacatggccgtggagaggagggtgcggggtgtcgtggagctcctgctggcacggaagatcagtgtcaacgccaaggatgaggaccagtggacagccctccactttgcagcccagaacggggatgagtctagcacacggctgctgttggagaagaacgcctcggtcaacgaggtggactttgagggccggacgcccatgcacgtggcctgccagcacgggcaggagaatatcgtgcgcatcctgctgcgccgaggcgtggacgtgagcctgcagggcaaggatgcctggctgccactgcactacgctgcctggcagggccacctgcccatcgtcaagctgctggccaagcagccgggggtgagtgtgaacgcccagacgctggatgggaggacgccattgcacctggccgcacagcgcgggcactaccgcgtggcccgcatcctcatcgacctgtgctccgacgtcaacgtctgcagcctgctggcacagacacccctgcacgtggccgcggagacggggcacacgagcactgccaggctgctcctgcatcggggcgctggcaaggaggccgtgacctcagacggctacaccgctctgcacctggctgcccgcaacggacacctggccactgtcaagctgcttgtcgaggagaaggccgatgtgctggcccggggacccctgaaccagacggcgctgcacctggctgccgcccacgggcactcggaggtggtggaggagttggtcagcgccgatgtcattgacctgttcgacgagcaggggctcagcgcgctgcacctggccgcccagggccggcacgcacagacggtggagactctgctcaggcatggggcccacatcaacctgcagagcctcaagttccagggcggccatggccccgccgccacactcctgcggcgaagcaagacctagctggctgcctgcggagaccgggggtccacgtggggctcttgtcctgtcctgtgttcctcgtggggatggaacgatcctgcgtggggccccgttgtggcttacctaaatgttaaccaagcagaggtgacatggtgccatcaggaggcggctgctgctgaccggagtgtcccctccaggtgaagctggctcaggtgcacatgcccgctccatcatcgatctaggcacctgctgtctgaagggaccgtgggtcagaatcatttcgttgtgctcctaatgggtcgctgaggctggtctctcagtgatgaagccccaggcgtggaagcatccactctctcctgaggcgagccaccttgggttgctggagctcaccagtcttgagggaggtgcaggggaaactgtgttttttatcttcatacatgacggtgggcagagaggcctgtcttaaagtttccatggaattgttttataaaatatcttaagagatgaataccttatcagctgttgcttgaaacctgttaaaaatgttcataacattggatagtctagtctctaaatgatggctaagtagtggggttggctttgaaaacaatgttttatgcaacaaggaacgaatggtagcagccagctttgcggggcgtatgtgtggccagctcttaaccattccagtctattacttgggtgagtccttgtggacaaccacacacacgtgcccacatggtactagctgccgttcgtttctcgttgcctaagatgttttggcaactctagagccacaggcctaagagtcattaaaaaattctccctttgtaacctcagtgctggggactgaggcgagccccctcaggtcgctggagtgcaccagtcttggggaagaggtgcaggagaagctgtgttttttatctccacacgcagtatgaagataaaattacatagtattacctagacatagacagtattacctaggtagatgcactgctcacctgcacccttcccagctctcatttttgttaggtgatttgggatagggatagtgttttggggtatggggggagtgtttctgacctgctttgcagacgtgcctccgcacctcagcagtttggggtgtggccccagggcggttcttggatgtaaaagatgtggccatctagcctcgtaacttcactgtcacctgtgtcccatagggtgccttctgaatactgttattagaataagtttgttgcagaacgtgaccctgcgtgcaaacatgtaccgtggcctggtatatgatagagattgatattaatgtaccatgtatgttaatgtgaatctgtgggcaggatacttttccatggcaggaaatatccaagctgttgaaactggctatgttttaatatgcctcattgtgcctttactgttgtgtggactgcgtgagggacaagaagttccatttgatgtcaataaagcaaagtacttgcctaaaaaaaaaaaaaaaaaaaaaaaaaaaaaaaaaaaaaaa

SEQ ID NO: 325 - DNA, 1740 bp, Homo sapiens
  ref <308>: DATABASE ACCESSION NUMBER: AL137461
  ref <309>: DATABASE ENTRY DATE: 2001-06-18
gcgagcttggattgcccggtgccccaggaatcgatggagagaagggccccaaaggacagaaaggagacccaggagagcctgggccagcaggactcaaaggggaagcaggcgagatgggcttgtccggcctcccgggcgctgacggcctcaagggggagaagggggagtcggcatctgacagcctacaggagagcctggctcagctcatagtggagccagggccccctggcccccctggccccccaggcccgatgggcctccagggaatccagggtcccaagggcttggatggagcaaagggagagaagggtgcgtcgggtgagagaggccccagcggcctgcctgggccagttggcccaccgggccttattgggctgccaggaaccaaaggagagaagggcagacccggggagccaggactagatggtttccctggaccccgaggagagaaaggtgatcggagcgagcgtggagagaagggagaacgaggggtccccggccggaaaggagtgaagggccagaagggcgagccgggaccaccaggcctggaccagccgtgtcccgtgggccccgacgggctgcctgtgcctggctgctggcataagtgacccacaggcccagctcacacctgtacagatccgtgtggacatttttaatttttgtaaaaacaaaacagtaatatattgatcttttttcatggaatgcgctacctgtggccttttaacattcaagagtatgcccacccagccccaaagccaccggcatgtgaagctgccggaaagtggacaggccagaccagggagatgtgtacctgaggggcacccttgggcctgggctttcccaggaaggagatgaaggtagaagcacctggctcgggcaaggctagaaagatgctacgttgggccttcagtcacctgatcagcagagagactctcagctgtggtactgccctgtaagaacctgctcccgcaaaactctggagtccctgggacacaccctatccaagaagacccaggggtggaacagcggctgctgttgctcctggcctcatcagcctccaaactcaaccacaaccagctgcctctgcagttggacaagacttggcccccggacaagactcgcccagcacttgcggctgggcccggggagcagtgagtggaaatcccccacgagggtctagctctaccacattcaggaggcctcaggaggccagcctgccatgagagcacatgtcctctggccaggagtagtggctgagctctgtgatcgctgtgatgtggacccagctccagggagcagagtgtcggggatggaggggcccagcctggactgactgctacttcctgtctctgtttccattatcacccagagagggacaagataggacatggcctggaccagggaggcaggcctcccactcagagtctgggtctcactggccccaagtctcccacccagaactctggccaaaaatggctctctaggtgggctgtgcaggcaaagcaaagctcagggctggttcccagctggcctgagcagggggcctgccaccagacccacccacgctctgacgagaggcttttccacctccagcaagtgttcccagcaaccagctccatcctggctgcttgccttccatttccgtgtagatggagatcactgtgtgtaataaaccacaagtgcgtgaaaaaaaaaaaaaaaaaaaaaaaaaaaaaaaaaaaaaaaaaaaaaaaaaaaaag

SEQ ID NO: 326 - DNA, 4060 bp, Homo sapiens
  ref <308>: DATABASE ACCESSION NUMBER: AL137502
  ref <309>: DATABASE ENTRY DATE: 2001-06-18
tgcgggcggccggctaggaggcttggcccccaccccgggacccccgccgtccccgggccggccggccggtgggcacgatgagccaggtgctggggaagccgcagccgcaggacgaggacgacgcggaggaggaggaggaggaggatgagctggtggggctagcggactacggagacgggcccgactcctccgacgccgatccggacagcggcacagaggagggaggatgattacatggaagccctggccaggctccacctcacggtgaccagggcctacaaagtgaatactgacatcaacttcgaggtgtttattcataaagtggatggtctgtcagatgaccacaaaattgaaacccaaagagatattcaccagagggcaaacgatgaccttgcagatgctggattagaaaaaattcacctcagcttttatctgacaagcatatatgatcattcaatatttgaagcttttagcaaagttgttcagaaactgattccacaactcccaactctggagaatttgctgaacatctttatctcaaattctggaattgaaaaggcatttctatttgatgtggtcagtaaaatttatattgcaactgatagtactccggtggatatgcaaacctatgagctctgctgtgatatgatagatgtggttattgacatctcttgtatttatggtctcaaagaagatggagcaggaaccccctatgacaaggaatccacagccatcataaagcttaataatacaaccgtgctttatttaaaagaggtgacaaagttcctggctctcgtttgctttgtcagagaggaaagctttgaaagaaaagggctaattgactataattttcattgcttccggaaggccattcatgaagtttttgaggtgagaatgaaagtagtaaaatctcgaaaggttcagaatcggctgcagaagaaaaagagagccacccctaatgggacccctagagtgctgctgtaggtgaggtttcaggaatgtcttttgaaatcagaccttatccatgaggctgctgcgccatgttgcactaaaggaagaggaagaaggagattgggacacataccattgatttgttgttaaaaaaaaaaaaaattcctgcaaccctcttgatcttctcttttataaataaagtaagcactttgaagcaaaaacttgtatattaacagtgatgtgaaatccattgtcatttcattacacaaatgtaaacttttatggtctgtagtcaaaaaaatcccgtgtgagaactgccaggaattgtacatattttgcactttttcatgtttctcattgaactgaactttgataaaacgacttttctaagctttttttctgtacttggtgtcaaggacatgcatactgtagtccatatctatatggcaatcagaaattaatcaaaaagtgatgcattggtaatgactttttgtaaatttggaaatctttgctaccaattgttgagaaaaatcatttttcagtggagctggaacagattggagctacaagctccaggagcaataagaactgtcccctatttataatgggtgtaaacagttttgtagaataatgctagcaccagacttacctaaaaatttctatagcagtggctgtgcttccctgctcaacggtttttatgaagctgtttacctcaacacacatctctataatcactttatacagagaggttatttctttttgttgcattagtattcttttgaaactttgggaccagatttccaaaatggtgccgaacactggaaaaaagtaagaatgtcactgaattgtagggtttctggaggcttttctgtacctaccacccagggctaaagtaacatcagaggcctaaagttgttccaaaagtatgtgattggcaactgcagactaaaaaacatagatacaattctggacttttggccctgtgcgatggtctggtgtgctgcatttaaaatgcttattcaggaccagttctttattgctccatgaccatagtgaatagaacaaatcgcagaaccccaccatggagctcaatcctgttagtcacttttgtcacctccacatcttcttctcactggtgaaaacatgcctcatgtactccacttgttcccaccttatgattaagccaagctcagcctgccaccagcatgctctgcaaggctgaagagtcatcctgaagacccctaaaggtcagtgggaaaaggatggctggagagacattacaattagctgtgtaattgtttctgtgaaattatttcacttatgtttactttagactaacaggaaattaagagtcctaaatctacccctatgccaaatcattccaagtagataattttacgtgcatctcaagggttagcaccctaaagcatgcttgtggggcattagaaaatgagatttttttttttttaaagcagagcctcctaagaacatcaaagttggtcctagcaaaatatataaagtccctaaagcaacttatacttgaaactttttttttttttttttagaggggggcctcattctgttgcttgtgctggaatacattggtacaatcatagctcactgttacctcttgggctcaagggatccttccacctcagcctccctagtagctagaactacaggtgtgcacaaccacgcccggctaattcttaaattttgtttttgtagagacaggatctcactgtgttgcccaagatggtctcaaactcctggccccaagcaatcctcctgccttggcctcctcaaatgctgagattacaggcctgagctactgtgcccagcctaaactttcccacttctctctgtggcttctttccaacctctctccttcctctccccaagtcctgtttctttgaagctggtaactgaatttaagatgatatctggttggtgtttaaggtttgagcctcccaagggtctgtgcattttgaaaggagatttctaaaaataattaaggtgccctaactcctttcctcatgattcctactccgaaacctggatggttaggagcccagggctccctgatttccagagctatatcctgttggacctttgccaacagacctgacacttaggggttattgttataaatctaattctctaatattttttacatgttgtttcactttgaataagcaaatgaagaatcagttttctaatatgactttatcctcaagctagagacactagcctatttggtaaatcacacattacttaggtatatttattactataaccaggttggagcttccatgtttaagctgggtatatgatgggtttttgttaaaatgtgccttaaaaagcctattacttcaagagcaaatgattctttgggggaaaggcaaaaataattctatgacatagggcccaagttcatggtagtaagtgcactctttgattaatcacacgctaatatagattactgcctctaactttgtaagtgtggcaatgacttcttaattaaagaaagatgcaggagttatgtctaagcgttcagtttttcaaatctgtgttattggaaatgtcttcaagtcattttgcattgtatttttgatatgagaggcagcttattgcgatgtgtatggccatgtttcattctcaaatttaattctataaatacaaatcctaaatacatggctacagcaactgcactggaacatttttgcttggttttagggattgagaacttgccttgcaggtttccttcctcaaaaggagcagggcagtcctttccctgttgagtcaattagaatttttacatagaggtgagactgtgaattattttggttattttcagtgatgtagattagtgtgaatgaccagggtggaatgtttttgaaggaatataaagcaaaaactggttgacattcacaaactgttcttttgtgaacatattttggacccttaaatatgactaaaatcacagcaatattgttacatacgggttatatgccaactctgtttgaaatatactctggaaaaacagctgaattgtcttggttattaaagtatggtatgtattcaacttgtaaaaaaaaaaaaaaaaaaa

SEQ ID NO: 327 - DNA, 1200 bp, Homo sapiens
  ref <308>: DATABASE ACCESSION NUMBER: AL137514
  ref <309>: DATABASE ENTRY DATE: 2001-06-18
cattttggtgcgagagaaacaataggacggaaacgccgaggaacccggctgaggcggcagcagagcatcctggccagaacaagccaaggagccaagacgagagggacacacggacaaacaacagacagaagacgtactggccgctggactccgctgcctcccccatctccccgccatctgcgcccggaggatgagcccagccttcagggccatggatgtggagccccgcgccaaaggcgtccttctggagccctttgtccaccaggtcggggggcactcatgcgtgctccgcttcaatgagacaaccctgtgcaagcccctggtcccaagggaacatcagttctacgagaccctccctgctgagatgcgcaaattcactccccagtacaaaggacaaagccaaaggccccttgttagctggccatccctgccccattttttcccctggtcctttcccctgtggccacagggaagtgtggcctgaataccccaccccggctcctctgcacccagagctgggggccacctcagaagtgtcatctctctctgagcacgcattcccctgcagcagtcgaggactgagcagattgagtgatgctggggcagagaggcctgggaggaaaggtgttcagccagtcgtttgtaaggcgctcgtcggcacctgctgaaacgcccccacctgacagccccatcctcaaagactgtcttaattactcatggcaggttctagagacttaaggggaaaagctgctttcaaggccaccacatgtctgtgctccccaaccagctctatctgccttgtgttcattttgttattttgtgacgtgagactgcaaagaccaataaaaacatattttataagaacaaaaggcctgggtgcctacccgtgtgggggcactgtgggaagcctttgctagggtgtcttgtgctgtgtggtttgttttgtttgcccctttattttgctttgcttacccagtcttcccttactcttggatgcttcttaaccctcaggcaaacctgtgttccccctgtattcaggctctgctttaaagcaagccatgaggctgttggagtttctgtttagggcattaaaaattcccgcaaactataaagagcaatgttttcagtcttttaggattagaagaattacataaaaattaataaacattttcaatgatggaaaaaaaaaaaaaaaaaaaa

SEQ ID NO: 328 - DNA, 2498 bp, Homo sapiens
  ref <308>: DATABASE ACCESSION NUMBER: AL137540
  ref <309>: DATABASE ENTRY DATE: 2001-06-18
gctgaaacgacagtcttgtccctgtcagagaaatgacctgaacgaagagcctcaacattttacacactatgcaatctatgatttcattgtcaagggcagctgcttctgcaatggccacgctgatcaatgcatacctgttcatggcttcagacctgtcaaggccccaggaacattccacatggtccatgggaagtgtatgtgtaagcacaacacagcaggcagccactgccagcactgtgccccgttatacaatgaccggccatgggaggcagctgatggcaaaacgggggctcccaacgagtgcagaacctgcaagtgtaatgggcatgctgatacctgtcacttcgacgttaatgtgtgggaggcatcagggaatcgtagtggtggtgtctgtgatgactgtcagcacaacacagaaggacagtattgccagaggtgcaagccaggcttctatcgtgacctgcggagacccttctcagctccagatgcttgcaaaccgtgttcctgccatccagtaggatcagctgtccttcctgccaactcagtgaccttctgcgaccccagcaatggtgactgcccttgcaagcctggggtggcagggcgacgttgtgacaggtgcatggtgggatactggggcttcggagactatggctgtcgaccatgtgactgtgcggggagctgtgaccctatcaccggagactgcatcagcagccacacagacatagactggtatcatgaagttcctgacttccgtcccgtgcacaataagagcgaaccagcctgggagtgggaggatgcgcaggggttttctgcacttctacactcaggtaaatgcgaatgtaaggaacagacattaggaaatgccaaggcattctgtggaatgaaatattcatatgtgctaaaaataaagattttatcagctcatgataaaggtactcatgttgaggtcaatgtgaagattaaaaaggtcttaaaatctaccaaactgaagattttccgaggaaagcgaacattatatccagaatcatggacggacagaggatgcacttgtccaatcctcaatcctggtttggaataccttgtagcaggacatgaggatataagaacaggcaaactaattgtgaatatgaaaagctttgtccagcactggaaaccttctcttggaagaaaagtcatggatattttaaaaagagagtgcaagtagcattaagatggatagcacataatggcacttgtctatgtacaaaacacaaactttagagcaagaagacctcagacaggaaactggaattttttaaagtgccaaaacatatagaaatgtttgaatgcatgggtcttatctaacttatctcttctggacccatgtttaaatacagttttatttcatgaagagaaatgaaaacccctacactgatatctgttttctatgggactgattctgaaattcttaactattaagaatattttaatagcagcatgacatttagcagtaatccattaagggcagtacctctaacaaggacgccttccagcttcagcgatgttacttacgtttgatgctacttaaagtaatgaatgacgttttaaggaatccctaaccctactatcagaaaaggtgtttgttaaagagccttctcttgtgtgttacgcatgaactttggtctgtaggtgttaaatggaacctctccatgtgtatatagtatttccttgtataaagcactttactacctaccacttgtgttgtgaacgtttggtgactgctgttgaaagaaggaaaagggtgtgtgagaaagcctactgaagcagcagcactgccactacatgtggacaaaagtgaccatataaaagaagttgtgctatttaactctgaatacttggagaaactaggtgaagatgcaaccagaaaggagaatatgtatgcgtgaagtctcagctttgagctggaggctagattccaagatgacagccatgatgaaactttttaaaaaactaaaccagaagagactttaaaataagagaaagaaatcataaatgtagacatatgcttggctaaaggggaaatggactttaaattttaaagagctcatttgcaatgcacttgtatacacttcaaaaattattgtagacacagaatttgttatatttttgtgcttagtatttaaacctgaacattgaaacagttttcctccttgtctttcttaacagtaatagtcattatatttacctgttttttaacacaatgtatgtgatagtcaaaaaatcacagtttttcattattattcatcttctgtacccacgcataaccactatacatagtttcttttgtacttgaatatacaaaacatgaacacagtgccatatgaataatttcacatacagaacctttttttctctgaagtcctgtggacttgcaaatatatatatatattgctttgttaatttgtttttatatttcatatatgtaataaaggaatatgatctgaaaaaaaaaaaaaaaa

SEQ ID NO: 329 - DNA, 3656 bp, Homo sapiens
  ref <308>: DATABASE ACCESSION NUMBER: AL137555
  ref <309>: DATABASE ENTRY DATE: 2001-06-18
cacggggctgccgcaggcccagctgctctggcgcaaggtgccactggacgagcgcatcgtcttctcggggaacctcttccagcaccaggaggacagcaagaagtggagaaaccgcttcagcctcgtgccccacaactacgggctggtgctctacgaaaacaaagcggcctatgagcggcaggtcccaccacgagccgtcatcaacagtgcaggctacaaaatcctcacgtccgtggaccaatacctggagctcattggcaactccttaccagggaccacggcaaagtcgggcagtgcccccatcctcaagtgccccacacagttcccgctcatcctctggcatccttatgcgcgtcactactacttctgcatgatgacagaagccgagcaggacaagtggcaggctgtgctgcaggactgcatccggcactgcaacaatggaatccctgaggactccaaggtagagggccctgcgttcacagatgccatccgcatgtaccgacagtccaaggagctgtacggcacctgggagatgctgtgtgggaacgaggtgcagatcctgagcaacctggtgatggaggagctgggccctgagctgaaggcagagctcggcccgcggctgaaggggaaaccgcaggagcggcagcggcagtggatccagatctcggacgccgtgtaccacatggtgtacgagcaggccaaggcgcgcttcgaggaggtgctgtccaaggtgcagcaggtgcagccggccatgcaggccgtcatccgaactgacatggaccaaattatcacctccaaggagcaccttgccagcaagatccgagccttcatcctccccaaggcagaggtgtgcgtgcggaaccatgtccagccctacatcccatccatcctggaggccctgatggtccccaccagccagggcttcactgaggtgcgagatgtcttcttcaaggaggtcacggacatgaacctgaacgtcatcaacgagggcggcattgacaagctgggcgagtacatggagaagctgtcccggctggcgtaccaccccctgaagatgcagagctgctatgagaagatggagtcgctgcgactggacgggctgcagcagcgatttgatgtgtccagcacgtccgtgttcaagcagcgagcccagatccacatgcgggagcaaatggacaatgccgtgtatacgttcgagaccctcctgcaccaggagctggggaaggggcccaccaaggaggagctgtgcaagtccatccagcgggtcctggagcgggtgctgaagaaatacgactacgacagcagctctgtgcggaagaggttcttccgggaggcgctgctgcagatcagcatcccgttcctgctcaagaagctggcccctacctgcaagtcggagctgccccggttccaggagctgatcttcgaggactttgccaggttcatcctggtggaaaacacgtacgaggaggtggtgctgcagaccgtcatgaaggacatcctgcaggctgtgaaggaggccgcggtgcagaggaagcacaacctctaccgggacagcatggtcatgcacaacagcgaccccaacctgcacctgctggccgagggcgcccccatcgactggggcgaggagtacagcaacagcggcgggggcggcagccccagccccagcaccccggagtcagccaccctctcggaaaagcgacggcgcgccaagcaggtggtctctgtggtccaggatgaggaggtggggctgccctttgaggctagccctgagtcaccaccacctgcgtccccggacggtgtcactgagatccgaggcctgctggcccaaggtctgcggcctgagagccccccaccagccggccccctgctcaacggggcccccgctggggagagtccccagcctaaggccgcccccgaggcctcctcgccgcctgcctcacccctccagcatctcctgcctggaaaggctgtggaccttgggccccccaagcccagcgaccaggagactggagagcaggtgtccagccccagcagccaccccgccctccacaccaccaccgaggacagtgcaggggtgcagactgagttctaggccagtgggtccctgactgctgcacatggcacaggccgttcccttccggacccaggcaggctcagctctggggagggcaccctggtctgtgccttgtgggtggaggcggggcagggctgtgtggcaccgccagggagcgggcccacctgagtcactttattgggttcagtcaacactttcttgctccctgttttctcttctgtgggatgatctcagatgcaggggctggttttggggttttcctgcttgtgccaagggctggacactgctggggggctggaaagcccctcccttcctgtccttctgtggcctccatcccctcatgggtgctgccatccttcctggagagagggaggtgaaagctggtgtgagcccagtgggttcccgcccactcacccaggagctggctgggccaggaccgggagagggagcactgctgccctcctggccctgctccttccgcagttaggggtggaccgagcctcgctttccccactgttctggagggaaggggaaggagggggtcttcaggctggagccaggctgggggtgctgggtggagagatgagatttagggggtgcctcatggggtgggcaggcctggggtgaaatgagaaaggcccagaacgtgcaggtctgcggaggggaagtgtcctgagtgaaggaggggacccccatcctgggggatgctgggagtgagtgagtgagatggctgagtgagggttatggggagcctgaggttttatgggcctgtgtatccccttctcccggccccagcctgcctccctcctgcccgcctggcccacaggtctccctctggtccctgtccctctggtggttggggatggagcggcagcaaggggtgtaatggggctgggttctgtcttctacaggccaccccgaggtcctcagtggttgcctggggagccggacggggctcctgaggggtacaggttgggtgggccctccctgagggtctggggtcaggctttggcctctgctgcctctcagtcaccaagtcacctccctctgaaaatccagtcccttctttggatgtccttgtgagtcactctgggcctggctgtcgtccctcctcagcttcttgttcctgggacaagggtcaagccaggatgggcccaggcctgggatcccccaccccaggacccccaggccccctcccctgctgctttgcggggggcagggcagaaatggactccttttgggtccccgaggtggggtcccctcccagccctgcatcctccgtgccctagacctgctccccagaggaggggccttgacccacaggacgtgtggtggcgcctggcactcagggacccccagctgccgcagccctggtctctggcgcatctcttccctcttgtcccgaagatctgcgcctctagtgccttttgaggggttcccatcatccctccctgatattgtattgaaaatattatgcacactgttcatgcttctactaatcaataaacgctttatttaaagccaaaaaaaaaaaaaaaaaaaaaaaaaaaaaaaaaaaaaaaaaaaaaaaaaaaaaaaaaaa

SEQ ID NO: 330 - DNA, 3619 bp, Homo sapiens
  ref <308>: DATABASE ACCESSION NUMBER: AL137566
  ref <309>: DATABASE ENTRY DATE: 2001-06-18
attagggataggaagagattttcacatggcagactttagaattcttcactttagccagtaaagtatctccttttgatcttagtattctgtgtattttaacttttctgagttgtgcatgtttataagaaaaatcagcacaaagggtttaagttaaagcctttttactgaaatttgaaagaaacagaagaaaatatcaaagttctttgtattttgagaggattaaatatgatttacaaaagttacatggagggctctctaaaacattaaattaattattttttgttgaaaagtcttactttaggcatcattttattcctcagcaactagctgtgaagcctttactgtgctgtatgccagtcactctgctagattgtggagattaccagtgttcccgtcttctccgagcttagagttggatggggaataaagacaggtaaacagatagctacaatattgtactgtgaatgcttatgctggaggaagtacagggaactattggagcacctaagaggagcacctaccttgaatttaggggttagcagaggcatcctgaaaaaagtcaaagctaagccacaatctataagcagtttaggaattagcagaacgtgcatggtgaggagatgccaaaggcaagaagagaagagtattccaaacaggagggattccaaagagagaagagtatcccaaacaacatttgcacaaacctgatggggagagagaatgtggggtggggatggatgatgagactgaagaagaaagccaggtctagataatcagtggccttgtacaccatgttaaagagtgtagacttgattctgttgtaaacaggaaagcagcacaattcatatgaatattttagaagactcccactggaatatggagaataaagttggagatgactaatcctggaagcagggagaacatttttgaggaagttgcactattttggtgaaaatgatggtcataaacatgaagaattgtaggtgatcatgacctctctctaattttccagaagggttttggaagatataacataggaacattgacaggactgacgaaaggagatgaaatacaccatataaattgtcaaacacaaggccagatgtctaattattttgcttatgtgttgaaattacaaatttttcatcaggaaaccaaaaactacaaaacttagttttcccaagtcccagaattctatctgtccaaacaatctgtaccactccacctatatccctacctttgcatgtctgtccaacctcaaagtccaggtctatacacacgggtaagactagagcagttcaagtttcagaaaatgagaaagaggaactgagttgtgctgaacccatacaaaataaacacattctttgtatagattcttggaacctcgagaggaattcacctaactcataggtatttgatggtatgaatccatggctgggctcggcttttaaaaagccttatctgggattccttctatggaaccaagttccatcaaagcccatttaaaagcctacattaaaaacaaaattcttgctgcattgtatacaaataatgatgtcatgatcaaataatcagatgccattatcaagtggaattacaaaatggtatacccactccaaaaaaaaaaaaaaagctaaattctcagtagaacattgtgacttcatgagccctccacagccttggagctgaggagggagcactggtgagcagtaggttgaagagaaaacttggcgcttaataatctatccatgttttttcatctaaaagagccttctttttggattaccttattcaatttccatcaaggaaattgttagttccactaaccagacagcagctgggaaggcagaagcttactgtatgtacatggtagctgtgggaaggaggtttctttctccagttcctcactggccatacaccagtcccttgttagttatgcctggtcatagacccccgttgctatcatctcatatttaagtctttggcttgtgaatttatctattctttcagcttcagcactgcagagtgctgggactttgctaacttccatttcttgctggcttagcacattcctcataggcccagctcttttctcatctggccctgctgtggagtcaccttgccccttcaggagagccatggcttaccactgcctgctaagcctccactcagctgccaccacactaaatccaagcttctctaagatgttgcagactttacaggcaagcataaaaggcttgatcttcctggacttccctttacttgtctgaatctcacctccttcaactttcagtctcagaatgtaggcatttgtcctctttgccctacatcttccttcttctgaatcatgaaagtctctcacttcctcttgctatgtgctggaggcttctgtcaggttttagaatgagttctcatctagtcctagtagcttttgatgcttaagtccaccttttaaggatacctttgagatttagaccatgtttttcgcttgagaaagccctaatctccagacttgcctttctgtggatttcaaagaccaactgaggaagtcaaaagctgaatgttgactttctttgaacatttccgctataacaattccaattctcctcagagcaatatgcctgcctccaactgaccaggagaaaggtccagtgccaaagagaaaaacacaaagattaattatttcagttgagcacatactttcaaagtggtttgggtattcatatgaggttttctgtcaagagggtgagactcttcatctatccatgtgtgcctgacagttctcctggcactggctggtaacagatgcaaaactgtaaaaattaagtgatcatgtattttaacgatatcatcacatacttattttctatgtaatgttttaaatttcccctaacatactttgactgttttgcacatggtagatattcacatttttttgtgttgaagttgatgcaatcttcaaagttatctaccccattgcttattagtaaaactagtgttaatacttggcaagagatgcagggaatctttctcatgactcacgccctatttagttattaatgctactaccctattttgagtaagtagtaggtccctaagtacattgtccagagttatactgttaaagatatttagccccatatacttcttgaatctaaagtcatacaccttgctcctcatttctgagtgggaaagacatttgagagtatgttgacaattgttctgaaggtttttgccgagaaggtgaaactgtcctttcatctgtgtatgcctggggctgggtccctggcagtgatggggtgacaatgcaaagctgtaaaaactaggtgctagtgggcacctaatatcatcatcatatacttattttcaagctaatatgcaaaatcccatctctgtttttaaactaagtgtagatttcagagaaaatattttgtggttcacataagaaaacagtctactcagcttgacaagtgttttatgttaaattggctggtggtttgaaatgaatcatcttcacataatgttttctttaaaaatattgtgaatttaactctaattcttgttattctgtgtgataataaagaataaactaatttctataaaaaaaaaaaaaaaaagg

SEQ ID NO: 331 - DNA, 1489 bp, Homo sapiens
  ref <308>: DATABASE ACCESSION NUMBER: AL137615
  ref <309>: DATABASE ENTRY DATE: 2001-06-18
ctgtccaggactcctggtggccagattcggcctccgaccttgaccttaaactgcagctgaccccaggggctcgccgctgcccctcccctccacaccaaggcctgagacagcaggagccccgcctggcccgaagccgtttccaccgcagcaggcagaggggctggacaggcactgtcagccaatgtggggggtcctgaagacacccccttggggcacccgagtgccccttctcagggctcagtctgaccgtagccacgtcctgcctcgcgccgcccctcgggcctgacctggaagctccgtcagctccgtccttgtccttagagctgagcccagaccccggggtctggccgaatcctcacccccagggcagtgtttttggtctgccaccttcaggaaaacggctgcggcctcggcctcccttcgggcacccaggaatgcgggggtctgctcagtccccccaccctccatgctccaacccccgggggctgcggagcctgctgccccctccccgcgggtggggacgttctatgcaatacagggttccactttagaagtgcgcgcggctagggtcaccgcccgcccttcccggcgcagcccccgagctccacagctggggcagcccctctggcttctaaatccgcggtcgggattcttcctcctgtttagttttttagtttttccttaaaaaaaaacaacacatcgatggactttgcttccctgttcttgaagaatacttgaatgtcggggggcctgggggtgggggcctcggagaccgtctgcctggccctgctgcccctcctgaatctcgtatgatggtcacagtccggtggccgtgggggtgctctgccttccctggtccccactgcccatatctgtggactgccccttccaaagacccctggggggggtggggcattccgcccacccctttcccccatcacttctcgcctgtcagtgattccatgtttcgtaacgggggattctctgcctttttgtatcaaagaacaagcaaatggacccccgcccgctgcaggcgcccatagccatcgggtctctaaagctgagtggctagcagcgtttgtttgtttgtttttttttttttttctgaaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgcaaaaaaaaaaaaaaaaaaaa

SEQ ID NO: 332 - DNA, 2746 bp, Homo sapiens
  ref <308>: DATABASE ACCESSION NUMBER: AL137638
  ref <309>: DATABASE ENTRY DATE: 2001-06-18
agctggggctccgtcctcgcctcccacgagcgatccccgaggagagccgcggccctcggcgaggcgaagaggccgacgaggaagaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagatgaaaaaacgtgcacaaagatagactactgtgcctcatctaatcacggatgtcagcacgagtgtgttaacacagatgattcctattcctgccactgcctgaaaggctttaccctgaatccagataagaaaacctgcagaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgacgactcatacacgtgcgagtgcttggagggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagaatctgagccagtcaccataaatatccaagacctactttcctgttctaattttgcagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtactggactttaccttgatatatgtatatggatgtatgcataaaatcataggacatatgtacttgtggaacaagttggattttttatacaatattaaaattcaccacttcagagaaaaaaaaaaaaaaaaaaaa

SEQ ID NO: 333 - DNA, 3091 bp, Homo sapiens
  ref <308>: DATABASE ACCESSION NUMBER: AL137639
  ref <309>: DATABASE ENTRY DATE: 2001-06-18
ctggcaccgaggccaagacccccaggctcatatccacagaaaccgggaagggaacactatccctagtttcttcaactggttttcagaccacagccttctagaattcgacagaattgcagagattatcaaaggagaactgtggcccaatcccctacaatactacctgatgggtgaagggccccgtagaggaattcgaggcccaccaaggcagccagtggagagcgccagatccttcaggttccagtctggctaatctctgtcctgtgagaagcttctgcacaagtttccttaccacctcctcttggacctatgcttggccaacagcatgcagtcttccatctgctttctcttcatactgtggattatcttttcctttggttctaaatcttcagtaatcggttgcaagattgttggcttacctgcctgtgccattcttcctctgggccttcatgcttttctgcattgtggttaacatgtttcaagtgcatggccttctacggcttctatgccaagcgtatgatactatagatatagtgtaccatactgcctttctttgcatggcttggaccctatctgtgaccatgctcttctcccaatttaagtggttctgtaccacaaagaatcttgatacattttcacaaataactgattgggcttcatactttatgctggctgtgtcctgatacccatgtacttatggtaagctatttgggtattaccactgcaagacaaaactgatatcttaacccggccatcaacccaaattggacattccagactaccaccaactggatcccagctgccttcctgggcttgtgccatccaccctactggttatctgatagaacaagctggtggctgatgggtgactgctaggcgtgactgaggtaatagatgaaaagtgttctatgttatcacattggttttcctgtacctttggttactctacgtcatgaccagctgctggtgagtatgaagcctgtgctatagcccacccctactcactctcaccttctggttgaactttgcttaggccaccattgtctgcctcatcaggaactatctgtagacgtagctcccagggagctcacagcaacaccccctaccaccaggatgggcagtaatatgtgacagagcccaaagcaaggctggaacgcagtcccttccagcttagtctttctgactcctagccaacaaaccatccttaatgtgagcaacttctttaggcatttcctcttttccccgcctgcacccactctgaacatgacaaaagttgccagagttggggcattgaggaagagatatttctggaatgtgagacttgttatgcctctgtctctttctctccctcctcctcccctctccctccccctctccctcccatcccttttcttccctttcactctgaagcagttttagcttattaacagaaaacaaaactggcaaagcaggctttttgtttaatttgctctttccctgattgtgttcagagagaaaggttatgattaaatgggctccagatctcttattgcccttattcctccaccccacttcttttagcaaggtctgaaagtttcaaagggagacctataggttaattgtttagttataggcagtgttaaattaggcagattttgacatatttatctttttaccccatccattctaccaaaacctgtgtatttcttgagtttttagtttgagaagctggaaagagagagaagggcctcacagtgatgggttcaggacgggtcaaaggcaaaggcctttgtgatgtgagcaaaggcaaccaaaacttagcctcactccacttttctaaagatggaaattcttttttgggccttggactgcttctagggtagcattttgtaggtcactcttctcctttgtactattttgtttctgccctgatgtcccttgggtctccatcctactgcctggctttcttggccctcatttctcagcttctgcatttccttccctgctcctaacaaatgaagaagcaggctgcagcctgcattgtggaagatctccagcctccttgtaggggataaggggatgtgcagcatctgtgtggattttcacggacaagttccagtaggtgggacagtgatgccgtcaaggcttagttatgatcatgtgtggtgataaagaccatccaccatcacccttttcccctttggttttgaaggccttgccctaagctacctgagggtttaggaggtctgaacacacacagtggagaggttaatctaggttgggaaactgagtaaaagtccagagcaggaatgagcctgctgtggcgtgggtttggaaaggctcacaggaaagaacctgcaggatcaggggtgggaggggaggcccctgaggtgctctccagggaagaggggctggggtttaaatagcatgcttggaggaagattttccttcaatttttcctaagtccttgaattcaccagtagatttttgtaaacaaaatgtaagtcgatgttttctctcaattatcctaggagtgacctttatatgtgtggaagattaatggtatatgctccttatgtcactgtttttgagtaaaatccatttcctttctctgtttcagcctatgacaaaattgatgtttacaggcctgctttttgcttataattgacaacatgtgcaaaaataccaaatttgtgtcctgtgcagtatgaagaattcagtgaatattcattaatgtattagcttgttttgctctctgttcatatatggctctattcttagaaatataatttgaatgtgatctttcaatagtctgaatattttacaaattatagctatgtcttgtgaaaataacctcaaaaagaaaaatacgactctgttgtcttacttgatatttcttgccctagtaatgtacttgacatttatgttcctaagcagtgtaagtaccagtagaatttctctgtcaaactcaatgatcatttagtacttttgtcttctcccatgtgcttgaaggaaaaataaagtgtcactaccgtatttcttgttttcatcaaaaaataaaaataatttaaaaaaaaaaaaaaaaaaaaaaaaaaaaaaaaaaaaaaaaaaa

SEQ ID NO: 334 - DNA, 2744 bp, Homo sapiens
  ref <308>: DATABASE ACCESSION NUMBER: AL137663
  ref <309>: DATABASE ENTRY DATE: 2001-06-18
tttttccagtatagatagaaggggcctcatgcactagcccaagttctctgaattaatcttagataaattaaatactttgtaaatattttaatgattataattgtaataaaattattattttttctgttcctcagtggcgataaagtatttaacacttatctgtctttgcagacaagcatgaaactaaattgaaaggagtaatatactttcaagccattgaagaagtctattatgatcacctcaagaatgctaataaggtaaacatcagttttctaaattcctacagtttgaatgcataattaagaagggaaaaatatttttggagtctaagaagtttgaaattgatgttctgatgtaacagatagatatgatcagaatggtgctggaaaagtaaacatgaagtaagtgggatggccgttctttttgaggaaaaaaaatatcatagcaaattgaggaaatattctggacataatggtttgggaaaccctgcgaaacgactctgccagggttctaaaaagaagctaccatatagttaagagggggatcgtgagcaagtcctagtagggctaagaataacagctactatttattaaactcctactctcagctaggtaccctgctagagctttacaaactagctgctgaaataatttatgagttctgtctgagatttcctgttcagaaaaatggtcaatcctgaaaaaggctctgggacaggtgtgtgagttatagtagagcaaaagtaacgcctttgtaaatttaataaattgaaaattttgaagaagtcatcacatgtctgtgttatttaatgttgtattttaagatgtttattttacattctttttccttttttgaattttagagtcctaatccgttactcacctttagcgtcaagactcatgacagaatctattatatggtagccccatcgccagaagccatgcggatctggatggatgttatagttacgggggcagaaggttacactcacttcttgttgtagtgaactgaggcaacagtccacttcagggcagacggcaataatctcttacaagaatgaagccatattcaaccccagatgagaaaacccaacagatccatcccttgagctgtaaacactcagaactcctttcatatcaagacaagttatttgtaaaaaataaagaaggggttttaatacaaaccttcataataaatagcaaaataattgaagcttccatgagaaagaaaacactattttgataaattggatcacttataggaacatttcttataaactgtttttaatcagttgtcggatttggtgaaataaactaaacaggttacagaatatctgtatgtacttggaaatacagaataactttatcacccacatcattggcattgacattattggtaatcaactggcttttttttaaaaaggtagcattttgttgacagttattttgtaaacataagcaaataagggcttggagggaaatacattttaggaggagttttgccttaattttttaagtactgcaccaaaaccaaagagctgacctgacttctgtggaacagtagtaactgcaagtgatgaactgcatttcgtattgttctgtatatttcaaaatggtattttgatgccatcaaatgcccaggaaattgactttgcagtgtcaccactggtgtaagctactatatatatatatatatatgtagtaaaccactttttgtaaaagaagaaagagcaaaaagctgtgcgttttagaaaaaaaagccatgttacacaacagacattctgtcatgttgaacaattttaaataaagagaatatctggtgttaggagcttgttttgctgaagatttctccattcctggtgctgagaataaaggcaaccagtagccaatgtcctttagattgtctgatttctttttgttgtggagcacacctgctaactgctccctcgacataactatgaaatcatagctctgttttcaccaaagaacagaccaattaacatacttatttgcagaagtggtgtagttctacaaaacggcaaatgaagttcaacttaatattctctataatgtattattttattttattttttacaattagccttttttttagttaatttttgtcaaatgaaacgacttcaggcaagtctcttttataatggtttttcaagtgccatttattctagtttatcatgttttgcatgtttgaaagtatgaatgtgctctttcctaaaacatggcaaatgaatagatgtagagaataacaatattacttacaagatgaaatgattagattagaagtgtccctttattaaactttgtcagcctgactgggtacaattcttttgttaatttgcagtgtggtttgtatacacatatacgtgttatcaataataagattttgcaactggatgacacaagattttacttgaacagtgaaggacaaaaatcatgattgtggaagatatttttaaaatctgattttgcagcgatcacttttaaaccctgtagtgatgtaagactaaaatataattgctaagattttgttggttaatgtaaagatatgacttttctgcactgtactctcttcataggattgtaaaggtgttctaatccaattgcatgatgtagtaagcctcttaaatatgtgtgttaaatatattgagtttggattaaaatgttgacatgatttcacatttgaaaaaaaaaaaaaaaaaaaaaaaaaaaaaaaaaaaaaaaaaaaaa

SEQ ID NO: 335 - DNA, 1252 bp, Homo sapiens
  ref <308>: DATABASE ACCESSION NUMBER: AL137673
  ref <309>: DATABASE ENTRY DATE: 2001-06-18
aacctatcataggcactaaagaggaaaagcctttgaagcaggcattagtacatgcagtgttataattcatatgaatatgaggtacaaaagaagaggtgttgatgttttaaaaacattaatggctatttattgatattgcagaccacctagaggatgctaaattgaacatttagtgacagaagattttctcctggatactttaaatacataaaaacttggcagagtttttatgaaatataaattttattgtattcatttacatattaaaaaatagactcagaggcggaaaaacttccttgaaattgtttgtcatttgttctacagttacttactgaagtcattactatttaccaagcatcatgctaggtgctaggcttacaagagtgaacaaggagacagggttcctgtcattatagagcttaatctactggggaagattgagtgggaaagattgacttaaataaaacagtaagttcagaaagttaggaagtgttggagtctatatttaaacttaggtattttgacccaaaagcctgtactgtttctaacataccatgctgatgctctagcctccattttatatgcttaaacttattatggggcttttaaatagaatatgtattatccttgccagggcaaaatataaagaaataattgactgcctgctatatctgtcttcacctttctatccctattatctgtttttttattcctcttttttgtctcccttgtttcttaccctgacttatgtatgaagatctctagtatttctttactattgtgaggatgaccagcggagaggctagacagcaacaagcagaattggcccaacaggaatggcttcaaatgcagcaagctgcccaacaagcccagcttgctgctgcctcagccagtgcatctaatcaggcgggatcttctcaggatgaagaagatgatgatgatatctgaaattcaccagctgagtttctatttcttctataaatgtttttccctgcacaacaaaaacagtgaaagaaatgcttatctgtaattttgtatgcatcttggtggacttgtcattggtattctagggatgtctgctattaagtttcatctattgtgtgctatacatgtaaaaactgtctctttgaactattgaaaatttaaggttcagtataatatcaattttgaatttttaatggtgtttatgaaattttagatagcagcgagtccttcgtttgatcaataaacagtgttacagataaaaaaaaaa

SEQ ID NO: 336 - DNA, 2273 bp, Homo sapiens
  ref <308>: DATABASE ACCESSION NUMBER: AL137718
  ref <309>: DATABASE ENTRY DATE: 2001-06-18
gggggccagttaccatattgtccggagtgggtccttgacattcaggaaagatacatcctcagacctttcaaaatttgtcatgcctctctaacctaaaacagccctcattaaatgcactttaatccgagcactgtatggcttggaaagaattatgagtgaggagaggagcctttccttattggccaaagccgtggatcccagacaccccaatatgatgacagatgtggttaaacttctctctgcggtatgcattgtaggggaagaaagcatccttgaagaagttttagaagctttaacttcagctggtgaagaaaaaaaaattgacagatttttttgtattgtggaaggcctccggcacaattcagttcaactgcaagtagcttgtatgcagctcatcaatgccctggttacatctcctgatgatttggatttcaggcttcacatcagaaatgaatttatgcgttgtggattgaaagagatattgccaaatttaaaatgcattaagaatgatggcctggatatccaacttaaagtctttgatgagcataaagaagaagatttgtttgagttatcccatcgccttgaagatattagagctgaacttgatgaagcatatgatgtttacaacatggtgtggagcacagttaaagaaactagagcagagggatattttatttctattcttcagcatcttttgctgattcgaaatgattattttataaggcaacaatacttcaaattaattgatgagtgtgtatcccagattgtattgcatagagatggaatggatccagacttcacatatcgaaaaagactagatttagatttaacccagtttgtagacatttgcatagatcaagcaaaactagaagagtttgaagagaaagcatcagaactttacaagaaatttgaaaaagagtttaccgaccaccaagaaactcaggctgaattgcagaaaaaagaggcaaagattaatgagcttcaagcagagctacaagcttttaagtctcagtttggtgccttgccagctgattgtaatattcctttgcctccctctaaagaaggtggaactggccactcagcacttcctcctccgcctccactgccttctggtggaggggtgccgcctccacctcctcccccaccacctcctccacttccaggaatgcggatgccattcagtggtcctgtgcctccaccacctcccctgggattccttggaggacaaaattctcctcctctaccaatcctgccatttgggttgaaaccaaagaaagaatttaaacctgaaatcagcatgagaagattgaattggttaaagatcagacctcatgaaatgactgaaaactgtttctggataaaagtaaatgaaaataagtatgaaaacgtggatttgctttgtaaacttgagaatacattttgttgccaacaaaaagagagaagagaagaggaagatattgaagagaagaaatcgattaagaaaaaaattaaagaacttaagtttttagattctaaaattgcccagaacctttcaatcttcctgagctcttttcgggtgccatatgaggaaatcagaatgatgatattggaagtagatgaaacacggttggcagagtctatgattcagaacttaataaagcatcttcctgatcaagagcaattaaattcattgtctcagttcaagagtgaatatagcaacttatgtgaacctgagcagtttgtggttgtgatgagcaatgtgaagagactacggccacggctcagtgctattctctttaagcttcagtttgaagagcaggtgaacaacatcaaacctgacatcatggctgtcagtactgcctgcgaagagataaagaagagcaaaagctttagcaagttgctggaacttgtattgctaatgggaaactacatgaatgctggctcccggaatgctcaaaccttcggatttaaccttagctctctctgtaaactaaaggacacaaaatcagcagatcagaaaacaacgctacttcatttcctggtagaaatatgtgaagagaagtaccctgatatactgaattttgtggatgatttggaacctttagacaaagctagtaaaggtttgtgcctttttaagaaacatttcatggctctgatcttcagtgctaaaagactgaaaattataccttttatttgtatgtactttccactttctcacagtgttttcatacccaatatctcattttaaaaataaagagagttgtaggatattaaaaaaaaaaaaaaaaaaaaag

SEQ ID NO: 337 - DNA, 2053 bp, Homo sapiens
  ref <308>: DATABASE ACCESSION NUMBER: AL137736
  ref <309>: DATABASE ENTRY DATE: 2001-06-18
ccccgacgtacgcggcagcggcgtcctggccacgctgagcctgcgggactgcaagctgcaggaggccaagtttgagctgatcacctccgaggcctcctacatccacagcctgtcggtggctgtgggccacttcttaggctctgccgagctgagcgagtgtctgggggcgcaggacaagcagtggctgttttccaaactgcccgaggtcaagagcaccagcgagaggttcctgcaggacctggagcagcggctggaggcagatgtgctgcgcttcagcgtgtgcgacgtggtgctggaccactgcccggccttccgcagagtctacctgccctatgtcaccaaccaggcctaccaggagcgcacctaccagcgcctgctcctggagaaccccaggttccctggcatcctggctcgcctggaggagtctcctgtgtgccagcgtctgccccttacctccttccttatcctgcccttccagaggatcacccgcctcaagatgttggtggagaacatcctgaagcggacagcacagggctctgaagacgaagacatggccaccaaggccttcaatgcgctcaaggagctggtgcaggagtgcaatgctagtgtacagtccatgaagaggacagaggaactcatccacctgagcaagaagatccactttgagggcaagattttcccgctgatctctcaggcccgctggctggttcggcatggagagttggtagagctggcaccactgcctgcagcaccccctgccaagctgaagctgtccagcaaggcagtctacctccacctcttcaatgactgcttgctgctctctcggcggaaggaatggctgagctgcaggtgcgggacctgagcctgaagctgcagggcatccccggccacgtgttcctcctccagctcctccacgggcagcacatgaagcaccagttcctgctgcgggcccggacggaaagtgagaagcagcgatggatctcagccttgtgcccctccagcccccaggaggacaaggaggtcatcagtgagggggaagattgcccccaggttcagtgtgttaggacatacaaggcactgcacccagatgagctgaccttggagaagactgacatcctgtcagtgaggacctggaccagtgacggctggctggaaggggtccgcctggcagatggtgagaaggggtgggtgccccaggcctatgtggaagagatcagcagcctcagcgcccgcctccgaaacctccgggagaataagcgagtcacaagtgccaccagcaaactgggggaggctcctgtgtgatgggcagccatggcctaggaccccacctccatgcctggctcctggatggtcctggaggggcctgcagtgtctccattccccaagctgctcctgctggcacttcgcttctgtggccttggcattgagggcacaggctggacacaggaatgggggcgcctccagagggtctctccgtcctcatgctcctcagtgtccacacttcaaggccaaggatagtttcttcctctgacatggggaccataacaggtgatcactgatacctggcaaagactggggccctctcctttctatgtcctcaatcctgcctgactcttggtccttctggcagggacctggctggggaacgttctggtgctgatggtgctgggacctatatgtatatttatatatatctggggtcttgtctaccacctcccctggtcagagcctgagtgggtgctggttgctgtgtcttgtctgtaaataaactcctatcatgcctttgcttggagtctgtgatccatctgatgctgcccccacccccacagtcctattttcccagctaaagaccaggagagtctccggctggctcccaactggggctttgcatttctctagagttcatctctgagctgtaagggtgaccagggggcagggggacgattgtgtatcagctaggctgcttttggctgcaagtaacaaaatatcagatacaaataggcttaaacattaaagagatttgattagttctttaaaaaaaaaaaaaaaaagg

SEQ ID NO: 338 - DNA, 3658 bp, Homo sapiens
  ref <308>: DATABASE ACCESSION NUMBER: AL137751
  ref <309>: DATABASE ENTRY DATE: 2001-06-18
ccaggatctcctctgggggagttttctattaccagaaacttcattacatcagaatccaaactcatgatcctctcttgaaaacagacactcctcttgagctcctgggctttctcgtttcctcctttggtggtgccatgacgctcccagctgccctggcctgccatccttgctttgttgtgtccccagacacccacagtcagcaagtcctgctgaatcttcttccagagagttgttgaattccagcctgggtgacagaacgagactctgtctgaaaaaaaaaaaaggaggaatgatactacctgttaatgatactacctgttaggattattggggtattaaatgagatgatttgacaaagtgccatttaaagtatatagcattagataaatattttatcttttgtggactttaacaaatagtttattgatggaaattttttaaaaaagcttttaagttacacattttaagttcctgctactgaaagcaggattaactagtctgtagaataatagtaattttttaattttgtctccttagctcattacctaaaggacttattgtaaataagctatttaagatcttaagaaatactgtatttttttaaatggaaggctaagaaaaacataaacagcctaagcatgtgcattaaaactttgttgacttataagattattcaaaatatgttattttaattttggaattatattgtttactttaggcagcagaacttgctgaattcactgccaagattgcacttctagaggaagccaagaagaaaaaggaagaggaagctactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttcacattttttttctttttcttttttttttctgttgaagattaacactaattatcacgtctgacaaatgtgtatgtgtggtttcagttctgtgtacattttaaaggataatggtgaacattttaatgggtttcccttgccctttccatatttaacctatttccacattctctctcactcacattttctcagtgtgcccttctcttatctgccatgtccatagccataattccaccatcatacagatcaggcagtgtttaaaatgatggtaggtagcacagtggacagtctttgatcatcatgtagaatatggctatgaatcaggaaagagattagaacatttaataatgtatgtacagctggtgcttagtttttttttaatctaaatttaattaccttattggatatttgatatttggttatttaatcacagtcatctttaacagcttacactgattggtgttttatctcctgtgatcctttgatggctttttttgcctaccatttcacagaggtttagacagcagtagtagctccctaggagagtttactgatgaaacagcctctgcaagattttaaaagttttgttcttttatagactgatttagaaaaacaaatgattagttaaaaaaagaaaatatacatttgttggtaactaatgttattttttaaaacctggacctttctggaagggcagcatataaaaacatcagtcccgaggaggggacaacaatactacctcactactacatctgtgatgactggttgttcaaacacaatggagtgtgtaaggtatatgttttataattcataaccatagcctcgatcatcaagaaatactttcgaaatttcattttccttcagaatatcttaagagtgctaaatttttaactgcctttttgtcgagtcaaactgtgggattctgatttgtattaaaattgtaagctcctcactggtatactatcatcctggaggggtgttgtatggctgagcaagagagagagagaatgagagagagactgtgtgtgtgtgtgtgtgtgtgtgtactctgtgtgtgtatgagagagagagagaaatgctaaccttgtagcatgtgaagaatgtctgtaccttgatacgatagttacataatcagtatatttggtttctagatcactgtgcttattttgtttcaatctctgactaaaaatacttaaatttggtttgttaattcttattttagaaattataattttagtttatattaatttcggttatagcttactgaagaaatctttccagttagaaggaggttctaatattcacatgttctaatactttgtttattgtaaaacagctaaatttggagatacgtaaagccttgttttctctgtgtggttcagctactttccatttggtattacacagtcaaatttacatttatctattaaaattgccattttattaaacattttcatgcacagtagattcaagttgtgtctgaaaatatctcttgtgcttttttgattttgctgactttaaaaggattaatctgggcagacattatgtaaaagaaaggttgcgtttaatatattttttgaactttgtaggacaaaacatagctggttaaccttgaagtgactgttgtaccatggttgtgcacatgcttcagaatcctatggaagagaatattcctacttgcagtacatcaaaggaatggatggtggaccctactattcatgttttgagacataaatgttcactttaaagcaattgcataatagataaaaacctgaactttcattggatttttgttaattttcctcattttgaattatgtgcactaccatagctacatcagtttgatacagtattgaaaaattatcagttatattttgctgtttatgatctatttgtagattaggattaaaatggatttaatccatttttaaggctgtgtgaatttttctaaacaagaaccatttgcaatatggatttcttagagattaaaccaattataacttattagcagtcgcgagcacatgttcatatagtcaatgtaaaaatacactaatgagtatttggtaaatcccagtaggcttttaccattagcataattttgtgttgtacaattaagttacaattacatctctaattttggataatattcattggttaacaataaagtgacaaaagctcatgcaaaaaaaaaaaaaaaaaaaa

SEQ ID NO: 339 - DNA, 3485 bp, Homo sapiens
  ref <308>: DATABASE ACCESSION NUMBER: AL137761
  ref <309>: DATABASE ENTRY DATE: 2001-06-18
cacaaagaaaaaagaaatacctgtagaagcgcatcgaaagctcctggaacagagttgtgtctcatatttgcaaagatgcagaaaaaataaacccgggacatccagctttcttttcctttcttctttgactattctgagaagctatgcgactaggagcacattttaggtaaacacgtggcttgagtagccataaggccactcttccctgtcgtgtgacccgcgcctgggcctttaagagatattggtgtttgaaaagggaggaatctgtttgccctcagatatttagttcaactgcctgcattgcttcctattttgttgtccaactctgtagtagttagcactggccttaccaacatgtaaagaaattttctttactgccccatgagtagttggaggcaaagagaaatttttaaagcgcagaaaaaggcctgcagggagatggaatttgttctgccagagaaacgagatgatagctgtatttaataaagttactgacctcttgtcaaaatttaaaacgcaaaagaagatgtttcaaaatgcagagaatgtcagaaaacaaaaactacagggaccagaccagtataatgtttagttttcattatactaacttttgtctagactggagttgattcactattttttctttaactcctcaggaagcaaaccttcccgatgatgaagacttcttgaaggatttcatgggtgatttgggatcccaggaccatttggctagtgtgcctaggtgaccacatgattgctgttttaccaggaatgcagcatcccattgacaaaacaagtgctctgagaaggtttaaaatactacagagaatatgggaacacagaccttgaaatttagctgagttgtaacagctgaaactccaagaggtgtcttccttgtttgaggtgaaactagtgttgcttccagagggcagctggaaaccgtaaagctgtttggaaatctttttgactgacttgctgacaaagaggtactgtgatgcattttaacaatatctaagttgatttttttttaaatcaaggaaaataaaaaccaagcatgaatgctatggtatgtgccccttttgaccatcctgggctgattaacatcatttaaatcaaagtaatcataaaaaggcatattctacttcaattatgtggtcaaataagagtaaacacacacactcacacatgctgaccccaattgccagagcattactgcactataaattacggttaattcccaaattatactactgtttatcttatttaacaagtcagaaagcacttttaaaataacttgagggctacaaggtcattctattaatgtcattctccattcgggttgtaggcatgtggaagtacccattaaaagataagttagagtttaaatactgataaacaaaaccttttattgcaactggacagtttctggagagttagcggaagaatcttggagtttcctttggtcagatgaatacaacatttcacttttgcagcactatttagaatgtactccatggttctcttgttcccaacttccaaaaagaacagaaaactttggtttacacagaacacgggcatctgaggcaggacctcttccctgccctttgatctgactcacacctccacatatgacgtaatcaacccaaatttgacaccaattcactcttttctgcaaagggcatattttgaaacaagggacagcctgagggcggctataatgagaatgttcatgggggttactgggtccctaattctgaacttgcttatgacacccagagtgaatagattcagattcagaaccttctgagaaataacccaaagaaaatttgttacccagccaattcttcgaaagcttaatatcaaaatatatcttttcaagaagaaaatcgttagagagaagaatgtggaggggagagaaatgggtttctcattgatatgatattttgttaaccatttcattttgaattattcaagttttggttaatattgtattcttttttcgtaactattttaccgtgagagtaggtcattgggttacttagatatttatttttacacagttattagtcttcagatagttttattttacttcatatgattttagtttttgtcagtataattttaaatcatgtttttcttggtcatctctttgtgtatattgtgtaattggattttcattgactgcaagtggagtgtttgccactcaattcagtactcagtactatggtgacttgttttcaaataagtctcagatacacatttagggagcctttgctggccgaatatagactctgtcaggacagcaggtcccctgatctaagaattttccccaatggttgctctaaaaatgctgctattttgctgttcactgtattgcacttagttaaaaagaagataatgtgaaagatgagagcagttttttaaaggatcttttcatatacccaattcccttattttcagatgtcccatcaattttagatatgaaagctttaagtaaaagtgtgtatgcctttctactgtcagaacaggatggatgcagcctgggtcagatttatttaagataaaaatcatgcagactcatcattcatatcataggtgaaaaatgtaaaaaccaaatggtttccactaaagccaccaagatcttttagaaatgtttgcacctttggtggtggcacaggaaaagagaagaattcagctggagtgaattctagaagtagatatcagaaacggggcatgaagaacaggggaactgggtggcatcagactcctaaagaagtgagttaattttccttcccttccattcagattcatgccacagctccatatcttgagtatgtgtaagaggtgagttccttcttcagccaggggcggtggctcatgcctttaatcccaatgctttgggaggccaaggtgggaggatcacttgtgccttggggttcaaggttgcagtgaaccatgattgcaccactgcactccagcctgagtgacagagcaagaccctgtctctaaaaatatatataaaaagtaaaactaaagaacttcttgcctaaacctgaattaccgcaatttgctgagtgactttgagaaaaatcagactgtttagttcagtcgggatgaaaagcttgcgattgcttcccacaagaatgggcaatagtgacggctgcaaggtacttttatttgttcatgaaagaacgacaatttttcaaaatgtaattaaacataatagaatgttttaaactactgggcactgaaactggaagaaaaaggaggctttattgaacattcccctttttcagttggttcaaagttcagcactgtggttatcattggtgatgccagaaaacattagtagacttagacaattgctatggcagtttctaaacagagctttttctatacactatttgcaactggagtgcaatattgtatattctgtgttaaagaaataaagtatttttatcatttattaaaaaaaaaaaaaaaaa

SEQ ID NO: 340 - DNA, 2809 bp, Homo sapiens
  ref <308>: DATABASE ACCESSION NUMBER: AL157431
  ref <309>: DATABASE ENTRY DATE: 2001-06-18
caaagtgtctagtagacagataaaaaaatagactagttctagatcgcgagcggcccccggaggctttcctggtagaagttgatgcgaggaagggcggcggggaccaggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgctttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 341 - DNA, 3097 bp, Homo sapiens
  ref <308>: DATABASE ACCESSION NUMBER: AL157432
  ref <309>: DATABASE ENTRY DATE: 2001-06-18
agactatctttctagacaaggcagttgaggaggagggagcgcttgagggggactggcctggcgtgcactccgcacctcggggacattattgcgcgtggaacggctgcttttggaaggcacaacttcctgaatggaccatgactcccaccaaagatccctgtctctgattcaccaaacagcttcaaccctgaaaccaggacgagaagttgacaacatctgagtggacagctaattgacctaagacttcagaccagactattgcccagaagaaaagatgtttggttttcacaagccaaagatgtaccgaagtatagagggctgctgtatttgcagagctaagtcctccagttctcgattcactgacagtaaacgctatgaaaaggacttccagagctgttttggattgcatgagactcgttcaggagacatctgcaatgcctgtgtcctgcttgtgaaaagatggaagaagttgccagcaggatcaaaaaaaaactggaatcatgtggtagatgcaagggctggacccagtctaaagactacattgaaaccaaagaaagtgaaaactctatctgggaacaggataaaaagcaaccagatcagtaaactgcagaaggaatttaaacgtcataattctgatgctcacagtaccacctcaagtgcctccccagctcaatctccttgttacagtaaccagtcagatgacggctcagatacagagatggcttctggttctaacagaacaccagttttttcctttttagatctcacttactggaaaagacagaagatatgttgtgggatcatctataaaggccgttttggggaagtcctcattgacacacatctcttcaagccttgctgcagcaataagaaagcagctgctgagaagccagaggagcaggggccagagcctctgcccatctccactcaggagtggtgactgaggtttttatgtagaaggggaacaaaaaaaaaaatctgaattttgaaaaaccacaaagctacaaactgaccctctttttttttttttttttttgagacggagttttgctcttgttacccaggctggagtgcagtggcgtgatcttggctcactgcaacttccgtctcccgggttcaagtgattctcctgcctcagcctcccaagtagctgggtttataggtgcccgccaccagacccggctaattttttagttttagtagagacggggtttcaccacgttggccaggctggtcttaaatgaccctcttatttttaacttggatacctgctattctgccaaaagacaatttctagagtagttttgaatgggttgatttcccccactcccacaaactctgaagccagtgtctagcttactaaaaaaagagttgtatataatatttaagatgctgagtatttcataggaaagctgaatgctgctgtaaagtgctctttaagtctttttttttttaatccccttctaatgaatgaaactaggggaatttcaggggacagagatgggatttgttgtatgataaactgtatgtagtttttagtctttctgttttgagaagcagtggttggggcatttttaagatggctggctactcttgttttccctcatgataataaatttgtcataactcagtaacatgaacttgcccctagaggtagttgttaataattttgaaatattaaggtcttgccaagcttctgatgattcacacctgtactactgattattaagcaggacagactgagctttctgttgcaaataccttggaggagaaagtaatttctaaatatacagagaggtaacttgactatatatgttgcatcctgtgcctcccttcatattaatatttgataaagattttaatttatgtaaaacttctaaagcagaatcaaagctcctcttggggaaatggcaagtctttaggataggcaagaccctgtatgaatagtaccaaagcattaccgcatggtagagaacacactcgattaaaaatgttaagctatctgaaaaataaaatgtgcaagtcttcaggatggcacaaaacaaaggttaatgcttcttggggcacatttcttagagggcttgctgagtgtgtaaatataatcgacttttgtttgtgttacatgacttctgtgacttcattgaaaatctgcacaattcagtttcagctctggattacttcagttgacctttgtgaaggtttttatctgtgtagaatgggtgtttgacttgttttagcctattaaatttttattttctttcactctgtattaaaagtaaaacttactaaaagaaaagaggtttgtgttcacattaaatggttttggtttggcttcttttagtcaggctttctgaacattgagatatcctgaacttagagctcttcaatcctaagattttcatgaaaagcctctcacttgaacccaaaccagagtactcttactgcctcttttctaaatgttcaggaaaagcattgccagttcagtcttttcaaaatgagggagaaacatttgcctgccttgtaataacaagactcagtgcttattttttaaactgcattttaaaaattggatagtataataacaataaggagtaagccaccttttataggcaccctgtagttttatagttcttaatctaaacattttatatttccttcttttggaaaaaacctacatgctacaagccaccatatgcacagactatacagtgagttgagttggctctcccacagtctttgaggtgaattacaaaagtccagccattatcatcctcctgagttatttgaaatgattttttttgtacattttggctgcagtattggtggtagaatatactataatatggatcatctctacttctgtatttatttatttattactagacctcaaccacagtcttctttttccccttccacctctctttgcctgtaggatgtactgtatgtagtcatgcactttgtattaatatattagaaatctacagatctgttttgtactttttatactgttggatacttataatcaaaacttttactagggtattgaataaatctagtcttactagaaaaaaaaaaaaaagaaaaaaaaaaaaaaaaa

SEQ ID NO: 342 - DNA, 1041 bp, Homo sapiens
  ref <308>: DATABASE ACCESSION NUMBER: AL157454
  ref <309>: DATABASE ENTRY DATE: 2001-06-18
cggacgcgtgggctaaaggatacatcatatactgacaaactcaatgtggtcctttcaagaattagccatgagtctcaaaaaggcaataaatggctctaagtggacaggtttgcttcaaacaagtaacatctacattttgtctttttttttcagttctcctgttatgttctggttgaaatcacctgtgtgtcttaatttctcaattcctttttggcaagaatatcaagcaaggtgaatttaacattatgtttatgttttgttttgttgctgtaactaatagttaattggactgattcttacccagccctggtcaagaatctgtgaggcatgtgactgaagtactaaattaaacttattttgaaaccaaacctaatttttaagccaaaaggtgtaatagtgatttaatacaggatgaaaaacactgaatttttaagactgtaggtggactatgttagtagttttcaagcaggatgtctgtattcagcattcaataatgctaaaatccctttcagcatgaaatttgtatgtttttatcctttgctgactaaaataaaataactggtggtttgctaactatttaccatatgggttggctggtttttattaataattgtttagggtatcataagatctgtaagtacaaaggatattctgtttctatctgcaatgcatttgataatcatttctatgaaatgtattttatttaatcagataagctaataagcgaattggttacatcgtttgtatctgttggcctagtggacagctgtgcctggtgcacctctggcttttaataaatactcattggttgaaacaccctgctaacactgtgttttgtcagttcgtaaattcctttaaccaagacttaactatgctttttaactctttttccacctgccatctactactaccaactcacttatacttccttcctcccaagtaatcatttcaaaactaaaaaaggatttaagttcttgggttacaacggtttaaaggaaagaaaatgaactttgaagtcaaaagaaaaaaaaaaaaaaaaaa

SEQ ID NO: 343 - DNA, 2162 bp, Homo sapiens
  ref <308>: DATABASE ACCESSION NUMBER: AL157476
  ref <309>: DATABASE ENTRY DATE: 2001-06-18
ctgacacggatccagtcatacctggggctggatgggatttggaggccctggtcatttgcagagtgaatggtgaagggcgcggaaaaggtttgcttggaggaaagaccggttgcagaggcgaggcggagggaggaggggcggaggcagcaggtctttgtttgtggtaggtctctggcttccatcagggaggaggaaagaggctgtgcccttcctggctcttggctgcaccactgaggacgctccgagggacagcgtgctcacccatcctttgcacagtgctggccccaagccccacggccttccagctaggattttctgctgggctcatgcagaggcaggggacaggtgcatggaagagccgccccacccgacacaccattgtttgaaaatcactgttctctttactcacttaaaaaagtgtacagggaacacctgttcctggcataatgctccaacctcgcggaaggggccaggtgcccttcatctggctctggctgcttccgacctgggcccacgtcatcgttcacgtcctctgtgaccaccactggtcacggtgctccctggcccagcctccaacccacccagcaccctggcatctcccaggccagtctgctgcacccagcgagcttccagtcagaagccaggctgaacggccctcctgccccatcagcttcgtgtcttctttttttttaaagaactgaaatagtccccaagaggcctcatggcctgaagactcacaatcatccacctgtaatttatgataaatgtctgggagcatttaccatttgcgtccgtgagtatttatagccctgaatgggcgggggggagggggggtggaggaggccctgcagccaggagctacacacctgtccccactagtgtcccctggttgacagagccccctcagcctccccaaggctgtcactgcggctgtgacagctgaggagtgccgcctttgaaagccagtggacagtcgctccactagggggagaggccctggccctggcgcagaggaggcgttgcgaggcgggacgggggctggaggggctgagcagccttcagggcagggactgggccctgggtcactggagacgttgatattagtccatctgtctgctgccaaattgctccccaccacatgagccccaggggtttatgtcccaggaaggcgagggtgcccatctgagcggaattgggaggggacggcaccagctcatctccctcagggcctttgcctcctggtgctgccctggtggctgctcctgcaccacagcccctgatggctgctgctagtcctgagttgctgggtttacccccagcccacacttcccacctgggcctgagggtgcggccagtgccctagtcctagccactacaggagtcattctgagacctgctggaggccatggggtcttcccaggcccctcaatcagctgcttccagggtcagcagggcagggtgctgccagtaaggtcctcagggagcacagcccggccgcccaggctgggggatactggggcagagcttccaggtctgtggggcctgatctctccccaaggctctccaggccttggtgcgccctccacagtgaccttcagagaggctgcaccccctcagaagaacagtgagaaatctctccatcacacgctccctggtccttatgtccctgaggccacccttccccaccccccagtgcctggagaagcgtgagactctggaggggcgccaggaggccaggggtcctcagggctaggcctggagctcggcccaagagctgcttttgcgaagcctgtcttgaatccggattcaccagagaacaagagcctcccagcctttggcgtttctgggcctgtaaagatgtgtgtacctcccaggccactctgatgcaagggcagggaccatgccaggcctgggttgggaatggctctgtgactccagaagctccgtctaaaactccaaagatgcccaaaaggctgtgctgctatgtggaatgtgtattatttgtgagcacgatgcggcttcttcctcattttgcagagcaacctaagcgggcagatgtacaaaccgtgtgttcgaaacccctgagtccatgtgtgtgaaaatgcaggttttctcttagaaataaagtggtgacttgtgctgtaaaaaaaaaaaaaaaaaaa

SEQ ID NO: 344 - DNA, 1444 bp, Homo sapiens
  ref <308>: DATABASE ACCESSION NUMBER: AL157480
  ref <309>: DATABASE ENTRY DATE: 2001-06-18
cggacgcgtgggatgaccttcgacctctatgatgactggatgagggcagccagcctgaaggagccaggggcccggctgcaggccctccaagaggtgtgcagccgcctaccccccgagaacctcagcaacctcaggtacctgatgaagttcctggcacggctggccgaggagcaggaggtgaacaagatgacacccagcaacatcgccatagtcctgggacccaacttgctgtggccacctgagaaagaaggggaccaggcccagctggatgcagcctccgtgtcttccatccaggtggtgggcgtcgtcgaggcgctgatccagagcgcagacaccctcttccctggagacatcaacttcaacgtgtcaggcctcttctcagctgttaccctccaggacacagtcagtgacaggctggcctctgaggaacttccgtccactgccgtgcccaccccagccaccaccccggctccggctccggctccagctccagctccggccccagccttggcttcagcagctaccaaggaaaggacagagtctgaggtgcctcccagaccagcctcccccaaggtcaccaggagtcccccggagacagctgccccagtggaggacatggctcggaggaccaagcgcccggcgccagcccggcccaccatgccgcccccccaggtctccggctcccgctcctcccctccagccccgcccttgccccctggctctggcagccctgggaccccccaagccctgccccgacgtctggttggcagcagcctccgagcccccacagtgccacccccgttaccccccacaccccctcagcctgcccggcgccaaagccggcgttcaccagcctcccccagcccggcctccccaggtccagcctcccccagcccagtctctttgagtaaccctgcacaggtggacctgggggctgccacagcagagggaggagcccctgaggctatcagtggggtccccactcccccagctatcccccctcagccccgccccaggagccttgcctcagagaccaactgagtggctggtttctccctaagcagccctcagcaccccctccctccccacctggccctcccaggacagctctcgccccccacaaaggggcatgggcctccagcctttgcccacaagtgcctcagtgcccactgggtcggcccccatggccaggagggctcaggacaatcctctatttcctgaccttttcctcgtccaccctgggcttggggacccccccaccggactctccactctccggcaggtcctaggggagccaccggaaggaaggagaggtttgcctgctcctacgggactgattcttctcttgccgacatgttttttgtaaggctggtaaataaattattttggacaaaaaaaaaaaaaaaaaaaaaaaaaaaaaaaaaaaaaaaaaaaaaaaaaaaaa

SEQ ID NO: 345 - DNA, 2832 bp, Homo sapiens
  ref <308>: DATABASE ACCESSION NUMBER: AL157482
  ref <309>: DATABASE ENTRY DATE: 2001-06-18
gtgcaccgtcggcaacctgcttcctggaaccgtgtatcgcttccgggtgagggctctgaatgatggagggtatggtccctattctgatgtctcagaaattaccactgctgcagggcctcctggacaatgcaaagcaccttgtatttcttgtacacctgatggatgtgtcttagtgggttgggagagtcctgatagttctggtgctgacatctcagagtacaggttggaatggggagaagatgaagaatccttagaactcatttatcatgggacagacacccgttttgaaataagagacctgttgcctgctgcacagtattgctgtagactacaggccttcaatcaagcaggggcagggccgtacagtgaacttgtcctttgccagacgccagcgtctgcccctgaccccgtctccactctctgtgtcctggaggaggagccccttgatgcctaccctgattcaccttctgcgtgccttgtactgaactgggaagagccgtgcaataacggatctgaaatccttgcttacaccattgatctaggagacactagcattaccgtgggcaacaccaccatgcatgttatgaaagatctccttccagaaaccacctaccggatcagaattcaggctataaatgaaattggagctggaccatttagtcagttcattaaagcaaaaactcggccattaccacccttgcctcctaggctagaatgtgctgctgctggtcctcagagcctgaagctaaaatggggagacagtaactccaagacacatgctgctgaggacattgtgtacacactacagctggaggacagaaacaagaggtttatttcaatctacagaggacccagccacacctacaaggtccagagactgacggaattcacatgctactccttcagaatccaggcagcaagcgaggctggagaagggcccttctcagaaacctataccttcagcacaaccaaaagtgtcccccccaccatcaaagcacctcgagtaacacagttagaaggaaattcatgtgaaattttatgggagacggtaccatcaatgaaaggtgaccctgttaactacattctgcaggtattggttggaagagaatctgagtacaaacaggtgtacaagggagaagaagccacattccaaatctcaggcctccagaccaacacagactacaggttccgcgtatgtgcgtgtcgtcgctgtttagacacctctcaggagctaagcggagccttcagcccctctgcggcttttgtattacaacgaagtgaggtcatgcttacaggggacatggggagcttagatgatcccaaaatgaagagcatgatgcctactgatgaacagtttgcagccatcattgtgcttggctttgcaactttgtccattttatttgcctttatattacagtacttcttaatgaagtaaacccaacaaaactagaggtatgaattaatgctacacattttaatacacacatttattcagatactcccctttttaaagcccttttgttttttgatttatatactctgttttacagatttagctagaaaaaaaatgtcagtgttttggtgcacctttttgaaatgcaaaactaggaaaaggttaaactggatttttttttttaaaaaaaagaaaaaaaaagaagaaaagtataccagataccaaaagccagctttcttatgttttcctttaaattttcagatttaccttcattctgttttcactgatgtcttttgcaagcctttgattttttttttttttgttacagtttagtaatttatattcaccagtcacttcatatgtcttgaacatctgtatctgtaaacatgaatcaccgtgtgtgtacttacagggctaggatttcagtgttgtcagagtattaccacacagcaacagcaacatacagaagatatgttcactcagataagactgccctaaacaaccattttgtcactcagttatttaactgtgtttagctcatttaaatcaaaatgtgtactttaatctaaaatgttttaataatctgtatttcttataattttaacactatgagctgcctgtataagaaatcaagtaaccagaatgcacctataaattatggagcattgtagattttaccacatcaattcatagcagtaactttaagagggcattgtgcaatagttagttgttttcttgttcagctattttaaaggctgctttaacttgtttgtttgtctttgtatataactacttctaatctaatcactagagttattatattctgttatgtttgaccagaattatatgacaagaactggtgacagtttagtgcctctgcccattgtccatgatttacactaattgtgagcagtcttcttatgtgtcagctcattatttttgaaacatttgcctttaggctgttctttgaggtatcaatgaagtgattgaatttcaataccttaattcagtgcacataatactaatgtaacagcagatgaaaattgataaaacccaaaagagagtcatctaaatttgtagttcctatttctgtgggtttgcctggccatggttggagagggaatggtgtttgatggtaaacacagggtgtttggggatcaaggagcctagattctctccctggatctgtcactaacttgctgcgtgacctgaacacgtcactttacctctctgtgcctcagttttcccatgcatgaaaaataaaataaaataaaacggggattctaatgttaaaaaaaaaaaaaaaaaaaaaaaaaaaaaaaaaaaaaaaaaaaaaaaaaaaaaaaaaaaaaaaaaaaaaacaaaaaaaaaaaaaaaaa

SEQ ID NO: 346 - DNA, 2352 bp, Homo sapiens
  ref <308>: DATABASE ACCESSION NUMBER: AL157484
  ref <309>: DATABASE ENTRY DATE: 2001-06-18
ccagaatgagatacagccaatttggctttgatgacccagctgagagggaaatttagatacaattcaggaatatcatgcccaaaaatagtggtcccagcaaccaggacacagagggaagacctggatattgtcagtgattggtggagggggacatcttggaccctcctaggcctggtgtcacatctcccatctctcagaccccacagaggccaaggggccttggctctgacccaggttaaagagagccaccagcccccaggctcagggagctgaaaccacccatccgcagaaatctaagggcaaggagaaatagaaattgtctgttccttcccttcaaagtgtaaggcctcttccaggagcaactggagccaccacagcttctcagtgacattgggagggcttcgggcccaggaaaaacccaagccttttgtcctgagagccgagccacagcggatgcagtggcgtcagcatcccagagcggcagcttctctcctgcctgtcactggggactggttgctctccacccatccaggaggaaggggttaggtcccagtcttacactcttatagggtctcatggacataggcctatgcctgttctgatatctataattttttaaactcaaaaggaccaaaacactcctgaaccctcatctatacggcctgcactgggcttggtgtttcctcctggcccaggcagctccatctcttctgccattcctcctggacgaaagtggcaggaccccacctctaccacttccccacagggtcactgcacagcggcttcaaagacacgccctgttgaaggggaaacatcctccccccatcacactccaactcgtcaccccaaaagggaagtcaaagcacaggtccgtggggcctatggtttgtagacactgacacagtggttttcaaaccaggtgctgcggaacccctgatattccacagagctttgtcaggggatgctaaagtgggaagatgggagtggaggcaaaggataggtttccagccctcctcccatttccgccgccaccagaataactctgcttttatctgtcttgcctactgagatttcattttcaagctttctttgaagaagaacttcaaaccaccatctcgaggtttgatcttagaccagccagcacaggttctattcttgctgttcatgttggaatggctccagcgttccagtacaaagtgtctttgtgttggaacttgggtcacagacccaggcacaagcatttatacacacacacacacacacacacacacacacacacacacgtacatagttgatggtttttctagccaacccaccctgaagctctggccaaggtttgatttggacagggacctggtgctcagtggggatgggtcgtgaccctgatattggcccatgaagcatggggagctctggagcaaggaaacaggctcaatcccccactgaggacttgtgtctgcacccctatctggcaccccactttcctggcctaggcccaagggacacagcaggagaagcagtgtgataggagagaggctagggttaaattcatctttacacagcgccggatggatggaaatcttggctcacataaaagacagactcagggaggattttatgacaaaagtccctcctttgagggcaggattcccccaggaatcctggacactttagtgagaactggaccagcccttggcacaaaaccctgcctgccctgtcccccactcccaccccccagggaattctaggtgaaaatgtgaagctcagggcacagcaagcgcatgacacgggtgtattacattcggtccgagtgtgtccttagtttccctgtgtgcaaaatggggctagtccaggctcttcccacctcactgggacaattgcaagggtcataggagaggtgggtatgataggtggtcatatgaggtggtgagtatgagaggtgggtgcctcacaaactcggggtatggtcctgacctgcatggcagatgagcagagcacttgggaacgagcataggaagtgccatcttcccgggcatctctgctcagtgttaaggtctagccacagacactgtgggacctgcctcttcctatggaatgggggcctgcatgggttgtgtcctggggcaggagtgagggatggctgggaagaatctccaggtctgtggcccttgtgttgagtgattattttgtgacactctcattcctggaccacctgccaggtttatctgttatacctgtggcattcttattatgtcagacaagttattatagttcattcaactctaacaaatgaacaaaagaacaataaataggaggccattaaaggtcttttgtggaaaaaaaaaaaaaaaa

SEQ ID NO: 347 - DNA, 3370 bp, Homo sapiens
  ref <308>: DATABASE ACCESSION NUMBER: AL157492
  ref <309>: DATABASE ENTRY DATE: 2001-06-18
gtacagcatcacttgccccatcattgtgccttttgggttgctctacctgtgcatgaagcacttgacggatcgctataacatgtactactcctttgcacccaccaaactgaacgagcagatccacatggctgccgtctcccaggccatctttgcgccactcttgggtctgttctggatgctgttcttctccatcctgcggttgggttctctccacgccatcaccatcttttccctgtccaccctcctcattgccatggtgattgcctttgttggcatttttctggggaagcttcggatggttgccgactacgagcccgaggaggaggagatccagacagtgtttgacatggagccaagcagcacctcctccacgcccacctccctcctgtatgtggccaccgtgctgcaagaaccggagttgaatctgacccccgcctcctccccagccaggcacacctatggcaccatgaacaaccagccggaagagggagaagaagagagtggtctgaggggctttgcgagggagctagactcggcccagttccaggaagggctggaactggagggccagaaccagtaccactgaccgggacctgaggcctccactggcgacttgttgaggggtcaggggagggcctggcaaggggaggcaggagggtggcctggacctccccactacctcctgcagactttgagaagcccacagtggagacatccaccaccccagccatgggccatacgggggtcctgacctgctgcccggctggaactgggggtgctcggcagtgctgaaggagcctgggaagggatgggaggatacaggcaagcacatgtcttgagagaggtggctggagccccggcacagagactgaacgctggggtcccttcctgggaccaagatggagaaggtgttcctaagggaggagacagaaggaggctgccgaaggctctgtggggtcatcaccactctgcatcagctgcccttccaaggagcttctgctgctgctcctcctcccagccccggcccattcctcccctgcagtctgaggaggcaaaggtatgtgcacggggcacattgacaggacacggaggaccacctcatcacagggttccctgcatggggatctgtaaagagaaagtttctgcacccaccagagcaagagccaactgaaagcgtagacctgagaagaggtaactcagccccttcctgctcctctgccctcatcagatgtccccaggagcagcagggcagaggcccttctttctattcttacaagggtagctagagcgtgatcactcagggctcatcaaatgagactcgtgtgcatttttcagaaggaaaccttggttagtccttgctgggtaacacaaagtggggtgagacgacagaagccgaattcatggaaggggggtcttctccccaaaaactctgtgtggtgggaaaccagctatacctccccaagccccagggcctaaagagaagaccccctaagccaaagatgtggccacttaaaagcgtctcctgcctcctacccaactgagtgcctgggcccccagcttggccaagatgggcagtacgttagggtaagaaccccatgcttcaaacttaaggactgaccatcacctgcgtcccaagtaggacccttcctcccttctcggggctgcccctgcaccctgccttgaagaccacccaagcggcctccagtgtgggcctggtccagacattgcagatgcttcaaccgtgatgtcgccccaggcctgccaggggtgtggtggaggggaaggccacgtgctccagggagaagccctttctggagaagcaaggctgtcctcccagggctgccactaccagagacctgggggagctgaattccgaacagtgatggtgacactcagcacctttgccacagccggggggaaccggcttctgcctctgggatgggctctcatcaggaccaccgtgcagcccagccagggaggacatgagaagggccagtgggggcctcaatgaaccagaacaagccaagctgaatggggtctgtgtgctccagggccctcttcagccccctcccccaaaggtctgggtccctgccaccaacctactgaaggccggcccccggctcacctcacctgagcacctgcaccaggccccaggcacatggctgccctgaactcagatcacctagaccttgtccctgccccacctttgccccatcctagccccagaagctccaagcttcaccgcaggtgagaaattgtgctcaatgggcagaaactgctatacccccagggcatggcccacattttggcatgagggtgtctttccagagagcttgggttggctggagagaggctgtctttcccattccttgtccagctaggaataaaggggaaatggtcctagcctggcccctacacacccaggtcccacaggccccctccccactggaatttcaccaaccaacaaggggaaagtacgctgttacagcatagcggtcaggcccagcaggagcttggcacatgatggggaggtggccagctccaggccctgcccgaccccatcatgtgtatttggtgtatggggtgtggggggtcacaccagaagctggcctggggtctcttctttgctggacacagctccctggcccctgcccccagcccctgcagcccctgccggactgtggaagccacatatgggaaaagtcctggcagacaatgtggcgggatgactgggggcttctccctctgaacctgggtccagtgtagcctggctctgagagaaggtggtgagcatgtggagaaggttccatagtccactcttaggggaaccagcaaagcctcatggcagttggctccatctggacctcccatggtcactacaggatggtggagcagggggcatcttttagcctccccccgccaccacatccaggccctctcaggcacctcctgcctcagcccacacctgcctcacccattgcccccctccccccacctactgccatcccactcctctgccagccacttcccagccgccccaccccactccatccaccaaatcacctcctgacttaatcctttctggaaggagctgccgcccaggaaccggtattgcctagagcctccaggaggggccctcctcaggcctccagtggccccatgcccacctgcctgaccctccactgcccctggaagcaaagtgcctatcagcagcgttgcgtcctctggggcccccggtcgggggggagggggtgtgggctaaccttggccaccaccacaaaaggaatgtgccagaatgctgaaccttcttgttaatgctatgaccgtgccttgaataaacaagtcctcccaaaaaaaaaaaaaaaaaaaa

SEQ ID NO: 348 - DNA, 2039 bp, Homo sapiens
  ref <308>: DATABASE ACCESSION NUMBER: AL157505
  ref <309>: DATABASE ENTRY DATE: 2001-06-18
cggacgcgtggggggggagggcccctcaggtgagcagcccaccactgacttcagcgttgctggctcggttatcagactctcatccaacacaagctcacagggaaagccgttccttgctccttgtggagggagctaccgtcattgccctgagaccaccagccaagaaagtaggtatgtccaggtagggaattcagagggacccagtgcatccaattatacaattatacccagaaggtcctgtgtaggggactgcgattgacatcaccctagtctgcagcaccaaggactgaatgagctcagtcctcttataatttaggctggactgtcacagacactggcagacacagcatacgtggtgcagccaaagtgcaaacatgccagcagcggccatgctccccagggtgggggtccagttagtaagccacgcgcagccaagaggcgaggcatgccctgtgccacacacggactcaccctgctcactgtgcccgtggtatcgaaatgtacccacgtttaattcataaaggagaggctgctgtcattgaaagaaaagtttgttacttgcatttctggagaaaaggagcgcaccaggccacgcagggccacaggaggaggacgcaccagagtggtcaggaggcagaactaggcgagcagctttccactgtgtctccatggcaaaggcgaagatgggcgggggcagagtgtaggattggcaggtttgaatgtcttgggcagtagctacaggggtggtctccagctgcctggtgcctggccctgggtgatcagggtgaggggatactgccttctgcagtggaagagtcaaatcgaggagatggactctgagttggttagtgtgcaaaggtgcactcccaagggacccctttgctatctctaagaattggcctgccctgggaagggcagtctctccccagtcagtgaggtccccaagatgtgaaaacattatacattataaaaaagcatgattaatataagctcattctagcatttcaggttacagcttctagaagaggtttgtagtctcaaatgagtaggtttttcctctagagaggggcgggcctggaccttcaagcaccccttggtgtgtttaggagctcaggagcagaagcacctgcctgcagccctgcagctaaggaagttctctcagtcactcagagcagggaggggctgagagagtcatgtgaggctcccggggtactacgacagccctcgaggtgaaggattggccctgatcataatagagaaccctgaggaagtttactgtcatgagtctcggctggttggcgcatgtgacctttgaaggatgaagatggagtttgcaacatgagtatctctaaccttttgcttttcagggatcattttcaaaaattgcattggggccttcgttatttaccatagtattttcactttcatagttttgtcacctttttgtactgtgaacagttcaaccagtgaccgacttctctctcatgctgtttaccccacacacaatttcccactcaattctgaaaataagaacctgttaataggttggaaagctgtgtactctattcatatattgttctttcatgctagtggagagtggtgtcattagcatcttaattttagagttgtgaaatgattttaccaattaggaattgaatgtgtattttttttctgtttaataagaagagcaaatttgaataaataagctggtgtagataaacttaataatcatgctttttcttgtttggagataggtgatgtgttgtcatatcctgtgatacaggtcactcatctggccttctgtttctgaagtttaagtctggtttgaatatgtaataatactactcagcatttcttgttgcctaagtgagacgaaacttaaatgttatgatatttacttcatgtattcttgtactgttcatttcaattaattggtattgtatatctaatatgtgatatttgaactgaataaaacttacagtgttgtaaatgttctttaataaataatcacacctaagtaataaaaaaaaaaaaaaaaa

SEQ ID NO: 349 - DNA, 1500 bp, Homo sapiens
  ref <308>: DATABASE ACCESSION NUMBER: AL157851
  ref <309>: DATABASE ENTRY DATE: 2001-06-18
ggcgcgcaggacgaagctcgcggcgcgggacccggaggacggtatcccgagcccaccgtgctacgcagctattccaatcaagttctctgaaaagcaacaggcttctcactacctctatgtgagagcacacggcattcaacaaggcaccaagtccacctggcctcagaagaggactctttttgtcttcaatgtgcccccatactgcacagagcaggagagcctgtcctgcctccagtccacctgtggccttgtccagtctgtagagttgaaggagaagctggagctggctgggagtcaaggtcgaagttttttcatccaaagccagttccgggtttccaggtagcctacgtggtgttccagaagccaagtggggtgtcagcggccttggccctgaagggccccctgctggtgtccacagagagccaccctgtgaagagtggcattcacaaatggatcagtgactacgcagactctgtgcccgaccctgaggccctgagggtggaagtggacacgttcatggaggcatatgaccagaagatcgctgaggaagaagctaaggccaaggaggaggagggggtccctgacgaggagggctgggtgaaggtgacccgccggggccggcggcctgtgctcccccggactgaggcagccagcttgcgggtgctggagagggagagacggaagcgcagccaaaaagagctgctcaactacgcctggcagcatcgagagagcaagatggagcatctagcgcagctgcgcaagaagtttgaggaggacaagcagaggatcgagctgctgcgggcccagcgcaaattccgaccctactgagccgtgagagccgcagtggatggctggaggtgcagggccaggaggaacatgaggtgaggcagggcctgcagcggtctctgagaggccgagctctggccaacgggccccaggttgaaggccatcgcgtccaacagccccatcagagtccacacaggccaggagtgaaggaccaggccacccctcgggtcttgtgcttcagcagtcctggagacccaggcgtgcctagaggaggacttgtccttcccacctcttgcctccacacccttgaggaccctggatgaatccgttctgtgcttccttttccctcaatgcaaaagcccttgctggcaacaaaaaagcctcaaaagcagtgagaatacaagaaccttttattttccatccagttgggcagcagggaaaggctaggtgggcccagcctgcccttccttcctccagctggctggatatttattattagccaggagaaagcagccctggaacccagactctgtctcccccttgaggtcacagatgttgaagttggaatctcgctccttcccctgactaccatcctaggctgggcctcaagactagtgaggcctgtccccaccatccctggccttgttgtggggctcaggaactcagagtcccagtgttgagtctgggagcactaggtcttcatagttccaggcc

SEQ ID NO: 350 - DNA, 914 bp, Homo sapiens
  ref <308>: DATABASE ACCESSION NUMBER: AL160131
  ref <309>: DATABASE ENTRY DATE: 2001-06-18
cgcaccgcaggagcaacggttggtcctgcggctgtgatgtcggtgttgaggcccctggacaagctgcccggcctgaacacggccaccatcttgctggtgggcacggaggatgctcttctgcagcagctggcggactcgatgctcaaagaggactgcgcctccgagctgaaggtccacttggcaaagtccctccctttgccctccagtgtgaatcggccccgaattgacctgatcgtgtttgtggttaatcttcacagcaaatacagtctccagaacacagaggagtccctgcgccatgtggatgccagcttcttcttggggaaggtgtgtttcctcgccacaggtgctgggcgggagagccactgcagcattcaccggcacaccgtggtgaagctggcccacacctatcaaagccccctgctctactgtgacctggaggtggaaggctttagggccaccatggcgcagcgcctggtgcgcgtgctgcagatctgtgctggccacgtgcccggtgtctcagctctgaacctgctgtccctgctgagaagctctgagggcccctccctggaggacctgtgagggtggctggcccctgggctgccccttctcatggcttcgtgctgactccataaacattctctgttgaggatgtccagtcagggcttgacaggcccaggctcagcccgccgtggctgggaaggttccctgcagtgccagtgctgcagcagggagagctgggcagaagcagcgagggggcccagctggcgagactgtagccccctcccactcccacactcactcttgcagagcctgtgtctttaagcagctggcgtgttacatctccatttaaggtttcctttgaacaaaaggtctgtggctaaaaaaagtttaaaaatcactggtctcattcacca

SEQ ID NO: 351 - DNA, 4926 bp, Homo sapiens
  ref <308>: DATABASE ACCESSION NUMBER: AL161960
  ref <309>: DATABASE ENTRY DATE: 2001-06-18
cggagaaatagggagatgcaggaagtgggggcccatggggcccccaagaagcggactctccaaggggtacccccaccccgctaccttccccacggacgggcccctcctggagcccataccctcctgtgaggccattccagtgtcttctagaaagactcgcttgccaggagtgcgttctttgttgaaaaatgccctgaagcgaaaagatgcaggtttatatggaacccccaccccctcccccactctcccactctgttcgttctgaatgtcttcacgagcgtgcatcagggcgcctggctcccccacctcagccagtgagtcagacacgggtttcgcagccatgtttcctggctccgaggacacgggtggcaggcccgttgcagcccagagccactggtccctacagggcgccgccacaccagcaggaaggaggatggctgtgtccggagcctggcggggaggcggcctccccagtatgtgagtgcagggatctgccagaaccacctggccctctgtagggcgtttaactggaaataccctcactgccaagtggagactggggcgtgtgccacattgccagccaccaggaaagcttttctttttcttttttttttttttttttaaacaccaagagcacgtatagcatgggggaaagaacctaaatgtctctctgtcctgtgagctggtgaaaaacccagcatgagaacgcagtgtcaggtgtgggactccttctgcccctgcagtgggtgttacgggcggtgtgccctggcgagcaagctttgattcttggttctttgagctcgtttcagaggctgagtccccacatcagctttagttcttggacttccctgtattaagcaagaattaggagaatggctgtccctgcaggcgcctcccgtaaatcctgagctctctggcgcaatctgaaacttctcttctgttttctttggctgtatcagccgaaccaggagaggcctgggctgcgactaaggagaaagaaatcgggggtttctgagagcagatggtgcctttgtgggtgcagggcttttgtggaaattgtcagcctctacgggcagagtccggcatcccctccccagactgcctgctgtcaaaccacggagcagctggagcctgccctgtccacggcccgtttccacccgggcatgttcgtctctcatgacttcggcagaggcccctggtggccttcagtttcagtttctcatccaggaaggtaaccttgggcattggcagtgggtttccctatggcttggatccagattagaattgatctttgttttcactttccatagttaataacatgcaaaataatgagaagaatttattttaaggtgacagctatactggtccaacatcgcctgcttattgtcagggtacagaagtttaatactttcttaatccagtttttcaaacttctccctgtagaccgtaaggatgaattccacaataggatcctttttaaaatcgattttaaattgttgcctagtcctgccaaggttattatgtgcatctgttatttttccaatacatgtaaacagttgcagcatgatgctttgtttaatgtcctgttcttaagctcgttagagccagttttgaaacgtttggtcttaccgtgaacggaggctggcttggcttagccacgctgatgagtaagtgagggatgtctccatcttgagatcaccaggcaagagagttgcctgcaccaggtaagaggctaaagcccctggggtaacagtccccaccgctacccgaggtaaaacaataaaagctatgtggttgagctcaggcctctcgtgcctggtgtcagagaaggcagagcccacagtaggtgcagggtgcaaggccctgggagggcactggccagggaaggtggtatagatggccctcagattgcggggccccgagcagctccccactctgcccgtccaccttccctggctccagcctcattctctctttagtttaactatgcaaagagaggaggttgagagtgttctggcagctggagctcttttccttgtccttcctgccctccgatggggccacctgtgtcggggcagcagtgtccatgtttatggagatcagaggtgtccccactgtgtggctggactgtactctgctgcccgggtagccaggagtctctccctctctcccctgccgcctgcctggtctcatgggcctccttcacacacccctccctgtggatcgcctgcctgggcccagagcaggggaactggagtttgtgagtgagcagagcaggttatgtgcagacagggaaacgagaactttggacctggctttctgagtccaggtgagagctgtgtggccccccgatgccactctgcccgccggagggatgtgcctgctgagccttttccttccacgccgcctctcactgccaggccagcggcttccgctgagactcgctggagaggcggctcccgtgtccgtccaccgagcactcagatggatgctgatcaccagggccgagggggctcccagaaggaccccaggccctggggagggtggctgtgggaggccaagtccactgcccggaagtcttgtcagccctaagccagggaagcctggagcgtggcctggcgggtctgggtggacaccgtccccactccggactcccagcacaggggagagcctgtatggccctgtagccctgggcagagctgggcctgtcgtgtgttcctgcctggcaggtgcaggtgctggccatctgcaggtggaaggaggtgggaatcttggattttttgtttttttttgtcttttttttttgagatgaagtctcgctctgacacccaggctggcgtgcagtggtgtgatctcggctcactgcaaactccgcttcctgggttcaagtggttctcctgccccagcctcccaagtagctgggattacaggcatgcgccaccacgctcagctgatttttgtatttttagtagagatggggtttcaccatgttggccaagctggtctcaaactcctgacctcaagtgatctgcccgcctcggcctcccagagtgctgggattacaggcgtgagccagtgcacccggcggaatcttggaatttttatagacggcacctcagtttctgactccagccgcacacctcctgcctctaccagcaggggttgccgccagaccagagccagggccaggtccctgcgtccatcccccccggtaggatggacgtgagccatccttctaggggacttttttcagtgtgcgactcgtctctgttaggtggtaggagccagtttgtgtggcctgtgccacgctccacagtgcgtggctgggctctgtgtgtggcctgtgtcccctgtccctgcaggacccagcaggcatcgtggcgtgacagctgtgtccaagccactgcccgggcatcccatcacccaccagggtgcacggtctctcctgctgggggctttctgtcgcatgtgtgtctcctgtcgactctgcagtttgttctcagagcagaatgtttcctgttctcagtgcacaaagacactggttttcaatcggcgtctaaaaccacgttcctgcctttcattgcaacacggtgtgttcatttgtttaaaacagtttaatgagtaagtttagatgactggtcaatatcttaaaaatgtatattagtaagaagttcttcctggaatttttctttcgattctggcagaataaacaggtgtttttagttttcccactgtctgagccaagcaggaccctgtcccagagcaagagatgtccccttccatctctgacccttgcctgggacaagctttgatggggggccccagcttcaaggctgtggtgggaacagcacccccaaatgccagcctctcctttcttcccatccaccagtatactgcggggccatttctggtctttgtccaacaggaaacccatttctggtgggatatgccttccagtgccacagggccactcaccccatgcatctctgtcctgcccgtcagtgctgggacggacagcaagggcaagcccagtgtctggcagataggtgggtgggaacagagaggggagaatgccgtcctaagcttctgcttggggatcccccacacgacctgggtactgcctgggaaacctgtcctaagtaaaactatggacctcgcctcgcccaccggcctgcgaagccagcatctccgtgaaggtggatggaagcgcctttgtcctcactttgagctgcaagctgggtcagcggctctgaagccctcgagtgactttctaacccaagacccagcccctggcaggaggagggtgggtgcagggctggtgggacaaaaagaggcctcagcaggcctggaagacccttccagtacatcccacagcgtgtcgagcagctgggagaacctgtgtcaagctcgagccgtcataggtccccatgaggtgtctgaagccccttcttggtgatgggaggcagaggtgctgacgttctggagcatggacgtgagtcctcagctggctccgcgtgggcccttggagggtgccaggtgtgtggtgaccttctggatgcctttaacttcatggctgcgtcattcctgatttagaactttaaccggagcttcatctagtgattgcaaaactggaccaatgggaggacggcggcgcagcccgctccctccgtggaatggagctcagctcttcggaggcatcaaagcacctgtcgcctccgtggtccccctgccgagggagtgcggcctctgcaaggttcgggggtggcttcgtttgcctggagtggccggccctgcttgtgccatgtggatgtttgtgagcctcggtcctacagcactgtgtaggctgcatctgtttcgtgctggtcctgttgacttgtatgatatccacaaataaatattttcatggtaaaaaaaaaaaaaaaaaaa

SEQ ID NO: 352 - DNA, 3333 bp, Homo sapiens
  ref <308>: DATABASE ACCESSION NUMBER: AL162049
  ref <309>: DATABASE ENTRY DATE: 2001-06-18
gtgcgggcgagaagatggcggcggcgggggaagcagcgtgagcagccggaggatcgcggagtcccaatgaaacgggcagccatggccctccacagcccgcagtatatttttggagattttagccctgatgaattcaatcaattctttgtgactcctcgatcttcagttgagcttcctccatacagtggaacagttctgtgtggcacacaggctgtggataaactacctgatggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagccctggtcaatggccatgccaattcagcagtcccgaacagtgtcagtgcagaggatgcagaatttatgggtgacgtgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctggcagagacaccctgtcaaggacagctggggctcagccctgcgttggtaccgatactactgaaaaccttggagttgctaatggacaaatacttgaatcctcgggtgagggcacagctaccaacggggtggagttgcacaccacggaaagcatagacttggacccaaccaaacccgagagtgcatcacctcctgctgacggcacgggctctgcatcaggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagattgcagagttgctggagaatgtaaccctaatccataaaccagtgtcgttgcaaccccgtgggctgatcaataaagggaactggtgctacattaatgctacactgcaggcattggttgcttgcccgccgatgtaccacctgatgaagttcattcctctgtattccaaagtgcaaaggccttgtacgtcaacacccatgatagacagctttgttcggctaatgaatgagttcactaatatgccagtacctccaaaaccccgacaagctcttggagataaaatcgtgagggatattcgccctggagctgcctttgagcccacatatatttacagactcctgacagttaacaagtcaagcctgtctgaaaagggtcgacaagaagatgctgaggaatacttaggcttcattctaaatggacttcatgaggaaatgttgaacctaaagaagcttctctcaccaagtaatgaaaaacttacgatttccaacggccccaaaaaccactcggtcaatgaagaagagcaggaagaacaaggtgaaggaagcgaggatgaatgggaacaagtgggcccccggaacaagacttccgtcacccgccaggcggattttgttcagactccaatcaccggcatttttggtggacacatcaggtctgtggtttaccagcagagttcaaaagaatctgccactttgcagccatttttcacgttgcagttggatatccagtcagacaagatacgcacagtccaggatgcactggagagcttggtggcaagagaatctgtccaaggttataccacaaaaaccaaacaagaggttgagataagtcgaagagtgactctggaaaaactccctcctgtcctcgtgctgcacctgaaacgattcgtttatgagaagactggtgggtgccagaagcttatcaaaaatattgaatatcctgtggacttggaaattagtaaagaactgctttctccaggggttaaaaataagaattttaaatgccaccgaacctatcggctctttgcagtggtctaccatcacggcaacagtgcgacgggcggccattacactacagacgtcttccagatcggtctgaatggctggctgcgcatcgatgaccagacagtcaaggtgatcaaccagtaccaggtggtgaaaccaactgctgaacgcacagcctacctcctgtattaccgccgagtggacctgctgtaaaccctgtgtgcgctgtgtgtgcgcccagtgcccgcttcgtaggacaccacctcacactcacttcccgcctctctttagtggctctttagagagaaactctttctccctttgcaaaaatgggctagaatgaaaaggagatgccttggggttcgtgcacaacacagcttctgttgactctaacttccaaatcaaaatcatttggttgaaacagactgttgcttgattttagaaaatacacaaaaacccatatttctgaaataatgctgattcctgagataagaaagtggatttgatccccagtctcattgcttagtagaataaatcctgcaccagcaacaacacttgtaaatttgtgaaaatgaattttatctttccttaaaaaagaaattttttaatccatcacacttttcttccctaccctttagtttttgataaatgataaaaatgagccagttatcaaagaagaactagttcttacttcaaaagaaaaataaacataaaaaataagttgctggttcctaacaggaaaaattttaataattgtactgagagaaactgcttacgtacacattgcagatcaaatatttggagttaaaatgttagtctacatagatgggtgattgtaactttattgccattaaaagatttcaaattgcattcatgcttctgtgtacacataatgaaaaatgggcaaataatgaagatctctccttcagtctgctctgtttaattctgctgtctgctcttctctaatgctgcgtccctaattgtacacagtttagtgatatctaggagtataaagttgtcgcccatcaataaaaatcacaaagttggaaaaaaaaaaaaaaaaaaaaa

SEQ ID NO: 353 - DNA, 1715 bp, Homo sapiens
  ref <308>: DATABASE ACCESSION NUMBER: AL355708
  ref <309>: DATABASE ENTRY DATE: 2001-06-18
aggaaatggaggggctgctgaggtcctgtgaatgtttctgtcattgtactttcttccagaagcctgcagagaatggaagcatcttctttattgtcctttcctggcatgtccatccttattgtcactacgttgcaactggagtttgatttggatctggttttaaaattcttctgtgcaatagatgggtttgaggatttagcggccctgatgtcttggtcatagcctggtaagaatgtccatgctgaggagccagatgttgtatttctaactgcctgagtcacacagaatagggtaagagcctgaccccattctgtaaatcagaaagcaaggatggagaccctttcctgctgctattattggctctctttgaggaagttggaggttaaggaaggaacttgtttgtttccgtatacgactccttcttctctctagttcagtcttcagccagtccagcgctctcttccacacttcagagccccttcagagaaagcattagcaggaatgagacaaggcagagctgcagtgccccctgaggcttccacacatctttctgaatattatttttcaagtaacaagggcagggacagcggaaacagctgcccaccccccccatcccagcagctcagctaagccctgatgagaatgaagccacaggagttgtctgaggtgaacccagccgctcagccacacatggaagccattgcctttgcacatagttcttgggttctttttcctaaaaaggtaaggagctgaggtgtgtggttttttaatattaagaatatataatggaaaacacacgactgacgctcaggcatcttcccctactccccaacagatccccagaagacagcgtggaaggcagtgtagacagtaaatcgggcttcagttctatagccaagaagagatcagctgctgaaaccaccagtgggtaccccaggccacctgcctttgaacttggggatttgccatgtttgatcttgtcacatacttgcttttttacaagatgaactctttgtatttatgatttggggggcaatgaaaggtgcaatgcaggaactgctgctgccgagctcgctggtcacatgggggtgccaggcgggattctggaaaaccagtgcacttaaactgatcctgaagagagctgtcccagcactctggccaccaggagggccagattccccagaaactaccttttgcccaaagaacatgctcagtatttggggcatttcctcccacaaaccctgactgcttctgttacctcagggccttggtacctggatactgccacagaattggggcgggtgggggaggggcctatttttaaataaaataactgttcaaagttgggggttttttaaaaaattaagaaaaaggaaagctattctgtattgcaccttttcacaatttaatacattttcttacattttcctgtgattttcgaaactaaaccattgtgtgtcctgtagtgtcctggttgagctgccgctcagcagcttcctcggggggatttggaacacctgtgtctgtcgccgcactgcctgtgggaggggcccagagggctgctgggactggcgtctgtacacacttgtttggccttttctgtagttgatgctgtaaactctatggctttttaaaaacgatttcatgtttttatttagtattggaaatccaatacacttttttaatccaatcaaaaaaaaaaaaaaaaaaaaaaa

SEQ ID NO: 354 - DNA, 1841 bp, Homo sapiens
  ref <308>: DATABASE ACCESSION NUMBER: AL359053
  ref <309>: DATABASE ENTRY DATE: 2001-06-18
ccacgcgtccgcccacgcgtccgaatgattcatgggggcctgatttgcatttgaaaaatgtttgaaattagagtctcatttgtttcaggaatgcagctacctgagttttttgtctcggcaaagtcacaaagcccatatactcacattgtgtgtctatacttgccaattaattctaaacttgtaggaaatatgccctctcttaaaggagaattttttttaaatctctgagaaatgagattctgagtttatttcagctaaaaggttgcaattcttctgaagatatctcaaatataaggttgaaagttaagtgttaataatttttgtgaatttatacacacctaaacgttaagtacacaaatattttatttgttttacaaataaggaataagtaatttataaattaagaagttacctataaaaataaaaagataacaaccctatcatatagcttatttttaaattacctgaaaaacgatattctacactgtttcctttttgactctgagttttcaaactgttacttctcccatatttctcaatccatttcactcagttgcacagtcttttaaaccctgtaattgtcataccaaagtttctttttaaaaaaaaattactttaaatgcttagtttattcaaagagcgatccaataatataaaaggaacatgtgttaaacacaataaaattttaaatggctctaaatcaagcacatcaagagtatacaagtcttaaaggctttttaatacatactcttttcccatctatgtaacccaacttgcacatttcagctgcatgtggtgaatatgcatcatatatttactttaagaggtaagattttacttgcaaaatacatgtgcaaattaggatccatcagttgatggaagagatggactctagaatattatttcttgtggttattactcctttacaaagcactttcgtctcacttgatcctcataaggaaactaaggctcagaatgagtagagctgggttcagaatctagctcttctaactccaagccatctcctctttccactgcaggaaactgcctcttttgtcagtgaaataatagaaagattgtgttagttaagtgataactgtcatttgtttgaaaatgttcgagactgaacaaatagcatttaaactgctggcatatagatgagatattgtacttttgtgcaatgtttattacctttgattaaattgtaatgtgaagcttttactaggtgaatagttcattatgtagtggaggcttcgtggttgtccattgaattgtcacagcaaaatctataagtttcttcaattctacaagatagatccatatacctttgatcacttggagactctttttttgctggtttctagataactcaggtaaatcagacctttacagagtacagggctaggtgaaagaattactgaaaaatcaccttgaaaatccgaagggctgatataccctttatgttcctgactgatgcgcagaacctgggggaaatctacagcaatatacaggttgcaatgctgataacacaacagcaatcctctcctctacgtggacttactgttgtttttttaattattattggaatgggattttagaaaatagaagttacctttgtgtgtgttttagggaaggtagagaagaatctgctctttctctgaatactgttttgaccccaggcaggaccttggaaaggccaaaacattaacagtagtacttctgttcactgaagagttatgttacatgaagataaaatggttttgtcgtgtttattattgtattttgtgttgatataaataaacatggtaatttaaacaatgaaaaaaaaaaaaaaaaaaaaa

SEQ ID NO: 355 - DNA, 4187 bp, Homo sapiens
  ref <308>: DATABASE ACCESSION NUMBER: D13643
  ref <309>: DATABASE ENTRY DATE: 2001-06-18
ggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacatcatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggccagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaagcctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctgg

SEQ ID NO: 356 - DNA, 1779 bp, Homo sapiens
  ref <308>: DATABASE ACCESSION NUMBER: D14678
  ref <309>: DATABASE ENTRY DATE: 2001-06-18
gtgagaggactcaaacgttggaccaagagaaccagcagcttcaggaccagctcagagatgcccagcagcaggtcaaggccctggggacagagcgcacaacactggaggggcatttagccaaggtacaggcccaggctgagcagggccaacaggagctgaagaacttgcgtgcttgtgtcctggagctggaagagcggctgagcacgccaggagggcttggtgcaagagcttcagaaaaaacaggtggaattgcaggaagaacggaggggactgatgtcccaactagaggagaaggagaggaggctgcaacatcagaagcagccctgtcaagcagccaagcagaagtggcatctctgcggcaggagactgtggcccaggcagccttactgactgagcgggaagaacgtcttcatgggctagaaatggagcgccggcgactgcacaaccagctgcaggaactcaagggcaacatccgtgtattctgccgggtccgccctgtcctgccgggggagcccactccaccccctggcctcctcctgtttccctctggccctggtgggccctctgatcctccaacccgccttagcctctcccggtctgacgagcggcgtgggaccctgagtggggcaccagctcccccaactcgccatgatttttcctttgaccgggtattcccaccaggaagtggacaggatgaagtgtttgaagagattgccatgcttgtccagtcagccctggatggctatccagtatgcatctttgcctatggccagacaggcagtggcaagaccttcacaatggagggtgggcctgggggagacccccagttggaggggctgatccctcgggccctgcggcacctcttctctgtggctcaggagctgagtggtcagggctggacctacagctttgtagcaagctacgtagagatctacaatgagactgtccgggacctgctggccactggaacccggaagggtcaagggggcgagtgtgagattcgccgtgcagggccagggagtgaggagctcactgtcaccaatgctcgatatgtccctgtctcctgtgagaaagaagtggacgccctgcttcatctggcccgccagaatcgggctgtggcccgcacagcccagaatgaacggtcatcacgcagccacagtgtattccagctacagatttctggggagcactccagccgaggcctgcagtgtggggcccccctcagtcttgtggacctggccgggagtgagcgacttgaccccggcttagccctcggccccggggagcgggaacgccttcgggaaacacaggccattaacagcagcctgtccacgctggggctggttatcatggccctgagcaacaaggagtcccacgtgccttaccggaacagcaaactgacctacctgctgcagaactctctgggtggtagtgctaagatgctcatgtttgtgaacatttctccactggaagagaacgtctccgagtccctcaactctctacgctttgcctccaaggtgaaccagtgtgttattggtactgctcaggccaacaggaagtgaagacggatccagatctgtgtgtgtgtgtgtgtgtgtgtgtgtgtgtgtgtgtcctatgtctatgtatcgggtgaggggtgggagggttgctggagggtgctttattgggtggagggcaccatgtcccagggctatcaaataaagaatagtttggttttttttttaaataaaggttttattaccatttgcccaagaaggcagatactttcatatctgt

SEQ ID NO: 357 - DNA, 2591 bp, Homo sapiens
  ref <308>: DATABASE ACCESSION NUMBER: D25328
  ref <309>: DATABASE ENTRY DATE: 2001-06-18
cccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgcggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcggccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccaccagctccagtgcgtgctgtctgtggagtgtgtctcatgctttcagatgtgcatatgagcagaattaattaa

SEQ ID NO: 358 - DNA, 9517 bp, Homo sapiens
  ref <308>: DATABASE ACCESSION NUMBER: D26070
  ref <309>: DATABASE ENTRY DATE: 2001-06-18
gttgctgtcggagagagaaagccgcacccgagaggaggtgtgggtgttccgcttccatcctaacggaacgagctccctcttcgcggacatgggattacccagcggctgctaacccctctcctcgccctgctcccccaaaccggcgtggctccccgggcaccaaggagctgactacagaggagcaggatttgcacccctcgctgggcttgctttggcaacagagtgcctgacccaggtcaggattttcaagaaagacatgtctgacaaaatgtctagcttcctacatattggagacatttgttctctgtacgcggagggatcgacaaatggatttattagcaccttgggcctggttgatgatcgttgtgttgtacagccagaaaccggggaccttaacaatccacctaagaaattcagagactgcctctttaagctatgtcccatgaaccgctactctgcccaaaagcagttctggaaagccgctaagcctggggccaacagcaccacagacgcagtgctactcaacaaactgcaccacgctgcagacttggaaaagaagcagaatgagacagaaaacaggaaattgctggggaccgtaatccagtatggcaatgtgatccagctcctgcatttgaaaagtaataaatacctaacagtgaataagaggcttcctgctctgttggagaagaatgccatgagagtcacattggacgaggctggaaatgaagggtcctggttttatattcagccattctacaagctgcgatccattggagacagcgtggtcataggtgacaaggtggttctgaaccccgtcaatgctggtcagcccctacatgctagcagccatcaactggtagataacccaggctgcaatgaggtcaattccgtcaactgcaatacaagctggaaaatagtccttttcatgaaatggagtgataacaaagacgacatattaaaggggggtgacgtggtgaggctgtttcatgctgagcaggagaagtttctcacctgtgacgaacacaggaagaagcagcacgtcttcctgagaaccacgggccggcagtcggccacatctgccaccagttcaaaagccctgtgggaggtggaggtggtccagcatgacccatgtcggggcggagcagggtattggaacagccttttccgtttcaagcatctggccacggggcattacttggcagcagaggtggaccctgatcaggacgcctctcgaagtaggttgcggaatgcccaagaaaagatggtatactccctggtctctgtgcctgaaggcaatgacatctcctccattttcgagctagatcccaccactctgcgtggaggtgacagccttgtcccaaggaactcttatgttcggctcagacacctatgtactaatacctgggttcacagcacaaatattcctattgacaaggaagaagaaaagcccgtgatgctgaaaattggcacctctcctgtgaaggaggataaggaagcatttgccatagttccggtttctcctgctgaagttcgggacctggactttgccaatgatgccagcaaggtgctgggctccattgctgggaagctagagaagggcaccatcacccagaatgaaaggaggtctgtaaccaagctgctagaagatttggtttacttcgtcactggtggaactaattctggtcaagatgttctcgaagttgtcttctccaagcccaacagagaacggcagaaactgatgagagaacagaatattctcaagcagatcttcaagttgttacaagccccattcacagactgcggtgatggcccaatgcttcggctggaagagctcggggaccagcggcacgctcctttcagacacatctgccggctctgctacagggtgctgagacactcgcagcaagactacaggaagaaccaggagtatatagccaagcagtttggcttcatgcagaagcagattggctatgatgtgttggctgaagacactatcactgccctgctccacaataatcggaaactcctggaaaaacacattaccgcggcagagattgacacatttgtcagcctggtgcgaaagaacagggagcccagattcttagattacctctccgacctctgtgtctccatgaacaaatcaattccagtgacccaggaactgatatgtaaagctgtgctgaaccccaccaacgctgacatcctgattgagaccaaattggttctttctcgttttgaatttgaaggtgtctcttccactggagagaatgctctggaggcaggagaagacgaggaagaggtgtggctgttttggagggacagcaacaaagagattcgcagcaagagtgtgagggaattggctcaggatgctaaagaagggcagaaggaggaccgagacgttctcagctactacagatatcagctgaacctctttgcgaggatgtgtctggaccgccaatacctggccatcaacgaaatctcaggccagctggatgtcgatctcattctccgctgcatgtctgacgagaacctgccctatgacctcagggcgtccttctgccgcctcatgcttcacatgcatgtggaccgagatccccaggaacaagtcacccccgtgaaatatgcccgcctctggtcggagattccctcggagatcgccattgacgactatgatagtagtggagcttccaaagatgaaattaaggagagatttgctcagaccatggagtttgtggaggagtatttaagagatgtggtttgtcagaggttccctttctctgataaagagaagaataagcttacgtttgaggttgtaaatttagctaggaatctcatatactttggtttctacaacttctctgaccttctccgattaactaagatccttctggccatattggactgtgtacatgtgacaacaatcttccccattagcaagatggcgaaaggagaagagaataaaggcagtaacgtgatgagatctattcatggcgtgggagagctgatgacccaggtggtgctccggggaggaggctttttgcccatgactcccatggctgctgcccctgaaggcaatgtgaagcaggcagagcctgagaaggaggacatcatggtcatggacaccaagctgaagatcattgagatactccagtttattttgaatgtgaggttggattataggatctcctgcctcctgtgtatatttaagcgagagtttgatgaaagcaattcccagacttcagaaacatcctccggaaacagcagccaagaagggccaagtaatgtaccaggtgctcttgactttgaacacattgaagaacaagcagaaggcatctttggaggaagtgaggagaacaccccactggacttggatgaccacggcggcagaacctttctccgtgtcctgctccacttgacgatgcatgactacccacccctggtgtcaggggccctgcagctcctcttccggcacttcagccagaggcaggaggtgctccaggccttcaaacaggttcaactgctggttaccagccaagatgtggacaactacaaacagatcaaacaagacttggatcaactgaggtccatcgtggaaaagtcagagctttgggtgtacaaagggcagggccccgatgagactatggatggtgcatctggagaaaatgaacataagaaaacggaggagggaaataacaagccacaaaagcatgaaagcaccagcagctacaactacagagtggtcaaagagattttgattcggcttagcaaactctgtgttcaagagagtgcctcagtgagaaagagcaggaagcagcaacagcgtctgctccggaacatgggcgcgcacgccgtggtgctggagctgctgcagattccctatgagaaggccgaagataccaagatgcaagagataatgaggttggctcatgaatttttgcagaatttctgcgcaggcaaccagcagaatcaagctttgctacataaacacataaacctgtttctcaacccagggatcctggaggcagtaaccatgcagcacatcttcatgaacaatttccagctttgcagtgagatcaacgagagagttgttcagcacttcgttcactgcatagagactcacggtcggaatgtccagtatataaagttcttacagacaattgtcaaggcagaagggaaatttattaaaaaatgccaagacatggttatggccgagctggtcaattcgggagaggatgtcctcgtgttctacaacgacagagcctctttccagactctgatccagatgatgcggtcagaacgggatcggatggatgagaacagccctctcatgtaccacatccacttggtcgagctcctggctgtgtgcacggagggtaagaatgtctacacagagatcaagtgcaactccctgctcccgctggatgacatcgttcgcgtggtgacccacgaggactgcatccctgaggttaaaattgcatacattaacttcctgaatcactgctatgtggatacagaggtggaaatgaaggagatttataccagcaatcacatgtggaaattgtttgagaatttccttgtagacatctgcagggcctgtaacaacactagtgacaggaaacatgcagactcgattttggagaagtatgtcaccgaaatcgtcatgagtattgttactactttcttcagctctcccttctcagaccagagtacgactttgcagactcgccagcctgtctttgtgcaactgctgcaaggcgtgttcagggtttaccactgcaactggttaatgccaagccaaaaagcctccgtggagagctgtattcgggtgctgtctgatgtagccaagagccgggccattgccattcccgtggacctggacagccaagtcaacaacctctttctcaagtcccacagcattgtgcagaaaacagccatgaactggcggctctcagcccgcaatgccgcacgcagggactctgttctggcagcttccagagactaccggaatatcattgagagattgcaggacatcgtctccgcgctggaggaccgtctcaggcccctggtgcaggcagagttatctgtgctcgtggatgttctccacagacccgagctgcttttcccagagaacacagacgccagaaggaaatgtgaaagtggcggtttcatttgcaagttaataaagcatacaaaacagctgctagaagaaaatgaagagaagctctgcattaaggtcctacagaccctgagggaaatgatgaccaaagatagaggctatggagaaaagggtgaggcgctcaggcaagttctggtcaaccgttactatggaaacgtcagaccttcgggacgaagagagagccttaccagctttggcaatggcccactgtcagcaggaggacccggcaagcccgggggaggagggggaggttccggatccagctctatgagcaggggtgagatgagtctggccgaggttcagtgtcaccttgacaaggagggggcttccaatctagttatcgacctcatcatgaacgcatccagtgaccgagtgttccatgaaagcattctcctggccattgcccttctggaaggaggcaacaccaccatccagcactcctttttctgtcgcttgacagaagataagaagtcagagaaattctttaaggtgttttatgaccggatgaaggtggcccagcaagaaatcaaagcaacagtgacagtgaacaccagtgacttgggaaataaaaagaaagacgatgaggtagacagggatgccccatcacggaaaaaagctaaagagcccacaacacagataacagaagaggtccgggatcagctcctggaggcctccgctgccaccaggaaagccttcaccactttcaggagggaggctgatcccgacgaccactaccagcctggagagggcacccaggccactgccgacaaggccaaggacgacctggagatgagcgcggtcatcaccatcatgcagcccatcctccgcttccttcagctcctgtgtgaaaaccacaaccgagacctgcagaacttcctccgttgccaaaataacaagaccaactacaatttggtatgtgagaccctgcagtttctggactgtatttgtggaagcacaactggaggccttggtcttctgggcttgtatataaatgaaaagaacgtagcgcttatcaaccaaaccctggaaagtctgaccgaatactgtcaaggaccttgccatgagaaccagaactgcatagccacccatgaatccaatggcattgacatcatcacagccctgatcctcaatgatatcaatcctttgggaaagaagaggatggaccttgtgttagaactgaagaacaatgcctcgaagttgctcctggccatcatggaaagcaggcacgacagtgaaaacgcagagaggatactttataacatgaggcccaaggaactggtggaagtgatcaagaaagcctacatgcaaggtgaagtggaatttgaggatggagaaaacggtgaggatggggcggcgtcccccaggaacgtggggcacaacatctacatattagcccatcagttggctcggcataacaaagaacttcagagcatgctgaaacctggtggccaagtggacggagatgaagccctggagttttatgccaagcacacggcgcagatagagattgtcagattagaccgaacaatggaacagatagtctttcccgtgcccagcatatgtgaattcctaaccaaggagtcaaaactacgaatttactatactacagagagagacgaacaaggcagcaaaatcaatgatttctttctgcggtctgaagacctcttcaatgaaatgaattggcagaagaaactgagagcccagcccgtgttgtactggtgtgcccgcaacatgtctttctggagcagcatttcgtttaacctggccgtcctgatgaacctgctggtggcgtttttctacccgtttaagggagtccgaggaggaaccctggagccccactggtcgggactcctgtggacagccatgctcatctctctggccatcgtcattgccctccccaagccccatggcatccgggccttaattgcctccacaattctacgactgatattttcagtcgggttacaacccacgttgtttcttctgggcgctttcaatgtatgcaataaaatcatctttctaatgagctttgtgggcaactgtgggacattcacaagaggctaccgagccatggttctggatgttgagttcctctatcatttgttgtatctggtgatctgtgccatggggctctttgtccatgaattcttctacagtctgctgctttttgatttagtgtacagagaagagactttgcttaatgtcattaaaagtgtcactcgcaatggacggtccatcatcctgacagcagttctggctctgatcctcgtttacctgttctcaatagtgggctatcttttcttcaaggatgactttatcttggaagtagataggctgcccaatgaaacagctgttccagaaaccggcgagagtttggcaagcgagttcctgttctccgatgtgtgtagggtggagagtggggagaactgctcctctcctgcacccagagaagagctggtccctgcagaagagacggaacaggataaagagcacacatgtgagacgctgctgatgtgcattgtcaccgtgctgagtcacgggctgcggagcgggggtggagtaggagatgtactcaggaaaccgtccaaagaggaacccctgtttgctgctagagttatttatgacctcttgttcttcttcatggtcatcatcattgttcttaacctgatttttggggttatcattgacacttttgctgacctgaggagtgagaagcagaagaaggaagagatcttgaagaccacgtgctttatctgtggcttggaaagagacaagtttgacaacaagactgtcacctttgaagagcacatcaaggaagaacacaacatgtggcactatctgtgcttcatcgtcctggtgaaagtaaaggactccaccgaatatactgggcctgagagttacgtggcagaaatgatcaaggaaagaaaccttgactggttccccaggatgagagccatgtcattggtcagcagtgattctgaaggagaacagaatgagctgagaaacctgcaggagaagctggagtccaccatgaaacttgtcacgaacctttctggccagctgtcggaattaaaggatcagatgacagaacaaaggaagcagaaacaaagaattggtcttctaggacatcctcctcacatgaatgtcaacccacaacaaccagcataagcaaatgaaagaaaggaattgtatttaccttttataattattattagtgtgggtatggctaatgagttctgattcacccacgaaggttacatttatgctgaatacatttgtaaatactcagttttatactgtatgtatatgattgctactctaaaggtttggatatatgtattgtaattagaattgttggcatgatgacatttcatttgtgccaaaaatattaaaaatgccttttttggaaggactaacagaaagcacctgatttgcacttgaaccagattatagatttaaaagtatatgacatgtattttgtatttaaaactagaatagccagtatttatgttttttataaaactgtgcaatacgaattatgcaatcacaatacatttgtagctcccgagtgtcctaaagggagtgcacttctttgaagctggtgtgttaatactatgtaataaatggttaactttcaaatgatgctgctgccaaaattatattaatagtgagtttcaggcccctgggcattttgtaccatgtaattatcctctggtgatgctgtttctcgttagtggcagtagtgcctccgtctcctagtgataatgctccaagtctatgaactgttaaatcagcattcattttaagaaaagcaactttagtttcaaagatacttttaagcttctaaattgatcatttaaactatttctttaaataagagagccaaattagaggctcatactttagcttgtgaagaagataatgaattttttaaagggaactttctatgcaatgttcaggataaatcgatactgctggccaatcagtgtcatctcctgggtaaattttgatgtcgcattataaagacatgcataattgatggtttctagattatctagtccaaacaatagagtttattttttcttcatctgaaccaacatgctacagtagctaagaagtattaaaactatatacatccatataaagatgaaatatgaactatctcattagaagtcatagttgaccacagacatgttattcttctgaaagagccacattttggttttatttcttgtcacatgatttcttttcttgatggatgaaaaatatgaaatgaaatcttttatatctgttgcctagttttgtacatggatctcattttacaagagaatctctctgcta

SEQ ID NO: 359 - DNA, 3500 bp, Homo sapiens
  ref <308>: DATABASE ACCESSION NUMBER: D26488
  ref <309>: DATABASE ENTRY DATE: 2001-06-18
cacgtggctgcagcggggccagagcagcaatggcggcgggcggcggcggtagctgcgaccccctggcccctgctggggtcccttgcgccttctccccgcacagccaggcctacttcgctttggcctctaccgacggtcacttacgagtatgggagacggccaacaaccggctgcaccaggagtacgtgccttccgcgcacctcagtggtacctgcacctgtctggcctgggcgccagcgcggctgcaggccaaggaaagtccccagaggaaaaaaaggaaatcagaagctgtaggaatgagtaaccagactgacttattggctcttggcacagcagttggtagcattttattatacagcacagtaaaaggagagttacacagtaaattaataagtggtggacatgacaacagagtcaactgcatacagtggcatcaagacagtggctgtttatatagttgttcagatgataaacatattgtggaatggaacgtacagacatgcaaagtaaagtgcaaatggaaaggggacaatagcagtgtcagttccctatgtatcagcccagatggaaagatgttgctttcagctggtcgaacaatcaaactatgggttttggagaccaaagaagtctacaggcatttcacaggacatgcaacgccagtttcgtcactgatgttcactaccatcagacctcctaatgagagccagccctttgatggaattacaggtctttatttcttatctggagcagtacatgaccggttacttaatgtctggcaggtccgatcagaaaacaaagaaaagagtgcagtgatgtcatttacagttaccgatgaacctgtctatattgacttaactttgtcagaaaacaaagaagagcctgtcaagttggctgttgtttgcagagatggtcaagtccatctttttgaacacatattaaatgggtactgcaaaaagcctttgacttcaaactgcacaattcagatagcaacacctgggaaaggcaagaagtcaacaccaaaacccatccctattctagctgctggtttttgctcagacaaaatgtcattgttgcttgtatatggcagttggtttcagcctactattgagcgagtggctttaaactccagagaacctcatatgtgtttagtaagagatatttcaaactgctgggcccccaaagtagaaacagctataacaaaggtgaggacaccagtgatgaattctgaagcaaaagttctggtgcctgggattcctggtcatcatgcagctatcaagcccgctcctccacaaaccgagcaagtagagagcaagaggaagtcagggggaaatgaggttagcattgaagaacgtctgggagcaatggatatagacacacacaaaaaaggaaaggaagacctccagacgaatagctttccagttcttcttacccagggcttagaaagtaacgattttgaaatgctaaataaagtacttcaaactaggaatgtaaaccttataaagaagactgtattaaggatgcccctgcatactattattccgttgttacaagagcttacaaagaggttacaaggacatcctaatagtgctgtgctaatggttcagtggctaaaatgtgtgttaacagttcatgcatcatacctgtccacgttgcctgacctggtaccccagctggggacactctaccagttaatggaaagcagagtcaaaacttttcagaaactttcacaccttcatggaaagcttattcttctaattacacaagtaacagcatcagagaagacaaagggagcaacttcccctggacagaaggcaaagttggtgtatgaagaagagtcttctgaagaggagtctgatgatgaaatagcagataaggattctgaagataattgggatgaagatgaggaggagagtgaaagtgaaaaagatgaggacgttgaagaggaagatgaggatgccgaaggaaaagatgaagaaaatggcgaggacagagatacagcaagtgaaaaagaattaaatggagattctgacttagatcctgaaaatgaaagtgaagaagaatgaagacagcaaagcaagccggtcaaactatataaactctggctcaccttgcccagtggtgagggctgcctctgtgccaggatgccaaggaccgctgcacatttccaaattcacagcagtggatcccatgccactttgctgtcctgagcaccccagacttgactgtgtaaataagagtgtttcattcaaatgttaataaactttacacagtatatagacacattttctgcaatgtactgacatcagtgtccaatatatggtatatttttataatataatatcctagtatgattggttatatcaagaattgacaagtgcagataaagacctttcccataggagttcaagaactggactgttgtgaagaagtcagctcttatctcaggttggtatctttcatcaaatccagatgcaaagcagcactagtgaaaatttttttaatttagtacatttaatttggtacattttcataaaatatgaagggataactacaaactggagtaaaaatgatggtaattaaaaaaaatcctcagtatccctagcttgtctattaactgtgataatctgacttgagtcagattgaatatttggagtgcttccccagaataaccacttatttttgaagctatcatgtgaagtatttttttaaaacaaaacaaaaattatggtcattaaaaaactagagaattagccatattaaggatttttcttgactgcaaattacttctaaagaatcatcagtgtatagattagaagtgctcattacctgcaacttttaaaaaaaattcagttatagctgcttttgaagaggtttccatttttatttaaattactaatggatcaaagaacaattgtttattttttctctttggttttagatattaatgataaccttgttggaattttttttccaaagaaaatatttttataattaaataatttaatgtttttcttccttttcattacctactcttggcagtgttagggtatctgtttacctttaaaatgataagtctcactcaagattttttatctatgtataaatattttggtgtgctacaaaagcctttacaaattatcagtagtagtttttttttttttttttttttttaaagaatgagccgatattggcttagtgctcactaggggacatgcacatggaagctcacctctaagaaagggctgggcagatggatttattttttcccacctgtgaatatgtaaaacaaaaccattatctttgagggagtttttaataccaatgacagaacagagatttgtgtgctcatcttaagagccagagccatataagcatcttgggaaagcaagtttgaaccagctgctggtgtaatgtacagttatatttgtctataaatggagctgtttatggcaatttaataccattctctttgtaaagtgaataaatattcatcttttccc

SEQ ID NO: 360 - DNA, 4573 bp, Homo sapiens
  ref <308>: DATABASE ACCESSION NUMBER: D31887
  ref <309>: DATABASE ENTRY DATE: 2001-06-18
cgcgtgtctacgcggacgcaccggctaagctgcttctgccgccgccggccgcctgggaccttgcggtgaggctgcgcggggccgaggccgcctccgagcgccaggtttattcagtcaccatgaagctgctgctgctgcacccggccttccagagctgcctcctgctgaccctgcttggcttatggagaaccacccctgaggctcacgcttcatccctgggtgcaccagctatcagcgctgcctccttcctgcaggatctaatacatcggtatggcgagggtgacagcctcactctgcagcagctgaaggccctgctcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggatacggtctcctctgtgtgaccgtcatctccctctgctccctcctgggggccagcgtggtgcccttcatgaagaagaccttttacaagaggctgctgctctacttcatagctctggcgattggaaccctctactccaacgccctcttccagctcatcccggaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccacaatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgttccctgagatgaatgaggtctgtcaagaggatgaaaggaagggcagcatcttgattccatttatcatccagaacctgggcctcctgactggattcaccatcatggtggtcctcaccatgtattcaggacagatccagattgggtagggctctgccaagagcctgtgggactggaagtcgggccctgggctgcccgatcgccagcccgaggacttaccatccacaatgcaccacggaagaggccgttctatgaaaaactgacacagactgtattcctgcattcaaatgtcagccgtttgtaaaatgctgtatcctaggaataagctgccctggtaaccagtctctagctagtgcctcttgccctctcctcacctccttttctctcagtgactctggaacctgaatgcagcttacaagacaagcctgacttttttctctgattaccttggcctcctcttggaaccagtgctgaaaggttttgaatcctttacccaacaatgcaaaaatagagccaatggttataacttggctagaaatatcaagagttgaatccatagtgtggggcccatgactctagctgggcaccttggacctccagctggccaatagaagagacaggagacaggaagccttcccattttttcaaagtctgtttaattgcctattacttctctcaaagagaacctgaagtcagaacacatgagcagggtgagaggtgaggcaaggttcatcctgaatgggagaggaagtcgaaccactgctgtgtgtcttgtcaggatgctcacttgttcctactgagatgctggatattgattttgtaacagcacctggtgtttcacggctgtccgagtgagctaacgtggcggtgtggctgcctggacctcctctttcaggttaacgctgacagaatggaggctcaggctgtctgcaagaaaacagttggtttggctgtgattttgacctcctcttccccactgccatcttctaagagactttgtagctgcctcctagaagcacattctgagcacatttgagacctctgtgttagaggggagactgcacaaactatcctcccccaggttgagacgtctgcagagtggcaagctgacttgtagaaatggggtgccatttatgctctacttagacaagggtaatcagaaatggaatcagtgcaggcaaaatttaggatttgccgcttccataaatcaaagcatgactaatagggggtctctgaaatgtaagggcacaaacttcacttagggcatcgcagatgtttgcagaatggttggcctaatgattatgctacagatgggttttaaatgacccgtctaggttactgcttccttgcaaaaaaagtcgaatcctgcattgaattgaatatgaatttctctaactctctccagaaaatggatggagataacttgtctttaaaactgtaggccagccttagccactgtggagcccttgcctccgagctctggcttcaaggggagctcttctccaggttcactaggtgaattgatttattattatcatattgataatgtgagattctttagccactttggggagcctgtctctccagaagcctttcttagtggtgcccacagttggagcccaggggccatgtttgcaaactgattcatgtgcatggctgacaggagtactggttcactaccaatgcctgagcttttctcttacatagaaaaactgtccactctcagtaatcacaagcagcatccgttttgttttctcttcttgggagacatctgtcaaaccaggaatattcttgaaaagaacgtgagcaggaaaaactgctggtgatactttttttaagttttgtttttatcttgcctgttggcttcaatacatttgagaatacgctgaagagggaaaatttcagtgatggagattctagattaaatatcaggactgatttcctggtgggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgcccccaaaggtattttgtgtctagtgtcaaattggagctattcttcactggtccttaaccttgggttttaaaaagaaggcttctctgtttgggtagcgtaagagctgagtatagtaagtcctcttccaaagagatggcaatatgctgggcatctactttaaaacaaagttgtctgatttttgcaagagaggttaggattttattgttcttatttccctttacagttctgcagttccatcacagtatttttttaaataactcaggtgtatgagcagaaattagaaaagaaaattaacttatgtggactgtaaatgttttatttgtaagattctataaataaagctatattctgt

SEQ ID NO: 361 - DNA, 6106 bp, Homo sapiens
  ref <308>: DATABASE ACCESSION NUMBER: D38521
  ref <309>: DATABASE ENTRY DATE: 2001-06-18
cgccgagtccgacttgcagctggcccagatcaaatgcaacctgggccgggccgtgcagctccaagagctgtggcccgggggcctcttctggaccaggaaactctccacatatattcgactttatgggagaaaatttagcaaagaagatcatgttctttttattaagttattgtatgagctggtatcaattccaaaactggaaatcagcatgatgcagggatttgcccgccttttgatcaacttgttaaagaaaaaggaacttctttcaagagctgatttggagttaccctggagaccactttatgacatggtagaaagaatattatattccaagacagagcacctaggattaaattggtttcctaattctgtagaaaatattctcaaaacactcgtgaaaagctgccgaccatattttccagcagatgccaccgctgagatgctagaagaatggcgacctttaatgtgcccttttgatgtaaccatgcaaaaggccatcacttattttgaaatatttcttcctacctcccttcctccagaacttcatcataaaggttttaaactttggtttgatgaattaattggcctttgggtttcagtgcaaaatctcccacaatgggaggggcaactagtaaatctctttgctcgattggctacagataatatagggtacatagattgggatccatatgtaccaaagatatttacaagaattctgagaagcttgaacctcccagtgggaagcagtcaagtgttagtcccaagatttttaacaaatgcttatgatataggacatgctgtaatatggatcaccgccatgatgggtggaccaagtaagctagtgcaaaaacacttagctggtttgtttaacagcatcacatctttttaccatccttcaaataatgggcgctggctgaacaagttaatgaaactacttcagcggttgccaaacagtgttgttagaagattgcatcgtgaaagatacaagaagccctcttggttaactcctgtgcctgatagccacaagcttactgatcaagatgttacagactttgtacaatgcattattcagcctgtcctcttggctatgtttagcaaaaccggtagtctagaagcagcccaggctttgcagaatcttgcactcatgagacctgaattggtaataccccctgtacttgaaagaacatatcctgcattagagacattaacagaacctcaccagctcacagctactttaagttgtgtaattggagtagcccgcagtttggtatcaggaggcagatggtttcctgaaggtcctacacatatgctacctctgttgatgagagcattgcctggggtggatccaaatgactttagtaaatgcatgatcacattccagttcatagcaacattttctactctggtgcctttagtagattgttcatctgtactacaagaaagaaatgacctcacagaagtggaacgagaactttgttcagccacagctgaatttgaggatttcgtcttacagtttatggacagatgttttggacttatagaaagtagcacattggagcaaacaagagaagagacagaaactgagaaaatgacacacttggagagtttggtcgaattaggtctgtcttctacgtttagtacaatcctcacccaatgttccaaagaaatatttatggtggcccttcagaaggtttttaatttttctacttcacatatatttgaaacaagagtagcaggtcgcatggtggcagacatgtgccgcgctgctgtaaagtgctgcccagaagaatctttgaagctctttgttccccactgctgcagtgttataactcagcttacaatgaatgatgatgtattaaatgatgaagagctagacaaggaattactatggaatcttcaacttttgtctgagattactcgagtggatggaaggaagttgcttctttatagggagcagcttgtaaagattctccaaagaaccctacatttaacctgtaagcagggttacactctgtcttgtaaccttttgcatcatcttctccgttctaccacacttatctaccctacagaatactgcagtgtgccaggtggctttgacaagcctccttctgaatactttcctatcaaggactggggcaaacccggggacttgtggaatctgggaatccagtggcatgttccttcttcagaagaagtgtcttttgccttttatcttttggactcctttcttcagcctgagctcgtcaaactccagcattgtggggatggaaaacttgaaatgtctagagatgatattctacagagtctgactatagtgcacaactgtttaattggctctggaaacctcctacctccgttgaaaggagagccagttactaacttagtaccaagtatggtgtccttggaagagacaaagttgtatactggacttgaatatgatctgtctcgagagaaccaccgagaagtaattgctacagttataaggaaacttcttaaccacatacttgataattcagaagatgatactaagtcattgtttcttattataaagattattggagaccttttacaattccaaggatctcacaagcatgaatttgactcccgatggaaaagcttcaacttagtaaagaaatcaatggaaaatcggctccatgggaaaaaacaacatatcagagcactgttgattgatagagtaatgttacagcatgagctacggacactaactgttgagggttgtgaatacaaaaagatacatcaagatatgatcagagatcttcttcgtttatctacaagttcatacagtcaggtgagaaataaggctcagcaaacattttttgctgccttgggagcatataacttctgttgcagagatatcattcccttggttttggagttcttaaggcctgatagacaaggtgttacacagcaacaattcaagggtgccttgtactgtctccttggaaatcacagtggtgtgtgcttggcaaaccttcatgattgggactgtattgtacagacgtggccagcgattgtttcttcagggcttagccaagcaatgtccctggaaaagccatcaatagtgagattgtttgatgatcttgcagaaaagattcataggcagtatgaaacaattggcttggacttcacaattccaaagtcatgtgttgaaatagcggaattacttcaacagtcaaaaaacccctctatcaaccagatattgcttagcccagaaaaaattaaggaaggaattaaacgccaacaagaaaagaatgccgatgccctaaggaactatgaaaatttggtagacaccttgctagatggtgtggagcaaagaaacctgccctggaaatttgaacatataggcattgggcttctgtctctactgctgagagatgaccgagtgttgcctcttcgtgccatacggttttttgttgagaatctcaaccatgatgcaattgtagttcgaaagatggctatctcagctgttgctggtatccttaaacagctaaaaagaacccacaaaaagctgaccattaacccctgtgaaatcagtggatgccctaaacccacccaaattattgctggtgataggcctgataatcattggttgcattatgacagcaaaactataccaagaactaaaaaagaatgggagtcaagttgctttgtggaaaaaactcactggggatactacacctggccaaagaatatggttgtttatgctggtgtggaagagcagcctaagcttggcagaagcagggaggatatgacagaggcagaacagattatatttgatcatttttctgatcctaaatttgttgagcagttaattacttttctatcattagaagacagaaaaggaaaagataagtttaatccacgacgtttttgtctctttaagggtatattcaggaattttgatgatgccttcctgccagttctgaagccccatttagaacatttggttgcagattcacatgaaagcacccagcgatgtgttgcagaaattatagctggtttaatcagaggttctaagcactggacatttgaaaaggtggagaagctttgggagcttctgtgccctctgcttagaacagcactgtccaatattaccgtagaaacttataatgactggggagcttgtatagcaacatcctgtgaaagcagagatccccggaaacttcactggctttttgaactgctgttggaatcaccattgagtggtgaaggaggatcctttgtagatgcatgtcgactttatgtactacaaggtggccttgcccagcaagaatggagagtgcctgaactattgcacagactactgaagtacttggaacccaaactcacccaggtttacaaaaatgtcagagaaagaataggaagtgtgctgacctacatattcatgatagatgtatctttgccaaataccacaccaaccatatcgcctcatgtccctgagtttactgctcgaattctggagaaattgaaacctctcatggatgtggatgaagaaattcagaaccatgttatggaagaaaatggaattggtgaagaagatgagcgaactcagggcattaaactcttgaaaaccatattgaaatggctgatggcaagtgcaggaagatccttttctacagcagttacagaacaacttcagcttctacctttgtttttcaagattgccccagtggaaaatgacaatagctacgatgaactgaaaagagatgcaaagttatgtttatcattaatgtctcaggggttgctttaccctcatcaagtgcctttggtacttcaggtgctaaaacaaacagcaagaagcagttcttggcatgcacgatacacagtactgacctacctccagaccatggtattttataacctctttattttcctaaacaatgaagatgcagttaaagatatcaggtggctggttataagtcttttggaggacgaacaactggaggttcgagaaatggctgctactaccttaagcggtctgctacagtgtaactttcttaccatggacagtcctatgcagattcattttgagcaactttgcaaaacaaaactacctaagaaaagaaagcgagaccctggttctgtaggagataccattccttctgcagagttggtcaaacgccatgctggggtgctaggacttggtgcatgtgttctttctagtccttacgatgttcccacctggatgccccagctcctcatgaatctcagtgcacatctaaatgatcctcagcctattgagatgactgtaaaaaaaaccttatccaatttccgaaggactcaccatgacaactggcaggaacataaacagcaattcactgatgaccaactgcttgttctcaccgatcttcttgtgtcaccatgctattatgcatagaaagatgactagtcctcacttcaggctcttttcatcaaaaattccacaccctcaggtaccatctgtggtggctctctgcaagttttaaaactgcctctgctgagctctcatcattttggtggtttctgtgttagatctcgttagtctgcattccacagcttctcagttgccatttgatttcccaacttgtccggaagtgtttccagaatactgatcactttttttttttgaggcatctgacaaagtcacaaagtctcagactagaaataattacccagtatgatcatggcatccaagaccagagtctcagaactcattaagaaacagtttacttggaatggagaatacccatctgtaatacaggtcctgtcatttcattcatctcaaattattttgaattcttcccaaatggctgctggatttaggtggtaataggggctgtgggccataaatctgaagccttgagaaccttgggtctggagagccatgaagagggaaggaaaagagggcaagtcctgaacctaaccaatgacctgatggattgctcgaccaagacacagaagtgaagtctgtgtctgtgcacttcccacagactggagtttttggtgctgaatagagccagttgctaaaaaattgggggtttggtgaagaaatctgattgttgtgtgtattcaatgtgtgattttaaaaataaacagcaacaacaat

SEQ ID NO: 362 - DNA, 2726 bp, Homo sapiens
  ref <308>: DATABASE ACCESSION NUMBER: D38553
  ref <309>: DATABASE ENTRY DATE: 2001-06-18
caggagacgccaaggaaagatgggacctcccggcccagcactgccagccacaatgaataactcttcttcagagacgcgaggacacccccacagtgcctcctctccttcagagcgtgtgttcccgatgcccctgcccaggaaggcgcctctcaatattcctggcaccccagtcctcgaagactttcctcagaatgacgatgagaaggagcggctgcagcggaggcgctcgagggtctttgatctgcagttcagcactgactcacctcgcttattggcctccccctccagcaggagtattgacatttcagctactatccccaagtttacaaacacgcagattacggaacattactccacctgtatcaaactgtccactgaaaataaaatcactaccaagaatgcttttggtttgcacttgattgattttatgtcagagattcttaaacagaaagacaccgaaccaaccaactttaaagtggctgcgggtactctggatgccagcaccaagatctatgctgtgcgcgtggatgccgtccatgccgatgtatacagagtccttggggggctgggcaaagatgcaccgtctttggaagaagtagaaggccatgttgctgatggaagtgctactgaaatgggaacaaccaaaaaggctgtaaagccaaagaagaagcacttacacagaactattgagcagaacataaacaacctcaatgtctccgaagcagatcggaagtgtgagattgatcccatgtttcagaagacagcagcctcatttgatgagtgcagcacagcaggggtgtttctgtccactctccactgccaggactacagaagtgaactgctgtttccctctgatgtccagactctctccacgggagaacctctcgagttgccagagttaggttgtgtagaaatgacagatttaaaagcgcccttgcagcagtgtgcagaagatcgccagatctgcccttccctggccgggttccagtttacacagtgggacagtgaaacacataatgagtctgtgtcggccctggtagacaagtttaagaagaatgaccaggtatttgacatcaatgctgaagttgacgagagtgactgtggagacttccccgatgggtccctgggggatgactttgatgccaacgatgaacctgaccacaccgcagttggggatcatgaagagttcaggagctggaaggagccctgccaggttcagagctgccaggaagaaatgatttcccttggggatggagacatcaggaccatgtgcccccttctgtctatgaaacctggagaatattcttatttcagtcctcggaccatgtcgatgtgggctggcccggatcactggcgctttaggcctcgacgcaaacaagatgctccttcccaatcagaaaacaaaaagaagagtacaaaaaaagattttgaaattgactttgaagatgatattgactttgatgtatattttagaaaaacaaaggctgctactattctgaccaagtccactttggagaaccagaattggagagctaccacccttcctacagatttcaactacaatgttgacactctggtccagcttcacctcaaaccaggcaccaggttacttaagatggcccagggccatagggtagagactgagcattatgaagaaattgaagactatgattacaacaaccctaacgacacctccaacttttgccctggattacaggctgctgacagtgatgatgaagatttggatgacttatttgtgggacctgttgggaactctgacctctcaccttatccttgccatccacctaagacagcacaacagaatggtgacactccagaagcccaaggattagacatcacaacatatggggagtcaaacttggtagctgagcctcagaaggtaaataaaattgaaattcactatgccaagactgccaaaaagatggacatgaagaaactgaagcagagcatgtggagtctgctgacagcgctctccggaaaggaggcagatgcagaggcaaaccacagggaagctggaaaagaagcggccctggcagaagtggctgacgagaagatgcttagcgggctcacgaaggacctgcagaggagcctgccccctgtcatggctcagaacctctccatacctctggcttttgcctgtctcctacatttagccaatgaaaagaatctaaaactggaaggaacagaggacctctctgatgttcttgtgaggcaaggagattgagttcactatggagaagtcagcagcaggaggcccatcccttactcagttgccgggacatccccagtctcgggggaagaagatgccatgggcttatacccaggctgtagccaactaccaacgtgcctgtttgtttgttgctctttccttctctccatcatagtctgggtgccagcgccctgaagctccgtgctcaactgattaaactttactgccctatggtgaccatctaggagaggggagggcagagggggtgagggtactattctggattgagaaaacctatatccattctttatatcaatgtatagttttagtctcctaaattgatctgttattttccaaactattctcttgtagaaaattttccagtgggcacttaatggtgcccttgaagaacttcctaatccatgtacataaaatacatcatatgtacacttataaatgtatatagaatgctcaaaaataaaattcttaataatag

SEQ ID NO: 363 - DNA, 2918 bp, Homo sapiens
  ref <308>: DATABASE ACCESSION NUMBER: D42043
  ref <309>: DATABASE ENTRY DATE: 2001-06-18
gggctccggcgagggacagacgcaccgatcgccggagggacagacacacgaccacgcggcgccaccgcccacgcctccacccaccggcgcccaagtcctccccgcgccgcctcctctgtatggcacaaactttcctcccgggacggaacacgctgcctcagggagcccgcgaccgcgccttctcctccgccggtcccatacgctgctgaaatgggttgcggattgaacaagttagagaaacgtgatgaaaaacggcctgggaatatttattcaactttgaagaggcctcaggtggaaaccaagatagatgtgtcctatgaataccgcttcctggagttcacgactctgagtgctgcggagctccctgggtcctcagcagtgaggctggcctccctgcgtgacctgcccgcccagctcctggagctgtaccagcagggcttctcgctggcggccctgcaccccttcgtgcagcccacccatgagcgggagaagacgcccctggagcacatctttagagccatcctgatcaagaaaaccgacagatctcagaaaactgatcttcacaatgaaggctacatcttggaattagattgctgttcctccttagaccacccgacagaccagaaactcatcccagagttcattaagaagatccaggaggctgcaagccagggcctgaaattcgttggtgttatacctcagtaccattcctctgtgaactcggcaggcagcagtgctccggtgtctactgccaacagcaccgaggatgccagagatgcaaaaaacgcacgtggggatcacgcgtcactggagaatgagaaaccggggactggggatgtgtgcagtgctccggctgggagaaaccaaagcccagagcccagctcaggccccagaggggaggtgcccctcgccaagcagcccagctcaccctccggagagggagatggtggagaactttcaccacagggggtgagcaagacactggatggaccggagagcaaccccttggaggtgcatgaagagccactctcagggaaaatggagatcttcacccttttcaacaaaccgaagagccatcagaagtgccggcaatactaccctgtcaccattcctctccatgtctccaagaatggccagacagtgagcggtttggacgccaactggttagagcacatgagcgaccacttccggaaaggaggcatgctggtgaacgcagtcttctaccttggaatagtgaatgattccttacatggcttgacagatggagtattcatctttgaagctgtttccacagaagatagcaaaaccatacagggctatgatgctattgtggttgaacaatggacagtcctggaaggtgtcgaagtgcagacagactacgtgcccctgctgaactcgctggcggcctatggctggcagctcacctgtgtgctaccaactcccgtcgtcaagactaccagcgaggggagtgtatccaccaagcagattgtctttcttcagagaccttgtctacctcagaaaatcaagaagaaggaatcgaagtttcagtggcgattctccagagaagaaatgcacaacaggcagatgaggaaatcaaaaggtaaactcagtgccagagacaaacaacaagcagaagaaaatgagaagaacttagaagaccagtcttccaaagctggagacatgggaaactgtgtttcaggacagcagcaggagggtggagtctccgaggagatgaagggccctgtccaagaggacaagggagaacagctgtcccctggtggcctgctgtgtggggtgggtgtggagggtgaggctgtgcagaatggtcctgccagccacagcagggccctggtggggatttgcactgggcactccaatcctggagaggatgccagggacggggatgctgaggaagtcagagagcttggtacggttgaagaaaactgagtcttgggcaatttgtgctaaaactaggtgagttgccaaacccaaggcatcttaccaacagctggtttgggggctggtttccctggtgttgtgtgttacctaccctttggcttggcttgacctctccttgtgagctcacctgagccctcccagggccaggttcctgacagtgttggtttttgcacatccactggaaaggtgtcattaatgacccagtgttagaatgcaagaggtcaggttattctagccctcatggctgaaggcccagtcctggctccaccactcctccagccagagggtctggaccatccagtgcctgtcctcgccacagggcctccagggagcattcgggtcaaatccatggacaccctgggctacaaaccaaggctgctgttcatcccacatcgtgtggggcagtgtccatcccctgcagctacttggtgacttaacaactccaggagccctgtcagctgccctcctccacctaaaccccttcgactcttctgctttgacaaagaaaatgacattggggaggggaggtgctccgcctcccagcttttctcaaaatagtcctatagatactggtaatctggaaatgaagaagtaattctgtctctgcacctacttttgcagaatgttcaaggaagtattctgtgttagtattaatgccaaaaagttgtttttaaaggttttgtactcagcacatcatacaaaccacattacttctgtcacttcagggcatcgggactggctggcgcccttgttatgtgctattttaatcagtgtaacattggtcaagttgttacccatgtatgctgtgtttatcatgtgtatatcgtccagaaagtattaaggctttaggtagatgcaactggcgaaccttggagagggaatgctgattgtcttgaccaaacccacagcctgtctcttctcttgtttagttacttacggcaataaatcatctatgagtt

SEQ ID NO: 364 - DNA, 4043 bp, Homo sapiens
  ref <308>: DATABASE ACCESSION NUMBER: D42047
  ref <309>: DATABASE ENTRY DATE: 2001-06-18
cgaagcgggtcctgccccgctgtcagctgcggcccccggcgccgggcgggggtggccgcgaccattggcggagaggcgaaaggggcggggccgccgccagccgctgcgggcaaggctgaacaggcggaggtgggcagccggccagggaagcacggtccaggcggctacattcggcccggccatggcagcggcgcccctgaaagtgtgcatcgtgggctcggggaactggggttcagctgttgcaaaaataattggtaataacgtcaagaaacttcagaaatttgcctccacagtcaagatgtgggtctttgaagaaacagtgaatggcagaaaactgacagacatcataaataatgaccatgaaaatgtaaaatatcttcctggacacaagctgccagaaaatgtggttgccatgtcaaatcttagcgaggctgtgcaggatgcagacctgctggtgtttgtcattccccaccagttcattcacagaatctgtgatgagatcactgggagagtgcccaagaaagcgctgggaatcaccctcatcaagggcatagacgagggccccgaggggctgaaactcatttctgacatcatccgtgagaagatgggtattgacatcagtgtgctgatgggagccaacattgccaatgaggtggctgcagagaagttctgtgagaccaccatcggcagcaaagtaatggagaacggccttctcttcaaagaacttctgcagactccaaattttcgaattacggtggttgatgatgcagacactgttgaactctgtggtgcgcttaagaacatcgtagctgtgggagctgggttctgcgacggcctccgctgtggagacaacaccaaagcggccgtcatccgcctgggactcatggaaatgattgcttttgccaggatcttctgcaaaggccaagtgtctacagccaccttcctagagagctgcggggtggccgacctgatcaccacctgttacggagggcggaaccgcagggtggccgaggccttcgccagaactgggaagaccattgaagagttggagaaggagatgctgaatgggcaaaagctccaaggaccgcagacttctgctgaagtgtaccgcatcctcaaacagaagggactactggacaagtttccattgtttactgcagtgtatcagatctgctacgaaagcagaccagttcaagagatgttgtcttgtcttcagagccatccagagcatacataaagtgaatcatgcaacgtgttgggggaagttctgcctttctgatcaatcttttgggttcacgtggaaaccaggacttggcaacatgatgtttgactgtaatctcatcacggatatgtatgaatttttacaggttcgtttttgaattgtgagaggcagttcattagcaaagatgtactgggcagtaactaaacacacatgcaaacatgtgaatggtggtttattcctcattctgtggatgtttctatgagccaaaatttgatgtctttttttcaaaattgcttatgaaatttccacacaatcgtagcttataagattggaacgatctcagccaaatattttaggtgtaattcatatgtatttgagtggaggattttttttctcatttttctagtgttaaattttaaccagcattaacatggtagagtggaggagtgagtgtgttcaaagatcaacatatttaacttttaaacactatctcaaagccagcataattaactactttgattgtgggctgacctttgtttttttaacaatcaggcatttttaattagataatccactcatgtatttccccctcactgcagttgtctgcatttttagcctcttttctcttcgttagttgtcagaatatgcctttgtcaaggctcagaggtaacaagacagaaaattcatctgggattttcctgctgtggctggcacattcttctgattaacagacacttgtatgatgctttaggctagttagtgcattttttagcaaacatttatcttaaacatcacagatccactggggggtgcaaggggctactgttagtcctcttgttagatgcagtcactcctcctggtcacctagtgagcagggacagagccaggagtcaagtgcagtgccaaggtgcatgaccctctgagaagtcactgggctgatttgacctccgactcattggttgtgtaaatgccatgtgcagcctttcctgaggccataggagggcttcctgcagctgagatctatgcaggccatcctctcaacaggtgccactccaagggcggtcctcggtgcagcagcatcagcttcacttgtgggggggtgggggaaggggcggtctcagaaatgcaggttcccaggtcccaccctggacttctgaaggggtgtggcatctgtgtttctgatgcttactacaatatgtgaaccactactttagaaaatctgctttaacttggtattcctctaattgtgttccctaggaaatgactgtcccaagagccagtgattattccaggtgttccctggaaaggtcaagtgagtctgggaaacactatgtctgtacacctcttgaaggtgtcgaatgtatgtttatacatcagtggaacccatttttctagcctagcaagtcccaaacacattacactgaagagattttggtgaggaaacttgctggagttttcagggaacactgttctaggcttaggtgaccttaggatcactcaagtagacccttcactccctgcgagaaattaggatgaataactacctgtggcattgttggttctgaacttttacagttcaggcctgctgtgaatctttgatgaagctttaaggtgacactgttgtacaagatgtcagctttgctgaaacgcacattacctggaataagtgctttaattgtagaattagaatgggatttactgtactgttttaaatgagattggcttcagaatccattacagttaccttacatagcacttgatacgtgttaaatgaacatatgaatgtaatttatatattcctagaatttaagttactttgtgagatttgggcctgtccctcaatgccagtttaggatttctttttttctataccttgaaatgattataaaatagattttcatgggaattttaaaaactctatccaaaacatttttggagcattttaaagccccatacacagaagtatacgaaagcacacaaaacactccaagtttcagcagttttagcgccaccattaacccactttgcttgtctcatgaaaaatctttgttaaagtttgtacacaggtaacaaaaagttactttaaaagatatataaagggctgtaagctaattgtggtgtctagtaagtagcataatgagatgtgaggagttggaactttgcgtgttttgcgtattttcatctgcattcagcttcttactctgggtttgtactcgagtgttatttctttacaaatgcccttgtaattaccactctgaagtctgctgactgtgtctcttgaacatacttaggatattctgcacattatggaaaaaggtaaattttagaagtttctgctctactaactgtagatatttatgactctgcgagttatctatttttataaccacctgtggtccattgttcattttaattcacatttcttatgaagtatggtaacagggagggagacacctagattagcagctcaatttgtactacttcagccaatctgtgaatgtaaaaactacactgttgccttgctaggatccaccctcctataatatggaacaaatatctgaatgaaatccaccctaggagacggagtcaaactaaacttgtggtttttcatttaacttttgactacagcatggccccatggcatccacaccaagagggtgttgtgatgaggtgccggtgtgcaaagggaactttagtttttccactggttcttatctgctagccttttacatacatgtgtactatatttgtttatagactgtaggtggatatataatttaaaagcttgatttaataaacatttaaccccctaaacttgggg

SEQ ID NO: 365 - DNA, 1938 bp, Homo sapiens
  ref <308>: DATABASE ACCESSION NUMBER: D43950
  ref <309>: DATABASE ENTRY DATE: 2001-06-18
attccggttgttgcaccatggcgtccatggggaccctcgccttcgatgaatatgggcgccctttcctcatcatcaaggatcaggaccgcaagtcccgtcttatgggacttgaggccctcaagtctcatataatggcagcaaaggctgtagcaaatacaatgagaacatcacttggaccaaatgggcttgataagatgatggtggataaggatggagatgtgactgtaactaatgatggggccaccatcttaagcatgatggatgttgatcatcagattgccaagctgatggtggaactgtccaagtctcaggatgatgaaattggagatggaaccacaggagtggttgtcctggctggtgccttgttagaagaagcggagcaattgctagaccgaggcattcacccaatcagaatagccgatggctatgagcaggctgctcgtgttgctattgaacacctggacaagatcagcgatagcgtccttgttgacataaaggacaccgaacccctgattcagacagcaaaaaccacgctgggctccaaagtggtcaacagttgtcaccgacagatggctgagattgctgtgaatgccgtcctcactgtagcagatatggagcggagagacgttgactttgagcttatcaaagtagaaggcaaagtgggcggcaggctggaggacactaaactgattaagggcgtgattgtggacaaggatttcagtcacccacagatgccaaaaaaagtggaagatgcgaagattgcaattctcacatgtccatttgaaccacccaaaccaaaaacaaagcataagctggatgtgacctctgtcgaagattataaagcccttcagaaatacgaaaaggagaaatttgaagagatgattcaacaaattaaagagactggtgctaacctagcaatttgtcagtggggctttgatgatgaagcaaatcacttacttcttcagaacaacttgcctgcggttcgctgggtaggaggacctgaaattgagctgattgccatcgcaacaggagggcggatcgtccccaggttctcagagctcacagccgagaagctgggctttgctggtcttgtacaggagatctcatttgggacaactaaggataaaatgctggtcatcgagcagtgtaagaactccagagctgtaaccatttttattagaggaggaaataagatgatcattgaggaggcgaaacgatcccttcacgatgctttgtgtgtcatccggaacctcatccgcgataatcgtgtggtgtatggaggaggggctgctgagatatcctgtgccctggcagttagccaagaggcggataagtgccccaccttagaacagtatgccatgagagcgtttgccgacgcactggaggtcatccccatggccctctctgaaaacagtggcatgaatcccatccagactatgaccgaagtccgagccagacaggtgaaggagatgaaccctgctcttggcatcgactgtttgcacaaggggacaaatgatatgaagcaacagcatgtcatagaaaccttgattggcaaaaagcaacagatatctcttgcaacacaaatggttagaatgattttgaagattgatgacattcgtaagcctggagaatctgaagaatgaagacattgagaaaactatgtagcaagatccacttctgtgattaagtaaatggatgtctcgtgatgcatctacagttatttattgttacatccttttccagacactgtagatgctataataaaaatagctgtttggtaaccatagtttcacttgttcaaagctgtgtaatcgtgggggtaccatctcaactgcttttgtattcattgtattaaaagaatctgtttaaacaacctttatcttctcttcgggtttaagaaacgtttattgtaacagtaattaaatgctgccttaattg

SEQ ID NO: 366 - DNA, 2573 bp, Homo sapiens
  ref <308>: DATABASE ACCESSION NUMBER: D50402
  ref <309>: DATABASE ENTRY DATE: 2001-06-18
gaatcggccgatgtgaaccgaatgttgatgtaagaggcagggcactcggctgcggatgggtaacagggcgtgggctggcacacttacttgcaccagtgcccagagagggggtgcaggctgaggagctgcccagagcaccgctcacactcccagagtacctgaagtcggcatttcaatgacaggtgacaagggtccccaaaggctaagcgggtccagctatggttccatctccagcccgaccagcccgaccagcccagggccacggcaagcacctcccagagagacctacctgagtgagaagatccccatcccagacacaaaaccgggcaccttcagcctgcggaagctatgggccttcacggggcctggcttcctcatgagcattgctttcctggacccaggaaacatcgagtcagatcttcaggctggcgccgtggcgggattcaaacttctctgggtgctgctctgggccaccgtgttgggcttgctctgccagcgactggctgcacgtctgggcgtggtgacaggcaaggacttgggcgaggtctgccatctctactaccctaaggtgccccgcaccgtcctctggctgaccatcgagctagccattgtgggctccgacatgcaggaagtcatcggcacggccattgcattcaatctgctctcagctggacgaatcccactctggggtggcgtcctcatcaccatcgtggacaccttcttcttcctcttcctcgataactacgggctgcggaagctggaagctttttttggactccttataaccattatggccttgacctttggctatgagtatgtggtggcgcgtcctgagcagggagcgcttcttcggggcctgttcctgccctcgtgcccgggctgcggccaccccgagctgctgcaggcggtgggcattgttggcgccatcatcatgccccacaacatctacctgcactcggccctggtcaagtctcgagagatagaccgggcccgccgagcggacatcagagaagccaacatgtacttcctgattgaggccaccatcgccctgtccgtctcctttatcatcaacctctttgtcatggctgtctttgggcaggccttctaccagaaaaccaaccaggctgcgttcaacatctgtgccaacagcagcctccacgactacgccaagatcttccccatgaacaacgccaccgtggccgtggacatttaccaggggggcgtgatcctgggctgcctgttcggccccgcggccctctacatctgggccataggtctcctggcggctgggcagagctccaccatgacgggcacctacgcgggacagttcgtgatggagggcttcctgaggctgcggtggtcacgcttcgcccgtgtcctcctcacccgctcctgcgccatcctgcccaccgtgctcgtggctgtcttccgggacctgagggacttgtcgggcctcaatgatctgctcaacgtgctgcagagcctgctgctcccgttcgccgtgctgcccatcctcacgttcaccagcatgcccaccctcatgcaggagtttgccaatggcctgctgaacaaggtcgtcacctcttccatcatggtgctagtctgcgccatcaacctctacttcgtggtcagctatctgcccagcctgccccaccctgcctacttcggccttgcagccttgctggccgcagcctacctgggcctcagcacctacctggtctggacctgttgccttgcccacggagccacctttctggcccacagctcccaccaccacttcctgtatgggctccttgaagaggaccagaaaggggagacctctggctaggcccacaccagggcctggctgggagtggcatgtatgacgtgactggcctgctggatgtggagggggcgcgtgcaggcagcaggatggagtgggacagttcctgagaccagccaacctgggggctttagggacctgctgtttcctagcgcagccatgtgattaccctctgggtctcagtgtcctcatctgtaaaatggagacgccaccacccttgccatggaggttaagcactttaacacagtgtctggcacttgggacaaaaacaaacaaacaaacaaaaaacatttcaaaaggtatttattgagcacctgcaggcgtgacctgacagcccaagggtgggtggggtgagggcttgaggacttgggcgggacacaggctccaaactggagcttgaaatagtgtctgatgaatgttaaattatctatctatctatttatttatttatttgagacagggaaagggtctccctctgttgccaaggctggagtgcagtggcgcaatcttaactcattgcaacctccaccttctgggttcaagcgattctctttattcagccccgggagtggcgcgcgccaccacgcccagctaatttgtgtattttcagcagagacggggtttgccatgctggccaggctggtctcgaactgctggattcaagtgatccgcccatctccgtctcccaaagtgctgggaattacaggcgtgagccaccaaaacccggcctgattaaagttaaataaatacg

SEQ ID NO: 367 - DNA, 2108 bp, Homo sapiens
  ref <308>: DATABASE ACCESSION NUMBER: D50914
  ref <309>: DATABASE ENTRY DATE: 2001-06-18
gattccggcagtgacagcagtgaggatgatgacgaaggcgacgaggagggagaggacggagcccttgatgacgagggccacagtgggattaaaaagaccactgaggagcaggtgcaggccagcactccttgcccgaggacagagatggcgagcgcccggattggggatgagtatgcggaggacagctctgatgaggaggacatccggaacacggtgggcaacgtgcccttggagtggtacgatgacttcccccacgtgggctacgacctggatggcaggcgcatctacaagcccctgcggacccgggatgagctggaccagttcctggacaagatggacgatcctgactactggcgcaccgtgcaggacccgatgacagggcgggacctgagactgacggatgagcaggtggccctggtgcggcggctgcagagtggccagtttggggatgtgggcttcaacccctatgagccggctgtcgacttcttcagcggggacgtcatgatccacccggtgaccaaccgcccggccgacaagcgcagcttcatcccctccctggtggagaaggagaaggtctctcgcatggtgcacgccatcaagatgggctggatccagcctcgccggccccgagaccccacccccagcttctatgacctgtgggcccaggaggaccccaacgccgtgctcgggcgccacaagatgcacgtacctgctcccaagctggccctgccaggccacgccgagtcgtacaacccaccccctgaatacctgctcagcgaggaggagcgcttggcgtgggaacagcaggagccaggcgagaggaagctgagctttttgccacgcaagttcccgagcctgcgggccgtgcctgcctacggacgcttcatccaggaacgcttcgagcgctgccttgacctgtacctgtgcccacggcagcgcaagatgagggtgaatgtagaccctgaggacctcatccccaagctgcctcggccgagggacctgcagcccttccccacgtgccaggccctggtctacaggggccacagtgaccttgtccggtgcctcagtgtctctcctgggggccagtggctggtttcaggctctgacgacggctccctgcggctctgggaggtggccactgcccgctgtgtgaggactgttcccgtggggggcgtggtgaagagtgtggcctggaaccccagccccgctgtctgcctggtggctgcagccgtggaggactcggtgctgctgctgaacccagctctgggggaccggctggtggcgggcagcacagatcagctgttgagcgccttcgtcccgcctgaggagccccccttgcagccggcccgctggctggaggcctcagaggaggagcgccaagtgggcctgcggctgcgcatctgccacgggaagccagtgacgcaggtgacctggcacgggcgtggggactacctggccgtggtgctggccacccaaggccacacccaggtgctgattcaccagctgagccgtcgccgcagccagagtccgttccgccacagccacggacaggtgcagcgagtggccttccaccctgcccggcccttcctgttggtggcgtcccagcgcagcgtccgcctctaccacctgctgcgccaggagctcaccaagaagctgatgcccaactgcaagtgggtgtccagcctggcggtgcaccctgcaggtgacaacgtcatctgtgggagctacgatagcaagctggtgtggtttgacctggatctttccaccaagccatacaggatgctgagacaccacaagaaggctctgcgggctgtggccttccacccgcggtacccactctttgcgtcaggctcggacgacggcagtgtcatcgtctgccatggcatggtgtacaatgaccttctgcagaaccccttgctggtgcccgtcaaggtgctgaagggacacgtgctgacccgagatctgggagtgctggacgtcatcttccaccccacccagccgtgggtcttctcctcgggggcagacgggactgtccgcctcttcacctagctgttctgcctgcctggggctggggtggtcgtgctgaagtcaacagagcctttaccctg

SEQ ID NO: 368 - DNA, 2427 bp, Homo sapiens
  ref <308>: DATABASE ACCESSION NUMBER: D55716
  ref <309>: DATABASE ENTRY DATE: 2001-06-18
gacgtttcgcgccaatttcggttggccggccacagtccaccgcgcggagattctcagcttccccaggagcaagacctctgagcccgccaagcgcggccgcacggccctcggcagcgatggcactgaaggactacgcgctagagaaggaaaaggttaagaagttcttacaagagttctaccaggatgatgaactcgggaagaagcagttcaagtatgggaaccagttggttcggctggctcatcgggaacaggtggctctgtatgtggacctggacgacgtagccgaggatgaccccgagttggtggactcaatttgtgagaatgccaggcgctacgcgaagctctttgctgatgccgtacaagagctgctgcctcagtacaaggagagggaagtggtaaataaagatgtcctggacgtttacattgagcatcggctaatgatggagcagcggagtcgggaccctgggatggtccgaagcccccagaaccagtaccctgctgaactcatgcgcagatttgagctgtattttcaaggccctagcagcagcaagcctcgtgtgatccgggaagtgcgggctgactctgtggggaagttggtaactgtgcgtggaatcgtcactcgtgtctctgaagtcaaacccaagatggtggtggccacttacacttgtgaccagtgtggggcagagacctaccagccgatccagtctcccactttcatgcctctgatcatgtgcccaagccaggagtgccaaaccaaccgctcaggagggcggctgtatctgcagacacggggctccagattcatcaaattccaggagatgaagatgcaagaacatagtgatcaggtgcctgtgggaaatatccctcgtagtatcacggtgctggtagaaggagagaacacaaggattgcccagcctggagaccacgtcagcgtcactggtattttcttgccaatcctgcgcactgggttccgacaggtggtacagggtttactctcagaaacctacctggaagcccatcggattgtgaagatgaacaagagtgaggatgatgagtctggggctggagagctcaccagggaggagctgaggcaaattgcagaggaggatttctacgaaaagctggcagcttcaatcgccccagaaatatacgggcatgaagatgtgaagaaggcactgctgctcctgctagtcgggggtgtggaccagtctcctcgaggcatgaaaatccggggcaacatcaacatctgtctgatgggggatcctggtgtggccaagtctcagctcctgtcatacattgatcgactggcgcctcgcagccagtacacaacaggccggggctcctcaggagtggggcttacggcagctgtgctgagagactccgtgagtggagaactgaccttagagggtggggccctggtgctggctgaccagggtgtgtgctgcattgatgagttcgacaagatggctgaggccgaccgcacagccatccacgaggtcatggagcagcagaccatctccattgccaaggccggcattctcaccacactcaatgcccgctgctccatcctggctgccgccaaccctgcctacgggcgctacaaccctcgccgcagcctggagcagaacatacagctacctgctgcactgctctcccggtttgacctcctctggctgattcaggaccggcccgaccgagacaatgacctacggttggcccagcacatcacctatgtgcaccagcacagccggcagcccccctcccagtttgaacctctggacatgaagctcatgaggcgttacatagccatgtgccgcgagaagcagcccatggtgccagagtctctggctgactacatcacagcagcatacgtggagatgaggcgagaggcttgggctagtaaggatgccacctatacttctgcccggaccctgctggctatcctgcgcctttccactgctctggcacgtctgagaatggtggatgtggtggagaaagaagatgtgaatgaagccatcaggctaatggagatgtcaaaggactctcttctaggagacaaggggcagacagctaggactcagagaccagcagatgtgatatttgccaccgtccgtgaactggtctcagggggccgaagtgtccggttctctgaggcagagcagcgctgtgtatctcgtggcttcacacccgcccagttccaggcggctctggatgaatatgaggagctcaatgtctggcaggtcaatgcttcccggacacggatcacttttgtctgattccagcctgcttgcaaccctggggtcctcttgttccctgctggcctgccccttgggaaggggcagtgatgcctttgaggggaaggaggagcccctctttctcccatgctgcacttactccttttgctaataaaagtgtttgtagattgtc

SEQ ID NO: 369 - DNA, 4994 bp, Homo sapiens
  ref <308>: DATABASE ACCESSION NUMBER: D80001
  ref <309>: DATABASE ENTRY DATE: 2001-06-18
ccgcagcgctcggctggctgcagcggcaccgcgggttgcgcggccggggatgctccagcgggcgcgatggcccccgccatgcagccggccgagatccaatttgcccagcggctggcgtccagcgagaagggcatccgggaccgagcggtgaagaagctgcgccagtacatcagcgtgaagacgcagagggagacaggaggtttcagtcaggaagaacttctacaggaagagctcgccaacaccattgcacagctagtccatgctgttaacaactcagcggctcaacacctgttcattcagaccttttggcaaaccatgaatcgagaatggaaaggaatagacaggctacgcctggacaaatactatatgctgattcgtctggtcctgaggcagtcctttgaagtcttgaagcgaaatggctgggaagaaagccgaatcaaggttttcttggatgtcctgatgaaggaggtcctgtgtcctgagagtcagtctcctaatggagtgagattccacttcattgatatttacctggatgaactctccaaagtcggggggaaggagcttttagcagatcagaatctcaagtttatcgatccattctgcaaaattgctgcaaagacgaaggaccacaccctggtacagaccatagctcggggtgtcttcgaagctatcgtagatcagtctccttttgtgcctgaagagacgatggaggaacagaagacaaaagtgggtgatggtgacctctctgctgaggagatacctgaaaatgaggtatccttgagaagagctgtcagtaaaaagaagacagcactgggcaaaaaccattccagaaaagatggactcagtgatgaaagaggaagagatgactgtggaacctttgaggacacagggccccttctccagtttgactataaggctgttgctgatcgactcctggaaatgaccagcaggaagaacacgccccacttcaacaggaagcgcctctccaaactcatcaagaaattccaagacctttctgaaggaagcagtatatctcaactcagttttgcggaggacatttctgctgatgaagatgaccaaatcctcagtcaaggaaagcataagaagaaaggaaataaacttttagagaaaactaacttggaaaaggagaaaggaagcagagtcttttgtgtagaggaagaggacagtgaaagcagtcttcaaaagagaagaaggaagaagaagaagaagcaccacctgcagcctgaaaatccaggcccagggggtgcagccccgtccctggaacagaaccggggcagggagcccgaggcctctgggccgaaagccctgaaggcacgtgtggccgagccaggtgcagaggccacgtccagcactggggaggagagtggctccgagcatcctccagccgtccccatgcacaataaaaggaaacggccacggaagaagagcccgagggcccacagggaaatgttggaatcagcagtgttgcccccagaggacatgtctcagagtggcccgagtggcagtcatcctcagggacctagagggtccccgacaggtggagcccaactcctaaaaaggaagcggaaacttggagttgtgcccgtcaatggcagtggcctgtccacgccggcctggcctccattgcagcaggaaggccctcccacaggccccgcagagggggcgaacagccacaccacgctgccccagcgcaggaggctgcagaaaaagaaggcagggcccggcagcctggagctctgtggcctgcccagccagaaaacagcaagtttgaaaaagaggaagaaaatgagagtgatgtcaaacttggtggagcacaacggggtgctggagtccgaagctgggcaaccccaggctctgggaagcagtgggacttgcagttccctgaagaagcagaagctgagggcagagagcgactttgtgaagtttgacacccccttcttaccaaagcccctgttcttcagaagagccaagagcagcactgccacccaccctccaggccctgccgtccagctaaacaagacaccatccagctccaagaaagtcacctttgggctgaacagaaacatgactgccgaattcaagaagacagacaagagtatcttggtcagtcccacgggcccttctcgagtggccttcgaccctgaacagaagcccctccacggggtgctgaagacccccaccagctcacctgccagctcacccctggtggccaagaagcccctgaccaccacaccaaggagaaggcccagggctatggatttcttctgaggagcagcagagtcccttgtaaaagactgcttttgtacagaatgcgctataaattatacctttaagaatgtggggccttttttatgattttgtaagttcccataagttgtgtgcacgaggttctgagagtgcccgcaggctgctgcgtcctggcccctctgtagtggctgcgggcgtcttggttgaatcttttgctacaaaccatgtttgcgtttgagctctccaggattttacatttttgggtaacctcagtgattcccattggtgtaggaaatgagaccctctctgaagctgaggagagcacgttgatctgaactttaaatcaatcagtgctgctggcacaatgaaaggtggaactgcacttgtgttgagctctcagttctgcggaatttggtactcattaccgtattcgccgtactaagttggtttctgttagtcttaacagtctgttttcttttaaaagcatgtagggcttcattgccatgttctgtgggtgtttggcaggttaccgatggggaagattcttgtcacagaatcagcaataccatagtttttctacatgtgctcagctgggggtgtggacaggtaggggtggggaaagaagaggctctgcgttctgggggctttttcttctcctccccctacccggtttccctccctgttttcctacctctacggcaagcccaaagtgtcttcccgggagcccagcgcagcccccggctcttacccaggaccccgccccgtgctgagccttctgctgaggtccttgcgtggagcacactcattcctccaagcccttgcgctcccgtttctctctctctccgtccacgttccagccgagtcactgcctgcctgaccggctccatggcagctccccatcttccctagaggctgcctgcgcatctggagcctgcgctccggctcagcgacctttcctctcaaatgcggaagcgtgcacttacagttcagaccgttctcctgtaagttcattacaaacacgggcggaaggcactcaggctttcgttggagaaacagaaataaggccttcttttgagcagcgattgctggatcattgatctgtttgaggaagtgtctgacctgggcctgagagctggagaaggtgcagattcaaagtgagcggctcctgaggagagccgccaaggctgctcgccttctccgtggcttccgcagctaccgtctgcacggtgagagggcacgggcacacggttcgggctggcgtgcagctctcccagccagccacgctctgctcaggcctggaagtgaaagccgcctccttcccgttatgccccccatacaggagcctcggtttttcagcaaaacgcggccagtccccttctccactgctgcctcccagcagagggccccaggatctccaaggtcccagctatggctttggacaacgtggcttcggcccctggggttgcagagcttgcattgggtttacctcggtctcattcattcatggagccaagggtggggtttcacctgcgaacatcagactgacttgctggcgtcaagagcagttgactcactgatgaaggccctggtgaggagaaagcactctgttcttcgcctactctgtaatcgttttgtcataatgagccatgaaaaaagtaatgaacttgtgctgttaatcgtcactgtaatgagaagtcttacgtacaacatagctgtggtggctgcgtggtttaatggctgcattagataggatcctcacatcccattcagaaccaaaactgatacagtgaaacaattaaggtgagcaaatagttttaacttttcttttttttttaagtttcattcttcctagaatatttttctaacaatttttatttcagctttaaagatgggtcatatagccaaacgggccatataatccaacattgttgagatgtcttaggacatctaaggcaaaactggcacatttgttctgcagactattgcaggaatgttttttcctagcatttctatattatctgtccattctgaggaaccagtgaatgtcctataaatgcacctcctgtcaaaaccatgcctgagaggtcccggctgggagtgacagggtgcttcttagattctattggtccttctctcattctccgaacttactcctttttatgggtaagtcaactaggtttacagtcccttatttttaatgcctaagttttgacagcaggaagaaaacaattttttaaaaattctcattacatagacgcacaagaatatgtcacataaagaaaatgtgtttagaatactggttttctatttacgcatgatattttcctaagtaaaattgccaagtggacttggaagtccagaaaggaaaataatttaaattaatgctggtgatcttaacaatattttgtaaaatgatgcttcccccttctccatggtctagtcaattttgtacaattaggtatctgactttacaagtttgttatcctttctaatttttactgaactgaaagcacaaagaagactacacagaaaatctggaaacagttgcaggtgttgggaggaagatgaaatcgagctgtcttttaacttttgtatgtgttttatcagaatttgctggactatgctggcaaggactttgtttacgatcaaattgtactagtgtctgcagggtttgtcagtactcgtcaaagccaagtccaattaaaaaaaaaaagtctttgccctcc

SEQ ID NO: 370 - DNA, 5307 bp, Homo sapiens
  ref <308>: DATABASE ACCESSION NUMBER: D80010
  ref <309>: DATABASE ENTRY DATE: 2001-06-18
ccacgcgcggcgccgctcggtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggttgacatagaaatcaatggggaatctgtggatttgcatatgaaattgggagataatggagaagcattttttgttcaagaaacagataatgatcaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcagaactcttcctaatgatatacctccattccaagatgatattcctgaggaaaacctctccctggctgtgatttaccctcagtcagcctcataccctaattcggatagagagtggtcacccactcccagtccttccggttcccgaccttcaacacctaaaagtgattcagaattggtcagcaagtccacggaaaggacagggcagaagaacccagaaatgctttggctgtggggagagctgccgcaggctgctaagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagagataaacgaagccgacatcttggtgctgacggcgtctacttggatgacctcacagacatggatcctgaagtggcggccctgtattttcccaaaaacggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaagatgcattcctggagcaagctgtgtcatatcaacagtttgtggacaaccccgctattatcgatgaccccaatctcgtggtaaagattgggagtaaatattataactggacaacagcagcacccctcctcctggcaatgcaggccttccagaaacctttgccaaaggccactgtggaatctatcatgagggataaaatgcccaaaaagggaggaagatggtggttttcatggaggggaagaaacaccacaatcaaggaggaaagtaagccagagcagtgcttggctggcaaggcccatagcaccggagagcaaccgccgcagctcagcttggccaccagggtaaagcatgaatcatcctccagtgatgaggagcgcgcagctgccaagccatcaaacgcaggccacctccctcttctgcctaatgtcagctacaagaagactctccggctgacttccgagcagcttaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccagatcagatactcttggccacattttgcccacccttgggaaggattggacccatcagggcatcgctaagctgtaccataaagtgagccagaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacagagaagtgattgaaaagaagccagaaaagtttaaagtccagtgtttgacagacatcaaaaacctgtttttccccaacacagaacccttttatgctgcttttggaaaccgaccagctgatgtgtattcatacaagcaagtaggagtgtctttgaatagaatatttaccgtcaaccctaaaggagagctggtacaggaacatgcaaagaccaacatctcttcgtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataagtttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcatcgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactgtaatacttcattgtgttgtactggatgcaaagctagaaaatattgcaataaatgagaccgatgaaagac

SEQ ID NO: 371 - DNA, 639 bp, Homo sapiens
  ref <308>: DATABASE ACCESSION NUMBER: D82345
  ref <309>: DATABASE ENTRY DATE: 2001-06-18
cgcgggaacgctaacctggtccggagcgagtctgggtctcagccccgcgaacagcctttcacgagtcttcaagctttcaggctatcttctagtcaagatgagtgataagccagacttgtcggaagtggagaagtttgacaggtcaaaactgaagaaaactaatactgaagaaaaaaatactcttccctcaaaggaaactatccagcaagagaaagagtgtgttcaaacatcataaaatggggatcgcctcccaacagcagatttcgacattacctgagagtcttgattttaggcttgttttttgtaaacccatgtgtttgtagagattttaggcgtcttcggatatcttctcacctatgttccctggctaagaagtcagaggtagccaatgtttccttaaattcatttttaaacttaccattggtgcatatgttccagatggcagatgctgtcaataatctcaccattgatgacctttgtgtatgtagttcttgcatcctatactggataagcctgttttaacctgctatgatgggtgcttccattgcttcataatcttcatgaagttgcatgcttttgcagcttttcacagtttatttgcatttctaatgtagtaataaagtaaccaatataatcatt

SEQ ID NO: 372 - DNA, 4814 bp, Homo sapiens
  ref <308>: DATABASE ACCESSION NUMBER: D83781
  ref <309>: DATABASE ENTRY DATE: 2001-06-18
ggcggcgggagccctggaacggagcttcgtggagctaagcggagctgagcgcgaaaggccgaggcactttcgggaattcacagtctgcagcattgggactgcaaatgccgtggctggcgccgtaaaatacagtgaaagcgcgggaggcttttactacgtggagagtggcaagttgttctccgtaaccagaaacaggttcattcattggaagacctctggagatacattggagctgatggaggagtcactggacataaatctgttgaataatgccattcgcctaaaattccaaaattgcagtgttttacctggaggggtttatgtctctgagactcagaatcgtgtgataatcttgatgttaaccaatcaaacagtgcacaggttacttttaccacacccctcccggatgtataggagtgagttggtagttgacagtcagatgcagtcaatattcactgacattggaaaagttgatttcacagatccttgcaactatcagttaattccagcagtacctggaatatctcctaattccaccgcctctacagcctggctcagcagtgatggggaggccctgtttgccttaccatgtgcttctgggggaatctttgttcttaagctacctccttatgacatacctggtatggtgtcagtcgtggaactgaaacagagttcagtaatgcaacgattgcttacaggctggatgccaacagctatcaggggtgaccagtcgccttcagatcgtcccctcagtcttgctgttcattgtgtggagcatgatgccttcatctttgctttgtgtcaggatcataaactacgaatgtggtcttacaaggagcaaatgtgcctaatggtagctgacatgctggagtatgtccctgtgaagaaagaccttcggcttactgctggaactggacacaaattacggcttgcttattcccccaccatgggactctacctggggatatacatgcatgcaccaaaacgaggacagttctgcattttccagttggtgagcactgagagtaatcgctatagtctcgatcatatttcttcactgttcacttctcaggagacactgattgactttgccttaacttccacggatatctgggccctgtggcatgatgctgagaaccaaacagtagtgaaatacatcaactttgaacataatgttgcaggtcagtggaatccagtttttatgcagcctctgccagaggaagagattgtcatcagagatgatcaagaccccagagagatgtatctgcaaagtctttttacaccaggacaattcacaaatgaagctttatgtaaggctttacagattttctgccgaggaactgagaggaatttggatctttcctggagtgaactgaagaaagaagttactttagctgttgaaaatgagcttcaaggaagtgtaacagagtatgaattctcccaggaggagtttcgaaatttacaacaagaattctggtgcaagttctatgcctgttgtcttcagtatcaagaagccctctctcaccctcttgccctacatttgaatccacacacaaacatggtgtgcctgctgaaaaaagggtacctgtctttccttattccctcatccttagtggatcatttgtatctcctgccttatgagaaccttttgacagaagatgagacaaccatatctgatgatgtggatatcgctcgggatgtcatatgtcttataaaatgcctccggctgattgaagagtcagtaactgtggatatgtcagttataatggaaatgagttgttataacctacagtctccggaaaaggctgcagagcagattctggaagatatgatcactattgatgtagaaaatgtgatggaggatatttgtagtaaactgcaagagattaggaacccaatccatgcaattggactacttatacgggaaatggattatgaaacagaagtggaaatggaaaagggattcaatccagctcagcctttgaatattcgaatgaatcttacccagctctatggtagtaacacagcagggtatattgtgtgcagaggggtgcataaaatcgccagtactcgtttcctgatctgcagagatcttttgatcttacagcagctgttaatgaggcttggagatgctgtgatttggggaactggtcagctctttcaagctcagcaagacctactacatcgaacagctcccctactcttatcttattacctcattaaatggggaagtgagtgcttggcaactgatgttccacttgacacactggagtctaatctccaacacttatcagtactggaattaacagactctggtgctttaatggcaaataggtttgtatctagtcctcagactattgtggagttattcttccaagaagttgcaagaaaacacattatatctcacctcttctctcagccaaaggcacctctgagccaaactggattgaattggcctgaaatgattactgcaattaccagttatttattgcagcttttatggcctagcaatcctggttgtctctttctagaatgtttgatgggaaattgccaatatgtacaattgcaggattatattcaactgctacatccctggtgtcaagtcaatgttggttcctgtcgatttatgctgggaaggtgttacctagttacaggagaaggacagaaggctctggaatgtttttgtcaggcagcatctgaagtaggcaaagaggaattcttggatcgcttgattcgctcagaggatggggagatcgtgtctacccccaggctgcagtattatgacaaggttttacgactactagatgtcattggtttgcctgaactggttattcagttggctacatcagccataactgaagcaagtgatgactggaaaagtcaggctactctaaggacatgtattttcaaacatcatttggatttgggtcacaatagccaagcatatgaagccttaacccaaattcctgattccagcaggcaattagattgtttacggcagttggtggtagttctttgtgaacgctcacagctacaggatcttgtagagtttccctatgtgaatctgcataatgaggttgtgggaataattgagtcacgtgctagagctgtggaccttatgactcacaattactatgaacttctgtatgcctttcacatctatcgccacaattaccgcaaggctggcacagtgatgtttgagtatggaatgcggcttggcagagaagttcgaactctccggggacttgagaaacaaggcaactgttatctggctgctctcaattgtttacgacttattcgtccagaatatgcgtggattgtgcagccagtgtctggtgcagtgtatgatcgccctggagcatcccctaagaggaatcatgatggagaatgcacagctgcccccacaaatcgacaaattgaaatcctggaactggaagatctggagaaagagtgttccttggctcgcatccgcctcactttggctcagcatgatccatcagcggttgcagttgctggaagttcatcagcagaggaaatggtcactctcttggttcaggcgggcctctttgacactgccatatcactctgtcagacttttaagcttcccttaacgccagtctttgaagggcttgccttcaaatgcatcaaattgcaatttggaggagaggcagcacaagcagaagcctgggcctggctagcagccaatcagctctcatctgtcatcactactaaggagtctagtgctacagatgaagcatggcgactattatccacttacctggagaggtacaaagtccagaataacttgtatcaccactgtgtaatcaacaagctcttgtctcatggagtgcctctgcctaattggcttataaacagtcacaacatcgcactgtcccaaaaagttgataaggcaacacgggatttattatatcgtcggaccttgtgatttggattgtcacctagcctttgtaaccgcttggtgcctcttaggacttaagactaccctacaggaaccctgtactcaaggccgatttttgtaactgtaaatgatgtgtacaacattcaagtctgcattctgcacaagataggagggcggaagagtcagaggaccctgtgcttgctggtggtgctaacacaatttctggtgttcaaccttggtctcaaatagctgcttttgtatatgattcacgagcttttttagagtttatatttttttaaactaccgaagacattcattatctgcaaattaagactcaccttcactttccaaaatagctgagggttgttggcttgttgtagctgaccaccaaaagcagtcactgcaaatcttttaattcttccctatcaccttttgtattttaatgcaattattttggtccagaactgacctgtattttctgtattgtacacaaaagctaataattttgtgtactttttatttattttggaggttttatatgatcttcaattgagtattaaataatttgcctagattaagcctaaaatgatgaccagctaattaaagaagatattttgaatctggttctgagctaaagttgagtaaattcttagctaagaaaaaattggaaatccatcatctatattagcaacagattctcagagtaaattgttaacttctatgatttatgataatcaagctggacttgatcatacaagttagtctcataatgtattggaccaaaatgtaaacttcattggtcagatttagaagcattcatgctcacaagttttgggaaagtgaaaaataataaaatcatcttggattttattctgtatattaaaatttatctttt

SEQ ID NO: 373 - DNA, 6050 bp, Homo sapiens
  ref <308>: DATABASE ACCESSION NUMBER: D86964
  ref <309>: DATABASE ENTRY DATE: 2001-06-18
ggcttccccacgggaggacgcgaggccccggcccagccatggccccctggcgcaaagctgacaaggagcggcacggcgtggccatatacaacttccaaggcagcggagccccccagctctccctgcagatcggcgatgtggtgcgaatacaggagacgtgtggagactggtataggggatacctcataaagcacaaaatgttacagggcatttttcctaagtcatttatccacatcaaggaagtgacagttgagaaaagaagaaatactgagaacatcattcctgcagaaattcctctggcacaagaagtgacaacgacactttgggaatggggaagcatctggaaacaactctatgtggccagcaaaaaggagcgttttctccaggtgcagtccatgatgtacgatctgatggagtggaggtcccagcttctctcaggaaccttacccaaggatgagctgaaggaactgaagcagaaagtcacgtccaaaattgactatggcaacaaaatccttgagcttgatttgattgtcagagatgaagacggaaatatcttggaccctgataataccagtgtcatcagcttgttccatgcacatgaggaagcaactgataaaatcacagagcgtatcaaagaagaaatgtcaaaagaccagccagattatgcaatgtattcccggatctcctcatcccccacccatagcctctatgtgtttgtgagaaactttgtgtgcagaattggggaagatgctgagctcttcatgtctctctacgaccccaacaagcaaacggtcataagtgagaactacctagtgcgatggggcagccggggcttccctaaggagattgagatgctcaacaatctgaaggtggtcttcacggatcttggaaacaaagacctcaacagggataaaatttacttgatttgtcaaatagtccgggtcggcaagatggatcttaaggatactggtgcaaagaagtgcacgcagggactgaggaggccctttggggtggcagttatggatataacagacatcatcaaggggaaagcagagagtgatgaagaaaagcagcacttcattccttttcacccggttacagctgagaatgacttcctacacagcctgctgggcaaagtcatagcctccaagggggacagtggagggcaaggcctctgggtgaccatgaagatgctggtgggtgacatcattcagattcgcaaggactatccacacctggtggacaggaccaccgtggtggccaggaagctgggattcccagagatcatcatgccaggggatgtcaggaacgacatctacattactctcttacaaggtgactttgacaagtacaacaagaccacacagaggaatgtggaagtcatcatgtgtgtgtgcgcggaggatggcaaaacgctgcctaatgcaatttgcgtgggagcaggggacaagcccatgaatgagtatcgctccgttgtgtactatcaagtcaaacagccacgctggatggaaacagtcaaggtggctgtccctattgaagacatgcagaggatccatctgcgattcatgtttcgacatcggtcatctctggaatctaaagataaaggagaaaagaactttgccatgtcctatgtgaagctgatgaaagaagatgggactactctacacgatggattccatgacttagttgtcctcaagggggacagcaagaagatggaggatgccagcgcatacctgacccttccttcttatcgacaccatgtggaaaacaagggggccacgctgagcaggagctccagcagtgttggggggctttctgtcagctcccgggatgtgttctccatttccaccctggtgtgctccacaaagctcactcagaatgtgggcttgctgggtttgctgaagtggcgtatgaagcctcaactgctacaggagaatttagaaaagttgaagattgtggatggagaggaagtggtgaagtttctccaggatactctggatgccctcttcaacatcatgatggagcattctcaaagtgatgaatatgacatcctcgtctttgatgccttgatttacataataggactcattgcagaccggaaatttcagcatttcaacaccgttctggaggcttacatccaacagcatttcagtgcgaccttggcttacaagaaattgatgacagtgctgaagacttacttggatacctccagcagaggggagcaatgtgagccaatcctaagaacgctgaaggctttggaatatgtgttcaagttcattgttcggtcgaggacattattttcacagctttatgaaggcaaagaacagatggagtttgaagaatccatgagacggctctttgaatccatcaacaatctgatgaaaagtcaatacaaaactaccatccttttgcaggtggcggctttgaaatacatcccatctgtcctgcatgatgtagaaatggtctttgatgcgaagttactcagccaactcctgtatgagttctacacctgcatccctcctgtgaaactccagaagcagaaagtacagtctatgaatgagatagtccagagcaacctctttaaaaagcaagaatgccgggacattctgcttcctgtcatcaccaaagagctgaaggagctgctggagcagaaggatgacatgcaacaccaggtcctggagaggaagtactgcgttgaattgctcaacagcatcttggaagtccttagctaccaggatgcggccttcacctaccaccatatccaagagatcatggtccagctgctgcggacagtgaaccggacagtcatcaccatgggccgggatcacattctgattagtcactttgtggcatgtatgacagccatcttaaaccagatgggtgaccagcactactccttctacattgagaccttccagaccagctctgaacttgtggacttcttgatggagaccttcatcatgttcaaggacctcattggaaagaacgtgtaccctggagactggatggccatgagcatggttcaaaacagggtcttcctgagagctatcaacaagtttgcagaaaccatgaaccagaagttcctagaacacacgaactttgagttccagctgtggaacaactattttcatctggcagtggcttttatcacccaggattctctgcagctggagcagttctcacacgccaaatacaacaaaatcctgaataagtatggggacatgagacggctaattggcttctccatccgtgatatgtggtacaagcttggtcagaacaaaatctgcttcatcccaggcatggtaggacctatattagagatgacacttatccctgaggctgagctccggaaagccaccataccaatcttcttcgacatgatgctgtgtgaatatcaaagaagtggggatttcaaaaagtttgaaaacgaaatcatcctgaagctggaccacgaggtagaagggggccgaggcgacgagcagtacatgcagctgctggagtcaatcctgatggaatgtgctgcagagcacccaaccattgccaagtcggtggagaacttcgtgaacctggtcaaaggcctcctggagaagctgctggattaccggggtgtgatgacagatgagagcaaagacaaccgcatgagctgcactgtgaacctgctgaatttctacaaagataacaacagggaggagatgtacataaggtacctgtacaaactccgcgatcttcacctggactgtgacaattacacagaggctgcctacacgctccttctccacacctggcttctcaagtggtcggatgagcagtgtgcatcacaggtcatgcagacaggccagcagcacccccagacacaccggcagctcaaggagacgctctacgagaccatcataggctactttgacaaaggaaagatgtgggaagaggccataagtctgtgcaaggagctggcggaacagtacgagatggagatctttgactatgagctgctcagccagaacctgatccagcaggcaaaattctatgaaagcatcatgaaaatcctcaggcccaaaccagactactttgctgttggatactacggccagggattcccctccttcctgcggaacaaagtgttcatctaccgcgggaaggaatatgagcgaagagaagatttccagatgcagctgatgacccagttccccaatgcagagaagatgaacaccacctctgccccgggagatgatgtgaagaatgccccaggccagtatatccagtgcttcactgtccagcctgtcttggatgaacatcccaggttcaagaataagccagtgcctgaccagattataaacttctacaaatccaactacgtgcaaaggttccactactcccggcccgtgcgcagggggaccgtagacccagagaatgagtttgcttccatgtggattgagagaacctccttcgtgactgcatacaagctgccggggatcctgcgctggtttgaggtggtgcacatgtcgcagaccacaattagtcctctggagaatgccatagaaaccatgtccacggccaatgagaagatcctgatgatgataaaccagtaccagagtgatgagaccctccccatcaacccactctccatgctcctgaacgggattgtggaccctgctgtcatgggaggcttcgccaagtatgagaaggccttcttcactgaagagtatgtcagggaccaccctgaggaccaggacaagctgacccacctcaaggacctgattgcatggcagatccccttcttgggagctgggattaagatccatgagaaaagggtgtcagataacttgcgacccttccatgaccggatggaggaatgtttcaagaacctgaaaatgaaggtggagaaggagtacggtgtccgagagatgcctgactttgacgacaggagagtgggccgccccaggtctatgctgcgctcatacagacagatgtccatcatctctctggcttccatgaattctgactgcagcacccccagcaagcctacctcagagagctttgacctggaattagcatcacccaagacgccgagagtggagcaggaggaaccgatctccccggggagcaccctgcctgaggtcaagctgcggaggtccaagaagaggacaaagagaagcagcgtagtttttgcggatgagaaagcagctgcagagtcggacctgaagcggctttccaggaagcatgagttcatgagtgacaccaacctctcggagcatgcggccatccccctcaaggcgtctgtcctctctcaaatgagctttgccagccagtccatgcctaccatcccagccctggcgctctcagtggcaggcatccctgggttggatgaggccaacacatctccccgcctcagccagaccttcctccaactctcagatggtgacaagaagacactcacacggaagaaggtcaatcagttcttcaagacaatgctggccagcaaatcggctgaagaaggcaaacagatcccagactcgctgtccacggacctgtgagctgctgctgactagggctgcatgggagagccagggaggggagtttctggaagaggaaagccatgcgtggaacatcgaagcctcagagagtgggagactgtccccatcagttgtccttacttagaggagacagagaggccaatcaggtcccagagctggagtgctaacaagcccagcatcccctggggctgtgatcatggtggatgaggaagcctcaacgtagattcctgaactcaaggtaccagcaagaatgccttctcccagtgtgctctccccaacatcctaggcacagctttcataacccagtttcttaggtgtaagaaactgcttttatctcatttattaagtctcagaacttaacagaaaaggaagccttttaaatattctttttaattttattttagattaacagttttgtactttacatttttttatacaaccaaccagtttcttttctagccaatcatctctgaagagttgctgtttcttactgacaataaaaaatgttctcttggttcg

SEQ ID NO: 374 - DNA, 6237 bp, Homo sapiens
  ref <308>: DATABASE ACCESSION NUMBER: D86978
  ref <309>: DATABASE ENTRY DATE: 2001-06-18
ctaagatggcgacgcctttggcggtaaattcggctgctagtctatggggtccttacaaagacatttggcataaagtgggaaatgctctttggagaagacaacctgaagctgttcaccttcttgataagattttgaagaaacacaaacctgacttcatctcattgttcaaaaatccgccaaaaaatgttcaacagcatgagaaggttcagaaagccagtacagagggagtcgccattcagggtcaacagggaactcgacttcttcctgaacagctcattaaagaagcctttattctcagtgacctttttgatattggagaattggcagctgttgagcttcttcttgctggagagcatcaacagccacattttcctggccttaccagaggattagtagctgttcttctgtactgggatggaaagcgatgcattgcgaattccttgaaagccttgatacagtctagacggggaaagacatggaccctagaactcagtccagagctggcttccatgacaacacgctttacagatgagctgatggagcaaggattgacttataaagttcttacgctggtgtcacagattgatgtgaataatgagtttgagaaactacagcgagagagaggtttgggcagtgaaaaacatcgcaaagaggtttctgatctcattaaggagtgcaggcagtctcttgcagaaagcctttttgcctgggcttgccagtcacctttaggcaaagaagacactctcctcctcattggacatttggaaagagtgacagttgaggctaatggctcactggatgcagtgaatctggctcttcttatggcgcttctatactgttttgatatcagttttatagagcaaagcacagaggaacgagatgatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacagctctggcagaattcacagaggcagatgaagcaatggcagaactcgcaattgctgacaacgttttcctgttcctcatggaatctgtagtggtatcagaatacttttatcaggaagaattttatattcgcagagtccataatctcatcacagatttccttgcacttatgccaatgaaggtgaaacagctgaggaatcgggcagatgaagatgctcgaatgattcacatgagtatgcagatgggtaatgaaccccccatttcacttagaagggacctggaacacttaatgcttttgattggcgagctatataaaaagaacccttttcatctggagcttgctctagaatattggtgtcccacagagcctcttcagactccgactatcatgggctcttatctaggggtggctcatcagcggccccctcaacgccaggttgtcttgtcaaagtttgttaggcaaatgggtgacctgttgcctccaactatttatattccttatttgaagatgctccagggattggccaatgggcctcagtgtgcccactactgtttcagcctgctcaaagtcaatggtagtagtcatgttgaaaatattcagggagcaggtggcagtcctgtttcctgggaacatttctttcactccttgatgctttaccacgaacaccttcggaaggatcttccaagtgcagatagtgtccagtaccgtcaccttccttcccgtggcatcacccagaaggagcaagatggattgattgcttttttgcagctcacgtctaccatcattacttggagtgaaaatgctcgcttggccctctgtgaacaccctcagtggacccctgttgtggtgattctgggactcctccaatgcagtattccccctgtcctaaaagctgagctactgaagacactcgcagcttttggaaaatctcctgaaattgctgcttccctctggcagtcattggaatacactcagatactgcagaccgtgaggattccaagccaaaggcaagctattggtattgaggttgaactaaatgaaatagaatcccggtgtgaagaatacccattgactcgggccttttgccagcttattagtactctggtggagagctcatttccttctaatttgggtgctggactgcggccccctggctttgacccttatttgcagttccttagagactctgtgtttctacgattccgtacaagagcttaccggagagcagctgaaaagtgggaagttgctgaggtggttttggaggtgttttataaattgctcagagattatgagcctcagcttgaagattttgtagaccagtttgtggaactacaaggagaagaaatcatagcctataagccacctggatttagtctgatgtatcatctgctgaatgagtcaccaatgttggagcttgctctcagtttactggaagaaggagttaagcagcttgacacctatgccccctttcctgggaaaaaacacctggagaaagcagtacagcattgccttgcacttctcaatcttactctgcaaaaggaaaatctttttatggaccttctaagagagagtcaactggctctaatagtctgtcctttagaacagcttttgcagggaattaatcccagaactaagaaggcagataatgtggtaaacattgccagatacctatatcatggcaatactaatccagaattggcttttgaaagtgccaagatcctctgttgtatctcttgcaactctaatattcagataaagttggttggagatttcacacatgaccagagtataagtcagaaactaatggctggatttgtggagtgtttggattgtgaagatgcagaagaatttgtacgtctggaagagggatcagaacttgaaaagaaattagttgcaattcgtcatgaaacaagaatccacatcttgaatcttctcattacctctctggaatgcaatccacccaatcttgctctctacctgttgggctttgaattgaaaaaacctgtcagtactacaaacctacaagatccaggagtgttaggttgccctcggacatgccttcacgccattctaaacatcttggagaaaggaacggaagggagaacaggcccagtggcggtgcgagaatctcctcagctggctgagctatgttaccaggtcatatatcagttatgtgcatgctctgatacatctggtcctactatgaggtacttgagaaccagccaggatttcttattttcccagttgcagtatctaccattttctaacaaagaatatgaaatatctatgctgaaccagatgtcatggcttatgaaaactgcctcaatagagctaagggtaacctctctgaatcgtcagcggtcacatacccagaggctcctacacctcttactggatgacatgccagtgaaaccatactcagatggtgaaggaggaatagaagatgaaaacaggtctgtttctgggttccttcactttgacactgctacaaaagtacgtcgaaaaattctaaatattcttgactcgattgacttcagtcaggagatccctgagcctttgcagttggatttttttgatcgggcccagattgaacaagttattgctaactgtgaacacaagaatttacggggacagacagtctgcaatgtcaagcttcttcatagggttcttgtagctgaagtaaatgcccttcagggtatggcagccataggacagagacctctactaatggaggaaatcagcactgtacttcagtatgtggtaggaagaaataaattgctgcagtgtcttcatgcaaaacgtcatgctctggagtcgtggaggcaactagtagaaattatactgacagcttgtccccaggacctcattcaggcagaggatcgacaactgattattcgtgatattttacaagatgtgcatgataagatactggatgatgaagctgcgcaagagttaatgcctgtggtcgccggggcagtgttcacactgactgctcacctaagccaggccgtcctcactgaacagaagcaaacatcagtcttgggaccagcagaggcccattacgcttttatgcttgatagttgcttcacctcacctcctcctgaagagaacccattagtgggttttgcttctattggagattcttcactttacatcatattgaagaaactgttagacttcattttgaagacaggtggtggattccaacgagtgaggactcacttgtatggctctctgctttattacttacagattgcccagagacctgatgaaccagacaccttagaagcagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaaggatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggcatttctcacaagagtggcaaagatacagcagggtgcattagagctgctaagatcaggggtgattgtgagactagctcaatgccaagtctatgacatgcgcccagaaacggacccgcagagcatgtttggcatgagagaccctccaatgttcatccctaccccagtggatcgctaccgccagattctcctcccagctctccagctgtgccaggtcatcctcacatctagtatggcccagcacttgcaggcagcagggcaggtattgcagtttcttatttcacattctgataccatacaagcaattctgcgctgtcaggatgttagtgctgggtctttgcaggaattggctctgctgacaggaattataagtaaagcagcacttcctggaatattaagtgaacttgacgttgatgtaaatgaagggtctctaatggagctacagggacatattggaagattccagcgccagtgcttaggactactaagtcgctttggtggctctgacagactgcgtcagtttaaatttcaagacgataatgtggagggagataaagtaagcaagaaagatgagattgaactggctatgcagcagatttgtgccaatgtaatggaatattgccagtcactcatgttacagagttcccctaccttccagcatgctgtgtgtctcttcactcctagcctttcagaaacagttaatagagatggaccgcggcaagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagagttgtgtcagtctgtgatgcctgctggtgttgataaaatctccactgctcagaaatatgttctagcaagacggcgcttggtgaaggtgatcaacaatcgagctaaactgctttccctttgttcttttatcatagagacctgcctatttattctttggcgccatctggagtactacttgttacattgcatgcccacggattctcaagattccttatttgcctcgagaaccttgtttaaaagcagaagactgcaagattccttcgcctcagaaaccaatctagattttagaagtgggctggctatagtgagccaacatgatttagaccagcttcaggctgatgcaatcaacgcttttggagaatcactacaaaagaaacttctggacattgaaggattatattcaaaagttcgatctcgatatagtttcatacaggctcttgtcagacgtatccgtggcctcttgaggatatcaaggaactgagagcccgtgcttatgctcttctatgagagagatgaattggggagaattgtctccattttatagattagtttctttctaaattatgaccaaaaatattttgctatttctttctttgtatatggacatcttttctgtaaacttcttcccctagttccatcctcactagtaaaaaataaatactttttaaaaaaac

SEQ ID NO: 375 - DNA, 6239 bp, Homo sapiens
  ref <308>: DATABASE ACCESSION NUMBER: D86985
  ref <309>: DATABASE ENTRY DATE: 2001-06-18
cgatctgcttctgatgaaagctctggtatcgagactttagtggaggagctctgctccagactgaaagaccttcagagtaagcaagaagagaagattcacaaaaagttagaggggtctccctctccagaggcagaattatcccctccagcaaaggatcaagtggaaatgtactatgaagcatttccaccactttctgagaaaccagtttgcctgcaagaaatcatgactgtgtggaacaagtctaaagtctgttcttactctagctcttcttcatcatccacagccccaccagctagcacagatacttcctctcctaaggactgcaacagtgaaagtgaagtcaccaaggaaagaagcagtgaagtacccaccactgtgcatgagaaaacccagagcaaaagcaaaaacgagaaggaaaacaaatttagtaatggcacaattgaagaaaagcctgctttgtacaaaaagcaaatccgacataaacctgaaggaaagattcgccctcgctcgtggtcttctggctccagtgaagcaggctcaagttccagtgggaatcagggagaattaaaagcatccatgaagtatgttaaagtaagacacaaggcacgagagattcgaaacaaaaaagggcggaatgggcaaagcaggctttctttgaagcacggtgaaaaggctgaaaggaacattcatactggaagtagtagcagtagcagcagtggttctgtcaaacagctgtgcaagcggggtaagagacctttaaaagaaatagggagaaaagatcctgggagcactgaaggaaaagacctgtacatggagaatagaaaggacacagagtataaagaggagcccttgtggtacaccgagccaattgctgaatattttgttcctctgagcagaaaaagtaaactagagaccacataccgaaacagacaggatacaagtgatctgacatcagaggcagtggaagaattgtctgaatcagtgcatggtctttgtatcagcaacaataatcttcataaaacatacctcgcagcaggtactttcattgatggtcattttgtagaaatgcctgcagttataaatgaggatattgacctcactgggacctcattatgttctctaccagaggacaataaatacctggatgatattcatctatcagaattaacgcacttctatgaagtggatattgatcaatccatgttggatcctggtgcctcagaaacaatgcaaggagaaagtcggattttgaatatgattcgacagaaaagcaaagagaacacagattttgaggcagaatgttgcatagtgttagatggtatggagttgcaaggggaacgtgcaatatggacagattctaccagctccgtaggtgctgagggcttattcctgcaggaccttggcaatctggctcagttttgggagtgctgttcatccagctccggtgatgctgatggggagagttttggaggagactctccagttagactctctcccatcttagacagcacagtgctcaattcacacctgcttgctggcaatcaagagctcttttcagatattaatgaaggatctggtataaactcttgtttttcagtgtttgaagtgcaatgcagtaattctgttttaccattttcttttgaaacactcaacttgggaaatgaaaatacagattctagtgctaatatgcttgggaaaacacagtctagattgctaatatggaccaaaaatagtgcctttgaagaaaatgaacactgttctaatctttcaacaagaacttgtagtccatggtcccattcagaagaaacacgttcagacaatgaaacattaaatattcagtttgaagaatccacacagtttaatgccgaagatattaattatgtagttcctagagtctcgtcaaattatgtagatgaagaacttctagattttttgcaagatgaaacttgccagcaaaacagtagaactttaggtgagattcctacattagttttcaaaaaaacatctaaactagaatccgtctgtggtattcagctagaacaaaaaacagaaaacaaaaattttgaaactacacaagtatgtaatgaaagtccacatggagatggctacagctcaggggttattaaagacatttggacaaagatggcagacacaaattctgtggctacagtagaaatagaaagaactgatgctgagttgttttcggcagatgtaaataactactgctgctgtctagatgctgaagctgaactggagacccttcaggagcctgataaggctgtgcggaggtcagagtaccatctgtgggagggacagaaagagagcctggagaaaagagcatttgcttctagtgagctatcaaacgtggatggtggtgattatacaacaccctctaaaccctgggatgtagcccaagataaagaaaacacattcattcttggaggagtttatggagaactcaaaaccttcaatagtgatggggagtgggcagtcgtaccacctagtcacacaaaaggaagtctgttacagtgtgcagcttctgatgttgtgacgatagctggtacagatgtctttatgaccccaggaaacagttttgctcctgggcacaggcagttatggaaacccttcgtgtcatttgaacagaatgatcagccgaagagtggggaaaatgggttaaataagggattttcttttatcttccatgaagacttactaggagcttgtggcaactttcaagtcgaagatcctggacttgaatactcattttcttcctttgacttaagcaatccattttcacaagttcttcatgtagaatgctcatttgaacctgaagggattgcatctttcagccccagttttaaaccgaaatcaatcctctgttctgattcagacagtgaagtgtttcaccccaggatatgtggtgttgacagaacacaatacagggctattcggatctctcctcggactcactttcgcccaatttctgcatccgaactgtccccaggaggaggaagcgagtcagaatttgaatctgagaaagatgaagcaaatattcccattccttctcaagttgatatatttgaagatccgcaggcagatctcaaacctttggaagaagatgcagagaaagaaggccattactatggaaaatcagagcttgagtctggaaaattccttcccaggttaaaaaaatctgggatggaaaagagtgctcagacatcactggattcccaggaggaatcaactgggattctttcagtaggaaagcaaaatcagtgtttggaatgtagcatgaatgaatccctggaaatagatttagaaagctcagaagcaaattgtaaaataatggcacaatgcgaggaagaaattaataatttttgtggttgcaaagcaggttgtcagtttcctgcttatgaagataatccagtttcttcgggacagctggaagagttccctgtattgaacactgatatacaaggaatgaatagaagtcaagaaaaacagacctggtgggaaaaagccttgtactctcctctttttcctgcatcagagtgtgaagaatgttacacaaatgccaagggagagagtggtttagaagaatatccagatgctaaagagacacccagtaatgaagagcgcctgttagattttaatagggtgtcttctgtttatgaagcaagatgtacaggagagagagattctggagcaaagtcagatggcttccgcggaaagatgtgctccagcgccagctccacctcggaagagacaggctcagaaggcggaggcgagtgggtgggccctagtgaagaggagctcttttctcgaactcatctctaaacctgcaaaatagtacaaattattgtttaaaaatgatatgtgatggaaaattactcttcagtgagacctgttaatctaaaacaacaacttaggtttcctcttcaattaactgattcagattggtaataattatctttctcttcttgcttattttagagttgaggacagctatcctgttaaagattttttttcccagctgttaaattcttggctatttgaaatagactagattgtgttgtcaaatcaagaatgggtgtgcatgtgcttgtcttagaagtatcactgctttttgcatcttaactgcagttaattttccttccgactgcggttatatcactatgaccttactagcattgcagtgtcaacaaccacttctgctcttcagagacttcagctttggagcatttaggctttgttctccaagaactgggatatccattcttaccctacagtggcttgatgcctttctgaaggcgagagggaagcctgggtgactcagcggtggtctccattcagcaaaatctcatgtacatttccagtaggaaccgcagaggtgtgcttttcaagactcaccaaatactgtgttttctctcttaggatttcttttcccctaaagtatcacggaagatactatggttcgtgactttcttgctaactgaagaagccaaggatttggggtgtggggtcgtatgcgagacacagtggggtaagggtgcataccccaccccttacctgctctcatactgcagttacatttacaccaaaaccccatgcagggttctttgtggtgagtgttccatacgtgctaaggaccttagttgcagattgttactttctggtgacctatgttgaattgaaacccccaaaacttgaaattgtgaacatttgacatgcagtaaaggccacctcatcacccagagaaatctttggctgctgcagctagccgcttcttggctgtgatgtagtatagcttcgatctcattttgtgtttgagagaatgttctgggcaagttctgtgtgtggtgggttggggcgggtagagtcatgagttttccacatccctgtgtggtggttttgctgactgtcgctccgtgggactggctcccgtttctccttggtgagcccggggagccggcgcatcttgtgagtcgcgtctgtgcatggcgatccgctcctccggctctcatggcattgtgccacaggcagaggccaggaggagcagtatgtgcacagccgaaacattttacattttttacattgtttttcttttttaaccaactcattgtttaaaaaacaaaaacaaaaaaaacctaatctgtgaaatcagcgtagcatgcctggagcatcaggaatggcagaaaagtctgatgcgctctagacagcttcaccactcatttgggcaggcagtaaacacacatataatttattagctgggagctgaactggctgtgaaatctatgatttgctttgaacatttgggttttgttgcctttttcttaattgataacacagaaaagaaagtaccatcaaagactgtggagtcattgagggtctgtgtgtcctcaccgagagggacctggtgtgcccgccgggtcgatcttcccacgtgttagggtttatttttatacaacacatcttttgacactttaaggtgggtgggtgtgtgtgtgtgtgtgtgtgtgcgcgcgtgcgcgcgcgcatgtgtaaggttttatgttgctgttatttatttacgaacttcagatacgtttttatgtatttttcattcttctggagcttcctaaaaattgataagcatctgcactgaaatataatttaacagcaaaagtaaaaaaggattgaaagttgtaaattcctcatatcactacagtgacgattattctagaaatcgttgcttgtgtagcaaagaccaaataaatagatttcagacacaaccttgagcacagttgattttggacagctgctgtttattaggaaagggctccaggtggcaaaggtgcacacttcctcagacacaggtgagaagatgcagcaccttccacaggtgaatgggacggattcgaagtgagcaaagggattcacaaattatgtatttatttgttttcatagttaagtagctgaagctcagaggctttcagcaacagagatgaaagtgtggctttttagttttgtgaatggatgatcacaaagaaaaagcatttttaaaaagttggcaaacgctgaaacgcactgtggtatgaagcgcattgcatttccatagcactgaagtaccagtttccattcctgggctgagattgtttttcccgtggttgtattgttctgatttcacgtacaccagagtaactgatttttttttgtttgttttcttgtggagttaacaccaaataaaaattgtaaaaaac

SEQ ID NO: 376 - DNA, 5630 bp, Homo sapiens
  ref <308>: DATABASE ACCESSION NUMBER: D87076
  ref <309>: DATABASE ENTRY DATE: 2001-06-18
caagtgcaacgtctgtgtgcatcaggcatgctacgggatcctcaaggtgcccacgggcagctggctgtgccggacgtgtgccctgggtgtccagccaaagtgcctgctctgccccaagcgaggaggagccttgaagcccactagaagtgggaccaagtgggtgcatgtcagctgtgccctatggattcctgaggtcagcatcggctgcccagagaagatggagcccatcaccaagatctcgcatatcccagccagccgctgggctctgtcctgcagcctctgcaaggaatgcacaggcacctgcatccagtgttccatgccttcctgcgtcacagcgttccatgtcacatgcgcctttgaccacggcctggaaatgcggactatattagcagacaacgatgaggtcaagttcaagtcattctgccaggagcacagtgacgggggcccacgtaatgagcccacatctgagcccacggaacccagccaggctggcgaggacctggaaaaggtgaccctgcgcaagcagcggctgcagcagctagaggaggacttctacgagctggtggagccggctgaggtggctgagcggctggacctggctgaggcactggtcgacttcatctaccagtactggaagctgaagaggaaagccaatgccaaccagccgctgctgacccccaagaccgacgaggtggacaacctggcccagcaggagcaggacgtcctctaccgccgcctgaagctcttcacccatctgcggcaggacctagagagggttagaaatctgtgctacatggtgacaaggcgcgagagaacgaaacacgccatctgcaaactccaggagcagatattccacctgcagatgaaacttattgaacaggatctgtgtcgagcaggcctgtccacctcattccccatcgatggcaccttcttcaacagctggctggcacagtcggtgcagatcacagcagagaacatggccatgagcgagtggccactgaacaatgggcaccgcgaggaccctgctccagggctgctgtcagaggaactgctgcaggacgaggagacactgctcagcttcatgcgggacccctcgctgcgacctggtgaccctgctaggaaggcccgaggccgcacccgcctgcctgccaagaagaaaccaccaccaccaccaccgcaggacgggcctggttcacggacgactccagacaaagcccccaagaagacctggggccaggatgcaggcagtggcaaggggggtcaagggccacctaccaggaagccaccacgtcggacatcttctcacttgccgtccagccctgcagccggggactgtcccatcctagccacccctgaaagccccccgccactggcccctgagaccccggacgaggcagcctcagtagctgctgactcagatgtccaagtgcctggccctgcagcaagccctaagcctttgggccggctccggccaccccgcgagagcaaggtaacccggagattgccgggtgccaggcctgatgctgggatgggaccaccttcagctgtggctgagaggcccaaggtcagcctgcattttgacactgagactgatggctacttctctgatggggagatgagcgactcagatgtagaggccgaggacggtggggtgcagcggggtccccgggaggcaggggcagaggaggtggtccgcatgggcgtactggcctcctaactcacccccttccctgtcccaggccctgccctggtccccccacaaggcctcagcccagtcacaactgccatttccagtctctgctgagtgtcccagaccctcgaggctgccactccgtcgtggttttatttttaatatagagagagttttgaattctacactgttgtctttcctctgtgctggcctaggacattaggattccttccacggctccggccgctaggaccctgccaggtcccgcgcaccatccctgccctgcccacgtggtattgctgggctcctggctagatgcaagcaaggtggacaagagctcaggactccagcccactgccactgggtgacacagactgtcgtttgggcattatttcatggcagatgggccagtccagggcctaccccgccttgcccccagatcccactggggtccatttggggggtcctgctacactccaccgatccccaaggaagtataataaacgatacccagccagagtctactcactgtcacaagcacaacgagtttatatgagaaagcactgagggggtgcagagggcccgctagttccaggggaactgaaagctgttcctgatcagcccgtatcatctgaggcctgcctgcccaccctgccaccctcccctcccttgctgctctgcccctgccagtgcccagcccagcggctctgggaaggggttcccagaatccctcctgagctgtgccatttactcaggggactcccaaacagccagctgccagtgcaggtggagggctgtaggggagggccagtgcccagacagggtcatggggctcagaccagcccactgtagagaatcactctgaggctccaacttccttccttccttcggggccagtctcggccgaagtctggtcacgctcagacagagctgaccagaccagaccgtttgccttttcaagtttcctagtcctgctacaagatgagcttcttccgtggtttccttttggaaactcctccttccaacaagcagtgggatcccggggcccagggcgggccggtgttggccgctggggctgttgtaagtcttgctggatgttcccctgttcctgagccttaacccctcgcacagccatcccccccccccgtcctgccatccccccccgccgtcctgccttccccaccccacccttaggtcccaggtagttgctctgaagagtttcagtagagtggccccagggtgatagctcagggaacaacaaaaaaggaattccgtgaaaacatttttttttctttgatgaattactcctgggtcacttccaccactggtaaagccagaacttctccaaaaagaaccttgcaaaaagtccagtgaatcagtcgaatcattctgtggatgccaaagaatattttgaccataatacagcacagcctggacctgacaacttgtcatttggacttttttttaaatggagttctttagcaacaaagtatagaaacatgttcattgcacacacccaaggagaagagctcaagcgcttggaagaggatgctttgctgctgctgaagtgtacctgggtgttagatttcagatcctgggctgagcccactgtgagctttcctaaactgtgagactcacagaggggaaagatactgacggtgaaaccagcatggaaaacgtctttaccatgtggttccctcctccccaaatacataaagcaaataagcaggatggggaacagcttgaccttcatccacccctaactccaaaactatcaaggtacgacagtggcattgtcatcgacactcaatttcatgtgaattttagcaaaacaggaaacaaagataatgactcagttcagaggatcggacaaatgtgtctagtccgggtggactcggagggagtggggtgggcttcaaggattctgggcgttgggatggcatgagctaccctgtagagtttagtctgcctgcccgccttggtagtagtgaccagtcagtgtcagcatcagtgtcccaaccccagtctctgtttactgcctttgaacagaacttcttccttccccatgctttgggtcacctcgggctgcaaccctgtctgtgccagattgcccggtctgaccctgcaggaagcaaagaggtgagcttaaagaacaaccaaactctgccaggggtcccagaaagcccagggtccagcagtctcagcacttggccccttgccccttcacaccatcctggggcaggggctgggcctccctggtggcaggggtgggtggagaattagggagagggtgcaacgagtctggccccttgcctcgggctggctggtgttcttccaagagcctctgctcacattgttggcctctggattctggcccttcttcattggctgttgctttggactggactgttgctgagcctgtgtcctgcagaacccagatgtctgttaggctggctggctgctgcgaggggaggggggtggcctttcatttggggtgccctttcactcccaggccaagccctggagcaatcttcttcaggcagctgtctccacctccaggatgtccagcaggctgcaaggagaaggatgccagccacccatcctcccccagttcccagcctttcccctgttggtcacagccgcttctgtctttttccggtctactgtccccagtgtagagggctttgctgtccctgagactgaggcaggttccttttccaggtcagaggtggaggtagatctttctctcaaccacatctgcctccacacacagctcctccgcagggaaggagaagctgctctgtaactcattctggctatcgtcccccttctcactgacctgaccgcccaccacctccttccccctcatcacatgacaaaggataatgtgcaagaaaagtatttttatgtatcataaatgtattttgaaacaaatgagaagaagaaaggtagaagggtttattttattaaatgagcctgacttagtgacagtgtgtgagcatttgcaatgtaagggcctcagcttccttggagaagccaccccaggtttccagacatagatgttgaattgtttgtggggggtgtgccaggccacgtctcgtgtgtccgtatgcaggcatgcctgtgtatactgtgtatgggcacactgtgggactagctgggacaattcctagagattcaactgcccaattctaaccaacattggcagcggctgaacttggcatttccttgctaactgccagatgtggccaacctttgtccatatgcaaaccactgaaaaatgatctggatttctatagcaaggcccttggggagggcactctcccatgcccttggcctcgctggccacattggccaatgagccagggctggagtctgagacctttggttgttctttaaggcacctcctgccactttctccctcagaggcacaaacactttgtgttccacgtcagtttgaggggacggtggggggatgatatgaatgtcacaggaggagacaccttctgtctttgtttcaaagaaagtgatgtgccatttgttaatatacaagagaaatattgaaaatatattgaaaagagcaattttaaattatttttggcttatgttgcaatatttattttcttgtattagaaaagattcctttgtagagaaaaaatgtatttttcattaacgcaaagacctatttctcctttttgtacattgtccatgtgcgcaacccttaacgagcaatagaatgtatggtcacctgggtgtggccagtgcccgctgtgccctgcatgattctgtgttgccgctgctgcatagttcccagccccatcctgtcctgctcactcatgggggcttccagaccccggccccaccagggcttgtgtcatagggagccctttgcactcctcgtgtgttggcaaacgcagttaataaagcaatgttttctgtg

SEQ ID NO: 377 - DNA, 2635 bp, Homo sapiens
  ref <308>: DATABASE ACCESSION NUMBER: D87453
  ref <309>: DATABASE ENTRY DATE: 2001-06-18
ccaagatggctgcctccatagtgcggcgcgggatgctcctggcgcggcaagtggttcttcctcagctctctcctgcaggtaaaagatacctgctttcttcagcctatgtagacagccacaaatgggaagcaagagaaaaagaacattactgtcttgctgatcttgcatctttaatggataaaacatttgagagaaagttgcctgttagttctttaacaatatcacggcttatagacaacatttcctctcgggaagagatagatcatgcagagtattacctttacaagtttcgacacagccccaactgctggtacctgagaaactggactatccacacctggattaggcagtgtctaaaatatgatgcacaagacaaagccctatatacccttgtaaataaggttcaatatggaatttttccagataactttacattcaatttactgatggattctttcataaagaaagaaaattacaaagatgctttatctgtggtttttgaggtcatgatgcaagaagcctttgaagtgccttccacccaacttctctccctctatgttttatttcattgcctggcaaagaagacagacttcagttgggaagaggagaggaactttggtgcatcccttttgcttccaggcctaaaacaaaagaactcagtgggtttcagttcccagttgtatggctatgcacttcttgggaaggtggagttgcagcaagggctacgggctgtgtaccacaacatgcctctgatatggaaaccaggctaccttgacagagcccttcaagtgatggagaaagtggctgcctccccagaagacataaagctgtgtagagaagcgctcgatgtgctggatgcagtgctgaaggctctgacttcagctgatggggcttcagaggagcagtcccaaaatgatgaagacaaccaggggtcagaaaaactggtggagcagttagacatcgaggaaacagagcagtccaagcttcctcaatacctggaacgatttaaggccttacattctaagcttcaagctctgggcaaaattgagtcagaaggtcttttaagtctgaccacccagcttgtcaaggaaaaactctccacctgtgaagcagaggacatcgccacctatgagcagaatctgcagcagtggcatctagaccttgtacagttgatccagagagaacagcaacagagggagcaagcgaagcaggagtaccaggctcagaaagcagcaaaggcatctgcctaatagggtcccccagggccccacctgtctcacaagaacttcactcaaccccgtgccaggactcagcagtggcctggacaacagcctcagcttcctctacccatcttcttttcttaaagcaggctatgtgccctacatggcaaggcaccatgactgcccatcgagatgccaagaagggctatggaactatgcaggtggctagtggtcagactgaagtcaccagctgaataccttaaggaggactcttgaggctcataatggagttcctggggcacagggattagttatgagcattaaagttcctaagacccagtgacagtactgggagaaaccaaggctgaagagtcaggttgaagcacaggcttttgttttttgttgtttttgttttttgagacagagtctcattctgtcacccaggctggagtgcagtggcgcaatcttggctcactgcaacctccgactcccaggttcaagcaattctcctgcctcggcctcctttagtaggtgggattacaggtgcataccaccacacctttctaatttttgcatttttagtagagatggggtttcaccatgttggtcaggctggtctcaacctcctgacctcaagtgatctgcccgcctcagcctcccaaagtgctgggatgataggcgtgagccaccacacccggccaagcacaggcttttgaatggtctccctctccccagcccaggtacatgaggccaaggtgaactgtgcatcctgagaccttgtgtccctgagtctcctttctgagtgcaagctgcactgtgagctggctgtgggatactcacacattcccacattctcctttctgccacatctcgcccttctggacctgcactgggagaaattcaggacaggagtgaactcaaggccatgaactcactggatttccatttttaggcacccatagggatgtttttaggatgtaagtttctgaggagaaagctagctctagcatgaagcttttttggattggcttctccatcgtgttggggtaacattttttttccaattttttttttcccaaaacatcgtctcagctcatttatcaagtaggtaaaatgagccttttgtgtacacacagaggcacatgtgcacgcacacacaacttgtgaacacacatttctgttaaagaagttagaaaatgagagatgggttggggcttgaagtgcatcagaggtatgaatgttgtaaaactgtcaggagatgtaaaattcctttctgaagtgtctcttctgtgaaagggttcagagcagattttgcttactatgtagtgttgcccttaagtacagtggtgtaattttattcaagattgtgctcttctatcaaaagcctctggaaataaatgttccgggatcatgtt

SEQ ID NO: 378 - DNA, 8924 bp, Homo sapiens
  ref <308>: DATABASE ACCESSION NUMBER: D87469
  ref <309>: DATABASE ENTRY DATE: 2001-06-18
gagagcgtccccttaggctacctggttctccatgtccaggctatcgacgctgatgctggtgacaatgcccgcctggaataccgccttgctggggtgggacatgacttccccttcaccatcaacaatggcacaggctggatctctgtggctgctgaactggaccgggaggaagttgatttctacagctttggggtagaagctcgagaccatggcactccagcactcactgcctcggccagtgtcagcgtgactgtcctggatgtcaacgacaacaatccaacctttacccaaccagagtacacagtgcggctcaatgaggatgcagctgtgggcaccagcgtggtgacggtgtcagctgtggaccgtgatgctcatagtgtcatcacctaccagatcaccagtggcaatactcgaaaccgcttctccatcaccagccaaagtggtggtgggctggtatcccttgccctgccactggactacaaacttgagcggcagtatgtgttggctgttaccgcctccgatggcactcggcaggacacggcacagattgtggtgaatgtcaccgacgccaacacccatcgtcctgtctttcagagctcccactatacagtgaatgttaatgaggaccggccggcaggcaccacggtggtgctgatcagcgccacggatgaggacacaggtgagaatgcccgcatcacctacttcatggaggacagcatcccccagttccgcatcgatgcagacacgggggctgtcaccacccaggctgagctggactacgaagaccaagtgtcttacaccctggccattactgctcgggacaatggcattccccagaagtccgacaccacctacctggagatcctggtgaacgacgtgaatgacaatgcccctcagttcctgcgagactcctaccagggcagtgtctatgaggatgtgccacccttcactagcgtcctgcagatctcagccactgatcgtgattctggacttaatggcagggtcttctacaccttccaaggaggcgacgatggagacggtgactttattgttgagtccacgtcaggcatcgtgcgaacgctacggaggctggatcgagagaacgtggcccagtatgtcttgcgggcatatgcagtggacaaggggatgcccccagcccgcacacctatggaagtgacagtcactgtgttggatgtgaatgacaatccccctgtctttgagcaggatgagtttgatgtgtttgtggaagagaacagccccattgggctagccgtggcccgggtcacagccactgaccccgatgaaggcaccaatgcccagattatgtaccagattgtggagggcaacatccctgaggtcttccagctggacatcttctccggggagctgacagccctggtagacttagactacgaggaccggcctgagtacgtcctggtcatccaggccacgtcagctcctctggtgagccgggctacagtccacgtccgcctccttgaccgcaatgacaacccaccagtgctgggcaactttgagatccttttcaacaactatgtcaccaatcgctcaagcagcttccctgggggtgccattggccgagtacctgcccatgaccctgatatctcagatagtctgacttacagctttgagcggggaaatgaactcagcctggtcctgctcaatgcctccacgggtgagctgaagctaagccgcgcactggacaacaaccggcctctggaggccatcatgagcgtgctggtgtcagacggcgtacacagcgtgaccgcccagtgcgcgctgcgtgtgaccatcatcaccgatgagatgctcacccacagcatcacgctgcgcctggaggacatgtcacccgagcgcttcctgtcaccactgctaggcctcttcatccaggcggtggccgccacgctggccacgccaccggaccacgtggtggtcttcaacgtacagcgggacaccgacgcccccgggggccacatcctcaacgtgagcctgtcggtgggccagccgccagggcccgggggcgggccgcccttcctgccctctgaggacctgcaggagcgcctatacctcaaccgcagcctgctgacggccatctcggcacagcgcgtgctgcccttcgacgacaacatctgcctgcgggagccctgcgagaactacatgcgctgcgtgtcggtgctgcgcttcgactcctccgcgcccttcatcgcctcctcctccgtgctcttccggcccatccaccccgtcggagggctgcgctgccgctgcccgcccggcttcacgggtgactactgcgagaccgaggtggacctctgctactcgcggccctgtggcccccacgggcgctgccgcagccgcgagggcggctacacctgcctctgtcgtgatggctacacgggtgagcactgtgaggtgagtgctcgctcaggccgttgcaccccgggtgtctgcaagaatgggggcacctgtgtcaacctgctggtgggcggtttcaagtgcgattgcccatctggagacttcgagaagccctactgccaggtgaccacgcgcagcttccccgcccactccttcatcacctttcgcggcctgcgccagcgtttccacttcaccctggccctctcgtttgccacaaaggagcgcgacgggttgctgttgtacaatgggcgtttcaatgagaagcatgactttgtggccctcgaggtgatccaggagcaggtccagctcaccttctctgcaggggagtcaaccaccacggtgtccccattcgtgcccggaggagtcagtgatggccagtggcatacggtgcagctgaaatactacaataagccactgttgggtcagacagggctcccacagggcccatcagagcagaaggtggctgtggtgaccgtggatggctgtgacacaggagtggccttgcgcttcggatctgtcctgggcaactactcctgtgctgcccagggcacccagggtggcagcaagaagtctctggatctgacggggcccctgctactaggcggggtgcctgacctgcccgagagcttcccagtccgaatgcggcagttcgtgggctgcatgcggaacctgcaggtggacagccggcacatagacatggctgacttcattgccaacaatggcaccgtgcctggctgccctgccaagaagaacgtgtgtgacagcaacacttgccacaatgggggcacttgcgtgaaccagtgggacgcgttcagctgcgagtgccccctgggctttgggggcaagagctgcgcccaggaaatggccaatccacagcacttcctgggcagcagcctggtggcctggcatggcctctcgctgcccatctcccaaccctggtacctcagcctcatgttccgcacgcgccaggccgacggtgtcctgctgcaggccatcaccagggggcgcagcaccatcaccctacagctacgagagggccacgtgatgctgagcgtggagggcacagggcttcaggcctcctctctccgtctggagccaggccgggccaatgacggtgactggcaccatgcacagctggcactgggagccagcggggggcctggccatgccattctgtccttcgattatgggcagcagagagcagagggcaacctgggcccccggctgcatggtctgcacctgagcaacataacagtgggcggaatacctgggccagccggcggtgtggcccgtggctttcggggctgtttgcagggtgtgcgggtgagcgatacgccagagggggttaacagcctggatcccagccatggggagagcatcaacgtggagcaaggctgtagcctgcctgacccttgtgactcaaacccgtgtcctgctaacagctattgcagcaacgactgggacagctattcctgcagctgtgatccaggttactatggtgacaactgtactaatgtgtgtgacctgaacccgtgtgagcaccagtctgtgtgtacccgcaagcccagtgccccccatggctatacctgcgagtgtcccccaaattaccttgggccatactgtgagaccaggattgaccagccttgtccccgtggctggtggggacatcccacatgtggcccatgcaactgtgatgtcagcaaaggctttgacccagactgcaacaagacaagcggcgagtgccactgcaaggagaaccactaccggcccccaggcagccccacctgcctcttgtgtgactgctaccccacaggctccttgtccagagtctgtgaccctgaggatggccagtgtccatgcaagccaggtgtcatcgggcgtcagtgtgaccgctgtgacaacccttttgctgaggtcaccaccaatggctgtgaagtgaattatgacagctgcccacgagcgattgaggctgggatctggtggccccgtacccgcttcgggctgcctgctgctgctccctgtcccaaaggctcctttgggactgctgtgcgccactgtgatgagcacagggggtggctccccccaaacctcttcaactgcacgtccatcaccttctcagaactgaagggcttcgctgagcggctacagcggaatgagtcaggcctagactcagggcgctcccagcagctagccctgctcctgcgcaacgccacgcagcacacagctggctacttcggcagcgacgtcaaggtggcctaccagctggccacgcggctgctggcccacgagagcacccagcggggctttgggctgtctgccacacaggacgtgcacttcactgagaatctgctgcgggtgggcagcgccctcctggacacagccaacaagcggcactgggagctgatccagcagacagagggtggcaccgcctggctgctccagcactatgaggcctacgccagtgccctggcccagaacatgcggcacacctacctaagccccttcaccatcgtcacgcccaacattgtcatctccgtagtgcgcttggacaaagggaactttgctggggccaagctgccccgctacgaggccctgcgtggggagcagcccccggaccttgagacaacagtcattctgcctgagtctgtcttcagagagacgccccccgtggtcaggcccgcaggccccggagaggcccaggagccagaggagctggcacggcgacagcgacggcacccggagctgagccagggtgaggctgtggccagcgtcatcatctaccgcaccctggccgggctactgcctcataactatgaccctgacaagcgcagcttgagagtccccaaacgcccgatcatcaacacacccgtggtgagcatcagcgtccatgatgatgaggagcttctgccccgggccctggacaaacccgtcacggtgcagttccgcctgctggagacagaggagcggaccaagcccatctgtgtcttctggaaccattcaatcctggtcagtggcacaggtggctggtcggccagaggctgtgaagtcgtcttccgcaatgagagccacgtcagctgccagtgcaaccacatgacgagcttcgctgtgctcatggacgtttctcggcgggagaatggggagatcctgccactgaagacactgacatacgtggctctaggtgtcaccttggctgcccttctgctcaccttcttcttcctcactctcttgcgtatcctgcgctccaaccaacacggcatccgacgtaacctgacagctgccctgggcctggctcagctggtcttcctcctgggaatcaaccaggctgacctcccttttgcctgcacagtcattgccatcctgctgcacttcctgtacctctgcaccttttcctgggctctgctggaggccttgcacctgtaccgggcactcactgaggtgcgcgatgtcaacaccggccccatgcgcttctactacatgctgggctggggcgtgcctgccttcatcacagggctagccgtgggcctggaccccgagggctacgggaaccctgacttctgctggctctccatctatgacacgctcatctggagttttgctggcccggtggcctttgccgtctcgatgagtgtcttcctgtacatcctggcggcccgggcctcctgtgctgcccagcggcagggctttgagaagaaaggtcctgtctcgggcctgcagccctccttcgccgtcctcctgctgctgagcgccacgtggctgctggcactgctctctgtcaacagcgacaccctcctcttccactacctctttgctacctgcaattgcatccagggccccttcatcttcctctcctatgtggtgcttagcaaggaggtccggaaagcactcaagcttgcctgcagccgcaagcccagccctgaccctgctctgaccaccaagtccaccctgacctcgtcctacaactgccccagcccctacgcagatgggcggctgtaccagccctacggagactcggccggctctctgcacagcaccagtcgctcgggcaagagtcagcccagctacatccccttcttgctgagggaggagtccgcactgaaccctggccaagggccccctggcctgggggatccaggcagcctgttcctggaaggtcaagaccagcagcatgatcctgacacggactccgacagtgacctgtccttagaagacgaccagagtggctcctatgcctctacccactcatcagacagtgaggaggaagaagaggaggaggaagaggaggccgccttccctggagagcagggctgggatagcctgctggggcctggagcagagagactgcccctgcacagtactcccaaggatgggggcccagggcctggcaaggccccctggccaggagactttgggaccacagcaaaagagagtagtggcaacggggcccctgaggagcggctgcgggagaatggagatgccctgtctcgagaggggtccctaggcccccttccaggctcttctgcccagcctcacaaaggcatccttaagaagaagtgtctgcccaccatcagcgagaagagcagcctcctgcggctccccctggagcaatgcacagggtcttcccggggctcctccgctagtgagggcagccggggcggcccccctccccgcccaccgccccggcagagcctccaggagcagctgaacggggtcatgcccatcgccatgagcatcaaggcaggcacggtggatgaggactcgtcaggctccgaatttctcttctttaacttcctgcattaaccctgggccgtggttcctacgcccgaggctcccttcccttccccagccgcactcatgccctgctcctgtcttgtgctttatcctgccccgctccccatcgcctgcccgcagcagcgacgaaacgtccatctgaggagcctgggccttgccgggaggggtactcaccccacctaaggccatctagtgccaactccccccccaccattcccctcactgcactttggacccctggggccaacatctccaagacaaagtttttcagaaaagaggaaaaaaagaatttaaaaaaggatctccactcttcatgacttcagggattcattttttttatacgctggaaattgactcccctttcccttcccaaagaggataggacctcccaggatgcttcccagcctctcctcagtttcccatctgctgtgcctctgggaggagagggactcctggggggcctgcccctcatacgccatcaccaaaaggaaaggacaaagccacacgcagccagggcttcacacccttcaggctgcacccgggcaggcctcagaacggtgaggggccagggcaaagggtgtgtctcgtcctgcccgcactgcctctcccaggaactggaaaagccctgtccggtgagggggcagaaggactcagcgcccctggacccccaaatgctgcatgaacacattttcaggggagcctgtgcccccaggcgggggtcgggcagccccagcccctctccttttcctggactctggccgtgcgcggcagcccaggtgtttgctcagttgctgacccaaaagtgcttcatttttcgtgcccgccccgcgccccgggcaggccagtcatgtgttaagttgcgcttctttgctgtgatgtgggtgggggaggaagagtaaacacagtgctggctcggctgccctgagggtgctcaatcaagcacaggtttcaagtctgggttctggtgtccactcacccaccccaccccccaaaatcagacaaatgctactttgtctaacctgctgtggcctctgagacatgttctatttttaaccccttcttggaattggctctcttcttcaaaggaccaggtcctgttcctctttctccccgactccaccccagctccctgtgaagagagagttaatatatttgttttatttatttgctttttgcgttgggatgggttcgtgtccagtcccgggggtctgatatggccatcacaggctgggtgttcccagcagccctggcttgggggcttgacgcccttccccttgccccaggccatcatctccccacctctcctcccctctcctcagttttgccgactgcttttcatctgagtcaccatttactccaagcatgtattccagacttgtcactgactttccttctggagcaggtggctagaaaaagaggctgtgggcaggaaagaaaggctcctgtttctcatttgtgaggccagcctctggcttttctgccgtggattctccccctgtcttctcccctcagcaattcctgcaaagggttaaaaatttaactggtttttactactgatgacttaaaaaaaatacaaagatgctggatgctaacttgatactaaccatcagattgtacagtttggttgttgctgtaaatatggtagcgttttgttgttgttgttttttcatgccccatactactgaataaactagttctgtgcgggt

SEQ ID NO: 379 - DNA, 6371 bp, Homo sapiens
  ref <308>: DATABASE ACCESSION NUMBER: D87682
  ref <309>: DATABASE ENTRY DATE: 2001-06-18
caggaagatactgtgttttttcacttgccacccagaaatggaaatggagccacagtatttggtatctcttgctatcgacaaattgaagccaaggcactgaaagtaaggcaagcagatatcaccagagagactgttcagaaaagtgtctgtgttctaagcaagctgcctctgtatggtttacttcaagcaaaacttcaactcattacacatgcatattttgaagagaaggatttttcccaaatttctattctaaaggagctttatgaacatatgaatagttccttgggaggtgcttcattagaaggatcccaagtatatcttggtctgtcacctcgagatcttgtccttcattttcgacacaaggtcttaatcctatttaagctaattcttcttgaaaaaaaggttcttttttatatttctccagtgaataaattggtgggtgcactgatgactgtgttatccctttttccaggcatgattgaacatggtctcagtgactgttctcagtatagaccccggaaaagtatgtctgaagatggtgggcttcaggaaagtaacccatgtgcagatgattttgtttctgcatccactgctgatgtttcacataccaacttgggaactatcaggaaagtcatggcaggaaaccatggagaagatgctgccatgaagactgaggagcctttgttccaagtggaagacagcagcaaagggcaggaacccaatgataccaatcaatatttgaaacctccatctcgcccatctccagattcttcagaaagtgactgggaaactttggatcctagtgtcttagaggaccccaacttgaaagaaagggaacagctgggatcagaccagacaaatttgtttccaaaggactctgtcccctcagagagtcttccaattactgtacaacctcaagctaatacgggacaggtagtcctgataccagggctcatttcgggtttggaagaggatcagtatggcatgcccctggccatcttcacaaagggatatctgtgtttgccttacatggcattgcagcagcatcatcttctctccgatgtcaccgttcgggggtttgttgctggagctactaacatcctttttcgacaacagaaacacctcagtgatgccattgtggaagtagaagaagctctgatccagatccatgatccagaactcaggaagctgcttaacccaaccactgcagacctaaggttcgcagactacctagtgaggcacgtgactgagaatcgggatgacgtcttcctagatggcacgggctgggagggaggtgacgaatggatccgggcccagtttgcggtctacattcatgccctgctggctgccacgctgcaattagttctgttcagaatagtgaacgtggcaaaaaaaattggaaacgtcatggtcacaactagccggaatgttgtacaaacaggaaaagctgttggccagtcagttggaggagctttttccagtgcaaagacagctatgtcttcatggctttccactttcaccacttccacctcccaaagtctcactgagccaccagatgagaagccttgagcaaggcgtcagaggctgctattgctttctgaggtttaagtgtcccctgtctgtctgctgctcccaggctgttactagccacagatccacagcaggggaccatatgtcgaactgtttacatggatgttgctctaagtgaatgtttcgggatgccgaaatgatgaaatcacagccatagcagggatggctttccaggttggggtttcaattgactacttttatttcagtctgagcctgattaaaacatacagtgaaccttctaatgaattttgagttttgatattgtacattggtttactttagaagagtttttacttatgtaaattttgttctgttttggtgtttgaatatctagatggtcactgtaatttatacttgctaaaattaatttatattaccattttctctaaagttggccttaaaacgtgcttataaagtgaaggggtcatacagttgggccttcattattttgctgaattatgtgatgatttttttgctttctacccacaaaacatttattaattcacttcctcccagaaacatgaaagttagaggtggtagttctgaggattgggtgttttgttttacgtttttagtttgttctttccacatccttaaaaacttggtttcagacatcaaggagtatcactgtgctttcctcctctttataactgtgcaggtgggtgtgcagagaaatagcagagtgatggttcgatgatactgaagcagtttaacatgaatgtgtctgtagggcaatactttcaaagaagacctatgtgtttatttttcaaccgcagtcatgttgcagtcttacaagcactttttttttattccagagtttgtgccatctgtttctctttttttttgggggggggggggggcggggtctcactctatcgcccaggctggagtgcagtggtgccatctcggctcactgcaacctccatctcccgggttcaagcaattcttgtacctcagcctcccaagtagctgggattatggacatgcgccaccatgcccagctaattattgtatttttagtagagacggggttttgccatgttggccaggctggtcttgatctcctggcctcaagtgatctgcccgcctcagcctctcaaagtgctgggactacaggcatgagccactgcgcctggcctgtttcttttttaaacagttttctattgggtgtttgcagacctacagcttttctcgtagtcttattcataaagcttttcaaagcacttagtcttctacttccctaactgaaagtcctcctataatcaatccctacccccttctagaagtatcttaaaagaaaagcaaggtgattgtaagtattaaatagaaatctcatcttagtttatattcagcaaagtaagaggcaagagaagaaaactgcagccttgacatctgtcatctgagaaaggacatctggtttcatgttaggcacatacatgcatgtgtgtgccatctactgatgatttgtacacagctggacctcgtgtgtttgccatgctcagctctcatttgcttttcaaggatacctgggatggctgttctcagagagtacttacggggaacagactgccttttagtaacaagggatacttgggaaatacattgtgagtatgatctatcccagattgctggggaaataaaggagggccctgattatatttggtttattcctcactaaatgtttaagaagtaaatgctcccaaggcatttgaaatgaacatagaaacataatctaaatgtctctaaattttccactttgtgttttctaaacacaaattgtattactcatttgagcataactcaagaattcagcgatgataaattgaagggctgaatgtgagaactccattaattccacttcttccaagaaagttaacctcaggaaatactgtttgaagagaagaaagtagtaccaaacaaaaaccttaaacagtacttgaatcttttttgcgctgagactataaagaattcattctaacatcttgtttcataagggccacatcattcgttggagcatgatagtgtgatttgtgtacaattgttacctctcagctgctgaagttcacacttcaaggatctaggagctctgtgaggggtcgtccagcaagatgctgatttgtctttcagttggtatggtttctgtgatcggggtaaactcccgtctcccactattcaaaagcagcccaactcatgctttggaatccactgaaataaaaatagttacatgaagtttaactttgctttaatatcacttgttcctcattgaatatacactttgatcagactttctattaacatttctagctaagagtttgactcttagtggtcactttactgactttccaacataaaacaagtatctcagaagatacagctttcatcatagaaatggtcaaaagaccatagctatatttccttcaggttctgggaggtggagtttttcaaggaacactggccgttgtattgttggcaggggccccaaggcagctcgcacaatcaaaggcaggaagcctcacccctggtcctgtgaccccccccaccccacacacacacatacttcaggcttggattctaggctccaagtggccagcatagaagcagcagcctctctccaaaccctggctctgtgagccataggaaccagcactaggtcatcttctgacatagccctggtgaaggtgtgtgtgtgttggtggccacacttgctaaggcttttgtgtctaagaattgagtatttgtacctaggtgtgagggaaccagggtcagccagcctttttcagatggcgccaggcacacacactacatcaatggcttgctggtggcttcaccactatccaggtgacttaaaagagtgtttggaaaatgtccctggtatacttcaattcctactagacattgtaatgacaatggtgtaggtaaggaagagagagttaaaactaccagttgtggaatagaaatagttgcatgtccaaagaaggcttagaatgattgtgcatatgcagttggctcacataaccagcatgaacagtctctccccaaatccattagtgattcactaccccccgccaagcacagccctaaaacaattctcgtccactttcctgttaagaaacacagcagcaatatactttggcagcaaaccagagcatatgatgtaacttgctcaaccttatcttcctttccaaattctatactaagcatctgatgttttttagaataatttcctttggaaagccaatgagaaaacaaattaggaagagagagaagtgagaaattgttgcatggctgaggaacaagatgcttaaaatctgaatggaagtattttgagagcagtatttcatgtgctaagggttataagaattcttttagaaagggattagaattttactctgctagttacaagttttaaagtcacgctacggcattatcaccctggcaggtaggttttgttattgttttacattttgtgaaaaaaagttttgtagaagttacagctagtggtcttttccctccagagccagtgatgagtgtgggagcacttcagctctgtaaggggccagcgttctgacctttaaccacatgaactaacctgcgtcagcagttgcagaaagtagcctgttaggacagcagctgctaagcgttgcctggtattttagtggggagaaggctgggactcttcatggcatcaacacttgcatgctctgaatctttgatcagagatgaggtgccatttttggcatttccaccccgtctcgtggtagcctttaaaagtggtagaagatgctgccctaattccccgaggatgattgtcattccatgcagcataatgtgccgtgaggagttttctcattccagttctttggacttcgtaacattggaattgtttttccataatttccggcattccataaatatttgtcaaggacaaagaaaaggaatgtggatgtttattcttttcatatgaatgactttgtacacatgacttcctgctttcattatgaaggaggggaaactagttcccttgtatggtaactccaaagttaaaaaattgtgcatgtctgaggggttgaatatattttgtaaaactctaaatacatttgtatttctgtgctgttctaaagtttacctttttacttatatgaaagataactatatatttaaatcatgtaagtggaacacagtgtagggggtttttccaatcttatttttcatcaggttctcacacccacgtagtatgctgctcaaattttttcgtgtgtgcaaatgtgaacatttgaacatttcagttaggtactgagccagaaaaggtaattgaagttttcagaaagcttctgtgcttagaaaatattttgttgttttcttaaaatattagtattttgtagctggaagaataagatcaaggcttacatgtttcaggccacttggtcactggttcctgaatttagaaaacattggattaatgagttggtgaaggcatttagtggttacaaaaacagtttaaatatttatgattaaaggcttttcacaaacctttttaaagaaaatttagctgagaaaacttaaaaagttttctaaggaagtttaactgtggcacatgttttgatcagaaaggtagttctctttgctctggtagttttaaagtttgtactagttctttatttctgttgtttttttaaattgttaaaattataaatcacgtctaatcatactgaattgtaaaacttgaattgtatctttattttaagcataaatgagaataaaatgatcctgttcaccctgcc

SEQ ID NO: 380 - DNA, 282 bp, Homo sapiens
  ref <308>: DATABASE ACCESSION NUMBER: G26403
  ref <309>: DATABASE ENTRY DATE: 2001-06-18
aatatccctggtgaaattagaggcatagcttgagactggtgacagtgcaacacagaccttcaggagctgctttgaggactggcctgcccagatgcctgctgttaagccagcagccccctcactccggcccctgccatcttgacagatggagctgccatggtttcagggacactcagcagggcatctgggttggtccctcccacatggaccttgtaaagttgctattcaggggaacctgggtatcgtttcaggcaaaacacagaaccatattagcacttctaa

SEQ ID NO: 381 - DNA, 2106 bp, Homo sapiens
  ref <308>: DATABASE ACCESSION NUMBER: J02639
  ref <309>: DATABASE ENTRY DATE: 2001-06-18
aattccggcagagctccgtttcctcatagaacaaagaacatccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagaacatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccccaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtcttcacctcccatgctgatctgtcccgcatcagcaaccactcaaatatccaggtgtctgagatggtgcacaaagctgtggtggaggtggacgagtcgggaaccagagcagcggcagccacggggacaatcttcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctatgctatggcccatctgtatgctggtagctagtgatttacgacaggtttagttgactagatgaggcattacaaataatattactctatggatgattgcttccacccacacgactgcaacatacaggtgccttggggaaatgtggagaacattcaatctgccgtcactattcatcaatgaagattagcactgagatccagagaggctggatggacttgctcaagttcaccagcatggtagtggcaaagagaggtccagagtcctggcccttgatgccgagctcatgccacaaagctcagtaggagggatgttccagtggatgagggccagccaggaagcacaggtccaaggctggtcccacacttatcagcagcaacaactgtcagttcatcctgcatgggaaaaatgttggaatgggagtctgaaatggggctactgtttcagtcctaacgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtgtcagttgcaggtgccaatgactaactttttg

SEQ ID NO: 382 - DNA, 1977 bp, Homo sapiens
  ref <308>: DATABASE ACCESSION NUMBER: J04162
  ref <309>: DATABASE ENTRY DATE: 2001-06-18
cactccagtgtggcatcatgtggcagctgctcctcccaactgctctgctacttctagtttcagctggcatgcggactgaagatctcccaaaggctgtggtgttcctggagcctcaatggtacagggtgctcgagaaggacagtgtgactctgaagtgccagggagcctactcccctgaggacaattccacacagtggtttcacaatgagaacctcatctcaagccaggcctcgagctacttcattgacgctgccacagtcgacgacagtggagagtacaggtgccagacaaacctctccaccctcagtgacccggtgcagctagaagtccatgtcggctggctgttgctccaggcccctcggtgggtgttcaaggaggaagaccctattcacctgaggtgtcacagctggaagaacactgctctgcataaggtcacatatttacagaatggcaaagacaggaagtattttcatcataattctgacttccacattccaaaagccacactcaaagatagcggctcctacttctgcagggggcttgttgggagtaaaaatgtgtcttcagagactgtgaacatcaccatcactcaaggtttggcagtgtcaaccatctcatcattctctccacctgggtaccaagtctctttctgcttggtgatggtactcctttttgcagtggacacaggactatatttctctgtgaagacaaacatttgaagctcaacaagagactggaaggaccataaacttaaatggagaaaggaccctcaagacaaatgacccccatcccatgggagtaataagagcagtggcagcagcatctctgaacatttctctggatttgcaaccccatcatcctcaggcctctctacaagcagcaggaaacatagaactcagagccagatcctttatccaactctcgatttttccttggtctccagtggaagggaaaagcccatgatcttcaagcagggaagccccagtgagtagctgcattcctagaaattgaagtttcagagctacacaaacactttttctgtcccaaccattccctcacagtaaaacaacaatacaggctagggatggtaatcctttaaacatacaaaaattgctcgtattataaattacccagtttagaggggaaaaaagaaaataattattcctaaacaaatggataagtagaattaatgattgaggcaggaccctacagagtgtgggaactgctggggatctagagaattcagtgggaccaatgaaagcatggctgagaaatagcagggtagtccaggatagtctaagggaggtgttcccatctgagcccagagataagggtgtcttcctagaacattagccgtagtggaattaacaggaaatcatgagggtgacgtagaattgagtcttccaggggactctatcagaactggaccatttccaagtatataacgatgagccctctaatgctaggagtagcaaatggtcctaggaaggggactgaggattggggtgggggtggggtggaaaagaaagtacagaacaaaccctgtgtcactgtcccaagttaagctaagtgaacagaactatctcagcatcagaatgagaatgagaaagcctgagaagaaagaaccaaccacaagcacacaggaaggaaagcgcaggaggtgaaaatgctttcttggccagggtagtaagaattagaggttaatgcagggactgtaaaaccaccttttctgcttcaatgtctagttcctgtatagctttgttcattgcatttattaaacaaatgttgtataaccaatactaaatgtactactgagcttcactgagttacgctgtgaaactttcaaatccttcttcagtcagttccaatgaggtggggatggagaagacaattgttgcttatgaaaaaaagctttagctgtctcctgttttgtaagctttcagtgcaacatttcttggttccaataaagcattttac

SEQ ID NO: 383 - DNA, 2154 bp, Homo sapiens
  ref <308>: DATABASE ACCESSION NUMBER: K02276
  ref <309>: DATABASE ENTRY DATE: 2001-06-18
gggggcagagggagcgagcgggcggccgcctagggtgcaagagccgggcgagcagagttgcgctgcgggcgtcctgggaagggagttccggagccaacagggggcttcgcctctggcccagcccttccggagccaacaggggacttcgcctctggcccagccctcccgctgatcccccagtcagcggtccgcaagccttgccgcatccacgaaactttgcccatactgcgggcgtacactttgcacttgaacttacaacacccgagcaaggacgcgactctcccgacgcggggagactattctgcccatttggggacacttccccgccgctgccaggacccggttctctggaaggctgtccttgaagctccttagacgctggagttttttcgggaagtgggaaagcagcctcccgcgacgatgcccctcaacgttagcttcaccaacaggaactatgacctcgactacgactcggtgcagccgtatttctactgcgacgaggaggagaacttctaccagcagcagcagcagagcgagctgcagcccccggcgcccagcgaggatatctggaagaaattcgagctgctgcccaccccgcccctgtcccctagccgccgctccgggctctgctcgccctcctacgttgcggtcacacccttctcccttcggggagacaacgacggcggtggcgggagcttctccacggccgaccagctggagatggtgaccgagctgctgggaggagacatggtgaaccagagtttcatctgcgacccggacgacgagaccttcatcaaaaacatcatcatccaggactgtatgtggagcggcttctcggccgccgccaagctcgtctcagagaagctggcctcctaccaggctgcgcgcaaagacagcggcagcccgaaccccgcccgcggccacagcgtctgctccacctccagcttgtacctgcaggatctgagcgccgccgcctcagagtgcatcgacccctcggtggtcttcccctaccctctcaacgacagcagctcgcccaagtcctgcgcctcgcaagactccagcgccttctctccgtcctcggattctctgctctcctcgacggagtcctccccgcagggcagccccgagcccctggtgctccatgaggagacaccgcccaccaccagcagcgactctgaggaggaacaagaagatgaggaagaaatcgatgttgtttctgtggaaaagaggcaggctcctggcaaaaggtcagagtctggatcaccttctgctggaggccacagcaaacctcctcacagcccactggtcctcaagaggtgccacgtctccacacatcagcacaactacgcagcgcctccctccactcggaaggactatcctgctgccaagagggtcaagttggacagtgtcagagtcctgagacagatcagcaacaaccgaaaatgcaccagccccaggtcctcggacaccgaggagaatgtcaagaggcgaacacacaacgtcttggagcgccagaggaggaacgagctaaaacggagcttttttgccctgcgtgaccagatcccggagttggaaaacaatgaaaaggcccccaaggtagttatccttaaaaaagccacagcatacatcctgtccgtccaagcagaggagcaaaagctcatttctgaagaggacttgttgcggaaacgacgagaacagttgaaacacaaacttgaacagctacggaactcttgtgcgtaaggaaaagtaaggaaaacgattccttctaacagaaatgtcctgagcaatcacctatgaacttgtttcaaatgcatgatcaaatgcaacctcacaaccttggctgagtcttgagactgaaagatttagccataatgtaaactgcctcaaattggactttgggcataaaagaactttttatgcttaccatcttttttttttctttaacagatttgtatttaagaattgtttttaaaaaattttaagatttacacaatgtttctctgtaaatattgccattaaatgtaaataactttaataaaaacgtttatagcagttacacagaatttcaatcctagtatatagtacctagtattataggtactataaaccctaattttttttatttaagtacattttgctttttaaagttgattt

SEQ ID NO: 384 - DNA, 5406 bp, Homo sapiens
  ref <308>: DATABASE ACCESSION NUMBER: K02403
  ref <309>: DATABASE ENTRY DATE: 2001-06-18
gaccagatcagcccccagagcagcctcatggctggaggatccaagagaggttagatccgtctgtctgtctgctaccttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtctccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagcccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacgggacagcagcacctggctcacagcctttgtgttgaaggtcctgagtttggcccaggagcaggtaggaggctcgcctgagaaactgcaggagacatctaactggcttctgtcccagcagcaggctgacggctcgttccaggacccctgtccagtgttagacaggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaaactcatttttgggggagaaagcaagtgctgggctcctgggtgcccacgcagctgccatcacggcctatgccctgtcactgaccaaggcgcctgtggacctgctcggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggcttcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtgagggctgccctcccacctccgctgggaggaacctgaacctgggaaccatgaagctggaagcactgctgtgtccgctttcatgaacacagcctgggaccagggcatattaaaggcttttggcagcaaagtgtcagtgttggc

SEQ ID NO: 385 - DNA, 649 bp, Homo sapiens
  ref <308>: DATABASE ACCESSION NUMBER: L05096
  ref <309>: DATABASE ENTRY DATE: 2001-06-18
ggcgaggcgtctcggagtctcagagacaccaaggcccctgcgacaaggtggctgcagctaggccgggggcgtcaggacgacggagcgggttcgggtcggtgacacgcagacctgagggagctgggcccgccttttccgcccgcgccccaggcccttgcagatcgagatttgcgtcctagagtgggaaaaaagcagaggccagggcgccgattttatttggagagaagcaagcatctttgcctctttggagtaggaaattcagacttgaaaaagtggtgtgtggttgactctgtttctcgccatgtcttctcacaagactttcaccattaagcgattcctggccaagaaacaaaagcaaaatcgtcccatcccccagtggattcagatgaaacctggtagtaaaatcaggtacaactccaaaaggaggcattggagaagaaccaagctgggtctataaggaattgcacatgagatggcacacatatttatgctgtatcaagttcacgatcatcttacgatatcaagctgaaaatgtcaccactacctggacagttgcacatgttttactgggaatatttttttctgtttttctgtatgctctgtgctagtagggtggattcagtaataaatatgtgaaagcttttgtttc

SEQ ID NO: 386 - DNA, 3202 bp, Homo sapiens
  ref <308>: DATABASE ACCESSION NUMBER: L10333
  ref <309>: DATABASE ENTRY DATE: 2001-06-18
ctgagacaccgcagcttccctgagcgccgagtccctccggggacagcagcagggagcgcccgcgcagccaccgagcctctgcccagccaagccgccgtcgccgcgccgggggaccgccagccatggccgcgccgggggatccgcaggacgagctgctgccgctggccggccccgggtcccagtggctcaggcaccgaggggagggggagaacgaagcggtgacgccgaaaggggccacgccggcgccgcaggctggggagcccagcccggggttgggcgccagggcccgggaagcggcgtcgcgggaagccggctcgggccccgcccggcagtcgcccgttgccatggaaactgcatccacaggtgtggcaggtgtttccagtgccatggaccacaccttctcaacaacatcaaaagatggggaaggatcgtgttacacatctctcatttctgacatctgctatccacctcaggaggattctacatattttactggaattcttcagaaggaaaatggccacgtcaccatttcagagagccctgaggagctgggtacacccggcccctccttaccagatgtgcctgggatagagtctcgtggcttatttagttctgattctggaatagagatgactcctgcagagtccacggaagtgaacaagatcttagcagaccctctggaccagatgaaagcagaggcctataaatacattgacataaccagacccgaggaggtgaagcaccaagaacaacatcaccccgagctggaagataaagacttggactttaagaataaagacactgacatctcaattaaacctgaaggagtccgtgaacctgacaaaccagctcctgtggagggaaaaatcatcaaggaccatttattggaagaatccacatttgctccatacatagatgatctctctgaagaacagcgcagggctcctcagatcaccacccctgtcaaaatcacactgacggaaatagaaccttctgttgaaaccactacccaagagaagacccctgagaagcaagatatatgtctaaagccaagtcctgacacagtccccactgtcactgtctcggagcctgaagacgacagcccaggatctatcacccctccatcttctggaacagaaccatctgctgcagaatcccaggggaaaggcagcatctccgaggatgagctgatcaccgccatcaaagaagcaaagggattatcgtatgaaaccgccgagaacccacggccggtgggccagctggccgacaggcccgaggtcaaggccaggtccggaccgccaaccatccccagccccctggaccacgaggccagcagcgcggagtcgggggactcagagatcgagctggtgtccgaggaccccatggccgcggaggacgcgctgccctcaggctatgtgagctttggccacgtgggcggcccgccgccctcgcccgcctcgccatccatccagtacagcatcctgagggaggagcgcgaggccgagctggacagcgagctcatcatcgagtcgtgcgacgcctcctcggcctcggaggagagccccaagcgggagcaggactcacccccgatgaagcccagcgccctggatgccatccgggaggagactggcgtccgggccgaggagcgtgcgccaagccggcggggcctggccgagccgggttccttcctcgactacccctcaactgagccccagcctggccccgagctgccccctggagacggagccctggagcctgagacgcccatgttgccacggaagcctgaagaagactcgagttccaaccaaagtcctgcggccacaaagggccctgggcctctaggtcctggcgccccgcccccactgctgtttctcaataagcaaaaagctattgacctgttgtattggcgggacatcaagcagacgggcatcgtgtttgggagtttcctgctgctgctcttctccctgacccagttcagcgtggtgagcgtcgtggcctacctggccctggccgcactctcagccaccatcagtttccgcatctacaagtctgttttacaagcagtgcagaaaaccgacgaaggccaccctttcaaggcctacttggagcttgagatcaccctttctcaggagcagattcagaagtacacggactgcctgcagttctacgtgaacagcacacttaaggaactgaggaggctcttccttgtccaggacctggtggattccttaaaatttgcagtcctgatgtggctcctgacctacgttggcgctctcttcaatggcctgaccctgctgctcatggctgtggtttcaatgtttactctacctgtagtgtatgttaagcaccaggcacagattgaccaatatctgggacttgtgaggactcacataaatgctgttgtggcaaagattcaggctaaaatcccaggcgctaagaggcacgctgagtaaactgatttcccaccggggactggacacaaacaggaatgtctggagtggtaacagctctcttcttactcattactgcaaattgattgtctttcccccctccctccagtaccataatcttagagacaaaccttaaaacagctgtttttaggctgttccttgtactcttaggatatttgagtcacttgtgtcaaccactaaagtatagagaaaagtgtattagatgtggtttttaattttgtgttgctaaaaaaagtgcatgatggtgagagcccaagttatctttccctcttcggtgttcttcttctcttctctgcaatgcttctgtagcttctaatgttccccgtggctaggcctttcctgccgagtgctctgatgcaatagtggaaatcgcttatatgtccttgggttgctggttggattaatctttaataacaatatatagaattgtagactgatgttttagcatttttccaacacacacaacgtaaaaataaaagcagtcgaccgcacttatggtaatcagttttgtataacttaaaataattaaataaatgaataaatccaaaacaaacatgcagtacttttgttgtatgggattggtgggctgatttacatgtatggttactaaaaagtaccagcatgttaactttattacaatttgtattactttctctgtagttcctaatggattcaattacggactctggatatttgcacttatgtacttgatactgaatgcataaataaat

SEQ ID NO: 387 - DNA, 319 bp, Homo sapiens
  ref <308>: DATABASE ACCESSION NUMBER: L11645
  ref <309>: DATABASE ENTRY DATE: 2001-06-18
ttctccggcaggtgggcattaactaccagccccccacggtggtccctgggggagacctggccaaggtgcagcgggctgtgtgcatgctgagcaacaccacggccatcgcggaggcctgggctcgcctggaccataagttcgatctcatgtatgccaagcgggcctttgtgcactggtacgtgggagaaggcatggaggagggggagttctctgaggcccgcgaggacctggcagctctggagaaggattatgaagaggtgggcgtggattccgtggaagccgaggctgaagaaggtgaagaatactgaggggagggtgt

SEQ ID NO: 388 - DNA, 4011 bp, Homo sapiens
  ref <308>: DATABASE ACCESSION NUMBER: L21934
  ref <309>: DATABASE ENTRY DATE: 2001-06-18
gggtagagacggggtttcaccgtgttagccaggatggtctggatctcctgacctcgtgatccacccacctcggcctcctaaagtgctgggattacagacatgagccaccgcgcccagccctattcatcccttttcaaaagtcagaccctaggaagctggagggaggtggggcatggttttacagtgaatttctgatttcactcagggtgataaatcagactcttggggaagcgggtggtggctctggacagcagcaggaatggggatccagttagcaacaaatccatggacctatgacaggctgaaagccaccccttctccatctttgggaggttgccaatgtctgatttaacactatccaatgaatgatcattgaaagtaaaaaataactatcaactagcagaaaatataaatggtaagcattagcacatatttcacatgtttatatttggctctcagattgacctataaaacaaagtctgggaaattctatatgatcctgaaaaaatgatacgctggtctggatggtagaataagttggagaaatgtttaagccaaaatgcagtcttaccaatgactttttattttattttattaattttcaggatttttggtatacaggtggtttttggttacatggaaaagttctttactggtgatttctgagattttagttcaccccttatcctgagcagtgtacactgttcccaatatgtagccttttatccctcaccccctctaagttcaagaagactatggtcctgcagaaagctttatatgtaattaacatatctttatctttatctttataggcagtagactcatcttttgaaacagattccattaagagtgaatgtgtaccctccctctagcctttattattactgtttttgctattacatgtgttagtgtatgtgaatttaatgcttaaaaatgtatcccattggctactatggcaaaaggttgactcataagagtttagcacgggttaagatctgaaagttttctcccagcctcttatcactggcgcagacttcacaattcatggaagccaccagtgagatgacattgcctcaggcagttactatttttatattctataactcgaggagctcagggtttcggaaatcattaaactttttttgtccttttaaagttggagacagcaattgtagacagccttccagtgggttatctttttgtgtctccttacctgtggagaagcctattagctgggatatgtagttaaatagctatatttatatatatccagggcaccccgaattcgggagagcttcccggagtcgaccttcctgctggctgctctgtgaccgcttcccggctctgccctcttggccgaagtgcccgctgccgggcgcgggcctcagacaatacaatggtgggtgaagagaagatgtctctaagaaaccggctgtcaaagtccagggaaaatcctgaggaagatgaagaccagagaaaccctgcaaaggagtccctagagacacctagtaatggtcgaattgacataaaacagttgatagcaaagaagataaagttgacagcagaggcagaggaattgaagccattttttatgaaggaagttggcagtcactttgatgattttgtgaccaatctcattgaaaagtcagcatcattagataatggtgggtgcgctctcacaaccttttctgttcttgaaggagagaaaaacaaccatagagcgaaggatttgagagcacctccagaacaaggaaagatttttattgcaaggcgctctctcttagatgaactgcttgaagtggaccacatcagaacaatatatcacatgtttattgccctcctcattctctttatcctcagcacacttgtagtagattacattgatgaaggaaggctggtgcttgagttcagcctcctgtcttatgcttttggcaaatttcctaccgttgtttggacctggtggatcatgttcctgtctacattttcagttccctattttctgtttcaacattgggccactggctatagcaagagttctcatccgctgatccgttctctcttccatggctttcttttcatgatcttccagattggagttctaggttttggaccaacatatgttgtgttagcatatacactgccaccagcttcccggttcatcattatattcgagcagattcgttttgtaatgaaggcccactcatttgtcagagagaacgtgcctcgggtactaaattcagctaaggagaaatcaagcactgttccaatacctacagtcaaccagtatttgtacttcttatttgctcctacccttatctaccgtgacagctatcccaggaatcccactgtaagatggggttatgtcgctatgaagtttgcacaggtctttggttgctttttctatgtgtactacatctttgaaaggctttgtgcccccttgtttcggaatatcaaacaggagcccttcagcgctcgtgttctggtcctatgtgtatttaactccatcttgccaggtgtgctgattctcttccttactttttttgcctttttgcactgctggctcaatgcctttgctgagatgttacgctttggtgacaggatgttctataaggattggtggaactccacgtcatactccaactattatagaacctggaatgtggtggtccatgactggctatattactatgcttacaaggactttctctggtttttctccaagagattcaaatctgctgccatgttagctgtctttgctgtatctgctgtagtacacgaatatgccttggctgtttgcttgagctttttctatcccgtgctcttcgtgctcttcatgttctttggaatggctttcaacttcattgtcaatgatagtcggaaaaagccgatttggaatgttctgatgtggacttctcttttcttgggcaatggagtcttactctgcttttattctcaagaatggtatgcacgtcggcactgtcctctgaaaaatcccacatttttggattatgtccggccacgttcctggacttgtcgttacgtgttttagaagcttggactttgtttcctccttgtcactgaagattgggtagctccctgatttggagccagctgtttccagttgttactgaagttatctgtgttatttggaccactccaggctttacagatgactcactccattcctaggtcacttgaagccaaactgttggaagttcactggagtcttgtacacttaagcagagcagaactttttttgtggggctgggtggggggagaagaccgactaacagctgaagtaatgacagattgttgctgggtcatatcagctttatcccttggtaattatatctgttttgtttcttgactctgtccaatcagagaataaacatcatagtttcttggccactgaattagccaaaacacttaggaagaaatcacttaaatacctctggcttagaaattttttcatgcacactgttggaatgtatgctaattgaacatgcaattggggaagaaaaaatgtagaatgatttttgctatttctagtagaaagaaaatgtctgttttccaaagataatgttatacatcctattttgtaatttttttgaaaaaagttcaatgttcagttttccttagtttttaccttgttttctctataggtcatgatttctgtgaagcaaaaagatgccttttaccatgaattcttgagtttacatcaataatattgtatattaaggggatcagaagtaggaaggaaaaaataagagatagcagaggaaaaagaaaaacatttcctcttataacttctgaagtaatttgtaaaaaagatttgtagagtcaatcatgtgtttaaattattttatcacaaacttaacatggaagatattcctttttaactttgtggtaacttctttgaagttatttagaaatatcctttggaacaattattttattgtctaataaatattgacttctcttgaattattttgcagactagtgagtctgtac

SEQ ID NO: 389 - DNA, 1374 bp, Homo sapiens
  ref <308>: DATABASE ACCESSION NUMBER: L22005
  ref <309>: DATABASE ENTRY DATE: 2001-06-18
attgcggcggcgccagagctgctggagcgctcggggtccccgggcggcggcggcggcgcagaggaggaggcaggcggcggccccggtggctcccccccggacggtgcgcggcccggcccgtctcgcgaactcgcggtggtcgcgcggccccgcgctgctccgaccccgggcccctccgccgccgccatggctcggccgctagtgcccagctcgcagaaggcgctgctgctggagctcaaggggctgcaggaagagccggtcgagggattccgcgtgacactggtggacgagggcgatctatacaactgggaggtggccattttcgggccccccaacacctactacgagggcggctacttcaaggcgcgcctcaagttccccatcgactacccatactctccaccagcctttcggttcctgaccaagatgtggcaccctaacatctacgagacgggggacgtgtgtatctccatcctccacccgccggtggacgacccccagagcggggagctgccctcagagaggtggaaccccacgcagaacgtcaggaccattctcctgagtgtgatctccctcctgaacgagcccaacaccttctcgcccgcaaacgtggacgcctccgtgatgtacaggaagtggaaagagagcaaggggaaggatcgggagtacacagacatcatccggaagcaggtcctggggaccaaggtggacgcggagcgtgacggcgtgaaggtgcccaccacgctggccgagtactgcgtgaagaccaaggcgccggcgcccgacgagggctcagacctcttctacgacgactactacgaggacggcgaggtggaggaggaggccgacagctgcttcggggacgatgaggatgactctggcacggaggagtcctgacaccaccagaataaacttgccgagtttacctcactagggccggacccgtggctccttagacgacagactacctcacggaggttttgtgctggtccccgtctcctctggttgtttcgttttggctttttctccctccccatgtctgttctgggttttcacgtgcttcagagaagaggggctgccccaccgccactcacgtcactcggggctcggtggacgggcccagggtgggagcggccggcccacctgtcccctcgggaggggagctgagcccgacttctaccggggtcccccagcttccggactggccgcaccccggaggagccacgggggcgctgctgggaacgtgggcggggggccgtttcctgacactaccagcctgggaggcccaggtgtagcggtccgaggggcccggtcctgcctgtcagctccaggtcctggagccacgtccagcactgagtggacggattcaccaat

SEQ ID NO: 390 - DNA, 3672 bp, Homo sapiens
  ref <308>: DATABASE ACCESSION NUMBER: L27560
  ref <309>: DATABASE ENTRY DATE: 2001-06-18
acatgtgcatatttcattccccaggcagacattttttagaaatcaatacatgccccaatattggaaagacttgttcttccacggtgactacagtacatgctgaagcgtgccgtttcagccctcatttaattcaatttgtaagtagcgcacgagcctctgtgggggaggataggctgaaaaaaaaaagtgggctcgtatttatctacaggactccatatagtcatatataggcatataaatctatgctttttctttgtttttttctttcttcctttctttcaaaggtttgcattaacttttcaaagtagttcctataggggcattgaggagcttcctcattctgggaaaactgagaaaacccatattctcctaatacaacccgtaatagcatttttgcctgcctcgaggcagagtttcccgtgagcaataaactcagcttttttgtggggcacagtactggatttgacagtgattccccacgtgtgttcatctgcacccaccgagccaggcagaggccagccctccgtggtgcacacagcacgcgcctcagtccatcccattttagtctttaaaccctcaggaagtcacagtctccggacaccacaccacattgagcccaacaggtccacgatggatccacctagtcccaccccagcctttttctttcatctgaacagaatgtgcatttttggaagcctccctcactctccatgctggcagagcaggagggagactgaagtaagagatggcagagggagatggtggcaaaaaggtttagatgcaggagaacagtaagatggatggttccggccagagtcgatgtggggaggaacagagggctgaagggagagggggctgactgttccattctagctttggcacaaagcagcagaaagggggaaaagccaatagaaatttccttagcttccccaccatatgtattttcatggatttgagaggaaagagaggaaaatgggggaatgggttgcaaaatagaaatgagcttaatccaggccgcagagccagggaaggtgagtaaccttaggagggtgctagactttagaagccagataggaagaatcagtctaaactggccatgctttggaagggacaagactatgtgctccgctgcccaccttcagcctgcaatgagggactgaggcccacgagtctttccagctcttcctccattctggccagtccctgcatcctccctggggtggaggatggaaggaaagctgggacaagcagggaacgcatgattcagggatgctgtcactcggcagccagattccgaaactcccattctccaatgacttcctcaaccaatgggtggccttgtgactgttctttaaggctgaagatatccaggaaagggggcttggacactggccaaggagaccccttcgtgctgtggacacagctctcttcactctttgctcatggcatgacacagcggagaccgcctccaacaacgaatttggggctacgaagaggaatagcgaaaaagcaaatctgtttcaactgatgggaaccctatagctatagaacttgggggctatctcctatgcccctggacaggacagttggctggggacaggagaagtgctcaatcttcatgagacaaaggggcccgatcaaggcagccacaaggccttgacctgccgagtcagcatgccccatctctctcgacagctgtcccctaaacccaactcacgtttctgtatgtcttaggccagtatcccaaacctcttccacgtcactgttctttccacccattctccctttgcatcttgagcagttatccaactaggatctgccaagtggatactggggtgccactcccctgagaaaagactgagccaggaactacaagctccccccacattcctcccagcctggacctaattcttgagaggggctctctcttcacggactgtgtctggactttgagcaggcttctgccccttgcgttggctctttgctgccagccatcaggtgggggattagagcctggtgtaagtgcgccagactcttccggtttccaaagttcgtgcctgcgaacccaaacctgtgagtctcttctgcatgcaggagtttctcctgggcagctggtcactccccagagaagctgggccttcatggacacatggaactaagcctcccaaatgggagttctggctgagcccagggtggggagatcctgggaagggaggcactggaggaagacggcacctcttcccccatggcagggtgtgagggaggcaggtttggaatggtgcgagtatggcaatctaagcaggggtctggtctctttgactccaggctcgctttggccgactgtctgctcacccagagaccttggactccggactatccatggctccgaatctaagtgctgcccactcccatgctcacacccacagaaggtcttcccatcccctttagattcgtgcctcactccaccagtgaggaagatgcctctgtctttcccacgactgccaggagatagggaagcccagccaggactgaccctccttcctccagcctgccctgacccacctggcaaagcagggcacatggggaggaagagactggaacctttctttgacagccaggcctagacagacaggcctggggacactggcccatgaggggaggaaggcaggcgcacgaggtccagggaggcccttttctgatcatgccccttctctcccaccccatctccccaccaccacctctgtggcctccatggtacccccacagggctggcctcccctagagggtgggcctcaaccacctcgtcccgccacgcaccggttagtgagacagggctgccacgcaaccgccaagcccccctcaaggtgggacagtaccccggacccatccactcactcctgagaggctccggcccagaatgggaacctcagagaagagctctaaggagaagaaaccccatagcgtcagagaggatatgtctggcttccaagagaaaggaggctccgttttgcaaagtggaggagggacgagggacaggggtttcaccagccagcaacctgggccttgtactgtctgtgtttttaaaaccactaaagtgcaagaattacattgcactgtttctccactttttattttctcttaggcttttgtttctatttcaaacatactttcttggttttctaatggagtatatagtttagtcatttcacagactctggcctcctctcctgaaatccttttggatggggaaagggaaggtggggagggtccgaggggaaggggaccccagcttccctgtgcccgctcaccccactccaccagtccccggtcgccagccggagtctcctctctaccgccactgtcacaccgtagcccacatggatagcacagttgtcagacaagattccttcagattccgagttgctaccggttgttttcgttgttgttgttgttgtttttctttttctttttttttttgaagacagcaataaccacagtacatattactgtagttctctatagttttacatacattcataccataactctgttctctcctcttttttgttttcaactttaaaaacaaaaataaacgatgataatctttactggtgaaaaggatggaaaaataaatcaacaaatgcaaccagtttgtgagaaaaaaaaaaaaaa

SEQ ID NO: 391 - DNA, 1092 bp, Homo sapiens
  ref <308>: DATABASE ACCESSION NUMBER: L48692
  ref <309>: DATABASE ENTRY DATE: 2001-06-18
gaattcggcacgagtggaaacgcagagcgccggggcagaggagggctttacccaggtcacccgcaagggtggccgacgggcgaagaaacgacaggctgaacagctgtccgcagcaggagagggcggggatgcgggccgcatggacacagaggaggccaggccggcgaagaggcccgtcttcccacccctctgtggggacgggctcctgagtgggaaagaagaaacaaggaaaattccagtcccagctaacagatacacaccattgaaagaaaactggatgaagatatttactcctattgtggaacatttgggacttcagatacgctttaacttggaaatcaaggaatgtgaaatcaggacttgtaagaaccaaggatgttagtgctctgacaaaagcagtgatttgtgaaagcttttattctcggctttcaggtggaggatgcacttgccctcatcaggttggatgacctcttcctagagtcttttgaaattacagatgttaaacccctaaagggagaccatctatccagggcaataggaagaatcgctggcaaaggaggaaaaaccaaattcaccatagagaatgtgacacggacaaggatagttttggctgatgtgaaagttcacatccttggctccttccaaaatatcaagatggcaagaactgccatttgcaacctaatcttgggaaatcctccttccaaggtttatggcaatattcgagctgtggctagcagatcagcagatcgattctgatttcaagtcagagactttttatcttgcctttggactctggtgaaaaatactttacagtggtcggtcacaagaaaccatctgaacaatttcagtcatttgaagctccgtcccttcttccattctcagccagaagcataaacagaaaagaaagatttagaggattcacactcaacaggttttaggatatttatatcaaaaattgattgttatcttacacattaggtataatttatcatttatctgaaatcacatgtagcagattgcatagtcttgtaatcctctcagagggaaacttcttgtctaaacagctctatatggatttatcctccatattcc

SEQ ID NO: 392 - DNA, 178 bp, Homo sapiens
  ref <308>: DATABASE ACCESSION NUMBER: M12758
  ref <309>: DATABASE ENTRY DATE: 2001-06-18
ctgtggtggtaccttctggagaggagcagagatacacctgccatgtgcagcatgagggtctgcccaagcccctcaccctgagatgggatagaaaaggagggagctactctcaggctgcaagcagtgacagtgcccagggctctgatgtgtctctcacagcttgtaaagtgtgagacag

SEQ ID NO: 393 - DNA, 1023 bp, Homo sapiens
  ref <308>: DATABASE ACCESSION NUMBER: M15178
  ref <309>: DATABASE ENTRY DATE: 2001-06-18
cggtgctgagctccccactggctttggctggggacacccaaccacgtttcttggagcaggctaagtgtgagtgtcatttcctcaatgggacggagcgagtgtggaacctgatcagatacatctataaccaagaggagtacgcgcgctacaacagtgacctgggggagtaccaggcggtgacggagctggggcggcctgacgctgagtactggaacagccagaaggacctcctggagcggaggcgggccgaggtggacacctactgcagatacaactacggggttgtggagagcttcacagtgcagcggcgagtccaacctaaggtgactgtgtatccttcaaagacccagcccctgcagcaccacaacctcctggtctgctctgtgaatggtttctatccaggcagcattgaagtcaggtggttccggaacggccaggaagagaaggctggggtggtgtccacaggcctgatccagaatggagactggaccttccagaccctggtgatgctggaaacagttcctcggagtggagaggtttacacctgccaagtggagcatccaagcatgatgagccctctcacggtgcaatggagtgcacggtctgaatctgcacagagcaagatgctgagtggagtcgggggctttgtgctgggcctgctcttccttgggacagggctgttcatctacttcaggaatcagaaaggacactctggacttcagccaacaggactcttgagctgaagtgcagatgaccacattcaaggaagaaccttctgccccagctttgcaagatgaaaagctttcccacttggctcttattcttccacaagagctttgtcaggaccaggttgttactggttcagcaactctgcagaaaatgtcctcccttgtggcttccttagctcctgttcttggcctgaagcctcacagctttgatggcagtgcctcatcttcaacttttgtgcttccctttacctaaactgtcctgcctcccgtgcatctgtactccccttgtgccaca

SEQ ID NO: 394 - DNA, 640 bp, Homo sapiens
  ref <308>: DATABASE ACCESSION NUMBER: M21551
  ref <309>: DATABASE ENTRY DATE: 2001-06-18
cgcgcgcccgaacgaagccgcggcccgggcacagccatggcccggcgggcggggggcgctcggatgttcggcagcctcctgctcttcgccctgctcgctgccggcgtcgccccgctcagctgggatctcccggagccccgcagccgagccagcaagatccgagtgcactcgcgaggcaacctctgggccaccggtcacttcatgggcaagaagagtctggagccttccagcccatcccattggggacagctccccacacctcccctgagggaccagcgactgcagctgagtcatgatctgctcggaatcctcctgctaaagaaggctctgggcgtgagcctcagccgccccgcaccccaaatccagtacaggaggctgctggtacaaatactgcagaaatgacaccaataataggggcagacacaacagcgtggcttagattgtgcccacccagggaaggtgctgaatgggaccctgttgatggccccatctggatgtaaatcctgagctcaaatctctgttactccattactgtgatttctggctgggtcaccagaaatatcgctgatgcagacacagattatgttcctgctgtatttcctgcttccctgttgaattggtgaataaaaccttgctcttt

SEQ ID NO: 395 - DNA, 1612 bp, Homo sapiens
  ref <308>: DATABASE ACCESSION NUMBER: M24895
  ref <309>: DATABASE ENTRY DATE: 2001-06-18
gaatataaatagtttctggaaaggacactgacaacttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctcccaagggatttggaggggttcaggtctctccaccaaatgaaaatgttgcaattcacaaccctttcagaccttggtgggaaagataccaaccagttagctataaattatgcacaagatctggaaatgaagatgaatttagaaacatggtgactagatgtaacaatgttggggttcgtatttatgtggatgctgtaattaatcatatgtctggtaatgctgtgagtgcaggaacaagcagtacctgtggaagttacttcaaccctggaagtagggactttccagcagtcccatattctggatgggattttaatgatggtaaatgtaaaactggaagtggagatatcgagaactacaatgatgctactcaggtcagagattgtcgtctggttggtcttcttgatcttgcactggagaaagattatgtgcgttccaagattgccgaatatatgaatcatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggaaatggccgggtgacagaattcaagtatggtgcaaaactcggcacagttattcgcaagtggaatggagagaagatgtcttacctaaagaactggggagaaggttggggtttcatgccttctgacagagcacttgtctttgtggataaccatgacaatcaacgaggacatggggctggaggagcctctattcttaccttctgggatgctaggctgtataaaatggcagttggatttatgcttgctcatccttatggttttacacgagtaatgtcaagctaccgttggccaagacagtttcaaaatggaaacgatgttaatgattgggttgggccaccaaataataatggagtaattaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaattgcacaggcattaaaatctacgtttctgacgatggcaaagctcatttttctattagtaactctgctgaggatccatttattgcaattcatgctgaatctaaattataaaatttaaaattaaatgcatatcctcaaaac

SEQ ID NO: 396 - DNA, 1639 bp, Homo sapiens
  ref <308>: DATABASE ACCESSION NUMBER: M26383
  ref <309>: DATABASE ENTRY DATE: 2001-06-18
agcagagcacacaagcttctaggacaagagccaggaagaaaccaccggaaggaaccatctcactgtgtgtaaacatgacttccaagctggccgtggctctcttggcagccttcctgatttctgcagctctgtgtgaaggtgcagttttgccaaggagtgctaaagaacttagatgtcagtgcataaagacatactccaaacctttccaccccaaatttatcaaagaactgagagtgattgagagtggaccacactgcgccaacacagaaattattgtaaagctttctgatggaagagagctctgtctggaccccaaggaaaactgggtgcagagggttgtggagaagtttttgaagagggctgagaattcataaaaaaattcattctctgtggtatccaagaatcagtgaagatgccagtgaaacttcaagcaaatctacttcaacacttcatgtattgtgtgggtctgttgtagggttgccagatgcaatacaagattcctggttaaatttgaatttcagtaaacaatgaatagtttttcattgtaccatgaaatatccagaacatacttatatgtaaagtattatttatttgaatctacaaaaaacaacaaataatttttaaatataaggattttcctagatattgcacgggagaatatacaaatagcaaaattgagccaagggccaagagaatatccgaactttaatttcaggaattgaatgggtttgctagaatgtgatatttgaagcatcacataaaaatgatgggacaataaattttgccataaagtcaaatttagctggaaatcctggatttttttctgttaaatctggcaaccctagtctgctagccaggatccacaagtccttgttccactgtgccttggtttctcctttatttctaagtggaaaaagtattagccaccatcttacctcacagtgatgttgtgaggacatgtggaagcactttaagttttttcatcataacataaattattttcaagtgtaacttattaacctatttattatttatgtatttatttaagcatcaaatatttgtgcaagaatttggaaaaatagaagatgaatcattgattgaatagttataaagatgttatagtaaatttattttattttagatattaaatgatgttttattagataaatttcaatcagggtttttagattaaacaaagaaacaattgggtacccagttaaattttcatttcagataaacaacaaataattttttagtataagtacattattgtttatctgaaagttttaattgaactaacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaatataaaagtaaatatgaaacatttaaaatataatttgttgtcaaagtaaaaaaaaaaaaaaa

SEQ ID NO: 397 - DNA, 847 bp, Homo sapiens
  ref <308>: DATABASE ACCESSION NUMBER: M27749
  ref <309>: DATABASE ENTRY DATE: 2001-06-18
ggccacatggactggggtgcaatgggacagctgctgccagcgagagggaccagggcaccactctctagggagcccacactgcaagtcaggccacaaggacctctgaccctgagggccgatgaggccagggacaggccaggggggccttgaggcccctggtgagccaggccccaacctcaggcagcgctggcccctgctgctgctgggtctggccgtggtaacccatggcctgctgcgcccaacagctgcatcgcagagcagggccctgggccctggagcccctggaggaagcagccggtccagcctgaggagccggtggggcaggttcctgctccagcgcggctcctggactggccccaggtgctggccccgggggtttcaatccaagcataactcagtgacgcatgtgtttggcagcgggacccagctcaccgttttaagtcagcccaaggccaccccctcggtcactctgttcccgccgtcctctgaggagctccaagccaacaaggctacgctggtgtgtctcatgaatgacttttatccgggaatcttgacggtgacctggaaggcagatggtacccccatcacccagggcgtggagatgaccacgccctccaaacagagcaacaacaagtacgcggccagcagctacctgagcctgacgcccgagcagtggaggtcccgcagaagctacagctgccaggtcatgcacgaagggagcaccgtggagaagacggtggcccctgcagaatgttcataggttcccagccccgaccccacccaaaggcctggagctgcaggatcccaggggaagggtctctctctgcatcccaagccatccagccct

SEQ ID NO: 398 - DNA, 2096 bp, Homo sapiens
  ref <308>: DATABASE ACCESSION NUMBER: M28170
  ref <309>: DATABASE ENTRY DATE: 2001-06-18
gaattcctctgaccaccatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggcatcctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtgtcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgactgaccccaccaggagattcttcaaagtgacgcctcccccaggaagcgggccccagaaccagtacgggaacgtgctgtctctccccacacccacctcaggcctcggacgcgcccagcgttgggccgcaggcctggggggcactgccccgtcttatggaaacccgagcagcgacgtccaggcggatggagccttggggtcccggagcccgccgggagtgggcccagaagaagaggaaggggagggctatgaggaacctgacagtgaggaggactccgagttctatgagaacgactccaaccttgggcaggaccagctctcccaggatggcagcggctacgagaaccctgaggatgagcccctgggtcctgaggatgaagactccttctccaacgctgagtcttatgagaacgaggatgaagagctgacccagccggtcgccaggacaatggacttcctgagccctcatgggtcagcctgggaccccagccgggaagcaacctccctggggtcccagtcctatgaggatatgagaggaatcctgtatgcagccccccagctccactccattcggggccagcctggacccaatcatgaggaagatgcagactcttatgagaacatggataatcccgatgggccagacccagcctggggaggagggggccgcatgggcacctggagcaccaggtgatcctcaggtggccagcctggatctcctcaagtccccaagattcacacctgactctgaaatctgaagacctcgagcagatgatgccaacctctggagcaatgttgcttaggatgtgtgcatgtgtgtaagtgtgtgtgtgtgtgtgtgtgtgtgtgtgtgtgtatacatgccagtgacacttccagtcccctttgtattccttaaataaactcaatgagctcttccaatccaaaaatgttaaaattagccaggcatagttgtgtgtgcctacagtgctacaggaggctgaggcaagaggattgcttgagttaaggaaggaagtcaaggctgcagtgagctatggtcatgccactgcactccagcctgggcaacagcaagaccctgtgtccaaaaaaaaaaaaggaattc

SEQ ID NO: 399 - DNA, 2907 bp, Homo sapiens
  ref <308>: DATABASE ACCESSION NUMBER: M29873
  ref <309>: DATABASE ENTRY DATE: 2001-06-18
ggaaccatggagctcagcgtcctcctcttccttgcactcctcacaggcctcttgctactcctggttcagcgtcaccctaactcccatggcaccctcccaccagggccccgccctctgccccttttggggaaccttctgcagatggacagaagaggcctactcaaatcctttctgaggttccgagagaaatatggggacgtcttcacggtacacctgggaccgaggcccgtggtcatgctgtgtggagtagaggccatacgggaggccctggtggacaacgctgaggccttctctggccggggaaaaatcgtcatcatggacccagtctaccagggatatggcatgctctttgccaatggaaaccgctggaaggtgcttcggcgattctctgtgaccaccatgagggacttcgggatgggaaagcggagtgtggaggagcggattcaggacgaggctcagtgtctgatagaggaacttcggaaatccaagggagccctcgtggaccccaccttcctcttccattccattaccgccaacatcatctgctccatcatctttggaaaacgcttccactaccaagatcaagagttcctgaagacgctgaacttgttctgccagagtttcttactcatcagctctatatccagccagctgtttgagctcttctctggcttcttgaaatactttcctggggcacacaggcaagtttacaaaaacctacaggaaatcaatgcttacattggccacagtgtggagaagcaccgtgaaaccctggaccccagcgcccccagggacctcatcgacacctacctgctccacatggaaaaagagaaatccaacccacacagtgaattcagccaccagaacctcatcatcaacacgctctcgctcttctttgctggcactgagaccaccagcaccactctccgctacggcttcctgctcatgctcaaataccctcatgtcgcagagagagtctacaaggagattgaacaggtggttggcccacatcgccctccagcgcttgatgaccgagccaaaatgccatacacagaggcagtcatccgtgagattcagagatttgctgaccttctccccatgggtgtgccccacattgtcacccaacacaccagcttctgagggtacaccatccccaaggacacggaagtatttctcatcctgagcactgctctccgtgacccacactactttgaaaaaccagacgccttcaatcctgaccactttctggatgccaatggggcactgaaaaagaatgaagcttttatccccttctccttagggaagcggatttgtcttggtgaaggcattgcccgtgcggaattgttcctcttcttcaccaccatcctccagaacttctccgtggccagccccgtggctcctgaagacatcgatctgacaccccaggagtgtggtgtgggcaaaatacccccaacataccagatctgcttcctgccccgctgaaggggctgagggaagggggtcaaaggattccagggtcattcagtgtccccacctctgtagataatggctctgactccctgcaacttcctgcctctgagagacctgctgcaagccagcttccttcccttccatggcaccagttgtctgaggtcgcagtgcaaatgagtggaggagtgagattattgaaaattataatatacaaaattatatatatatattttgagacagagtctcactcagttgcccaggctggagtgcagtggcgtgatctcggctcactgcaacctccacccccggggttcaagaaattctcctgcctcagcctccctagtagctgggattacaggtgtgtgctaccatgcctggctaatttttgtatttttagtagagatggggtttcaccgtgttggccaggctgatctcaaactcctgaactcaagtgattcacccaccttagcctcccaaagtgctgggattacaggtgtgagtcaccatgcccggccatgtatatatataattttaaaaattaagatgaaattcacataaaataaaattagccattttaaagtgtacaatttagtggtgtgtggttcattcacaaagctgtacaaccaccaccatctagttccaaacattttctttttttctgagacggagtctcactctgtcacccaggttcgagttcagtggtcttgaactcctgatgtcaggtgattctcctagttccaaatgttttcattatctctcccccaacaaaacccatacctatcaagctgtcactccccataccccattctctttttcatctcagcccctgtcaatctggtttttgtccttatggacttaccaattctgaatatttcctataaacagaatcacacaatatttgattttttttttaaaactaagccttgctctgtctcccaggctggagtgctgtggcgtgattttggttcactgcaacctccgccttccaagttcaagagattctcctgcctcagcttccaagtagctgggattacaggcatgtggtaccacgcctggctaattttcttgtatttttagtagggacatgttggccaggctggttgtgagctcctggcctcaggtgatccacacgcctcagtgtcccagagtgctgatattacaggcgtaatatgtgatcttttgtgtctggttcctttcacgttgaacgctatttttgaggttcgtgcctgttgtagaccacagtcacacactgctgtagtcttcccccatcctcattcccagctgcctcctcctactgtttccctctatcaaaaagcctccttggcgcaggttccctgagctgtgggattctgcactggtgctttggattccctgatatgttccttcaaatccactgagaattaaataaacatcgctaaagcctgacctccccacgtc

SEQ ID NO: 400 - DNA, 3045 bp, Homo sapiens
  ref <308>: DATABASE ACCESSION NUMBER: M29874
  ref <309>: DATABASE ENTRY DATE: 2001-06-18
cagaccatggaactcagcgtcctcctcttccttgcactcctcacaggactcttgctactcctggttcagcgccaccctaacacccatgaccgcctcccaccagggccccgccctctgccccttttgggaaaccttctgcagatggatagaagaggcctactcaaatcctttctgaggttccgagagaaatatggggacgtcttcacggtacacctgggaccgaggcccgtggtcatgctgtgtggagtagaggccatacgggaggcccttgtggacaaggctgaggccttctctggccggggaaaaatcgccatggtcgacccattcttccggggatatggtgtgatctttgccaatggaaaccgctggaaggtgcttcggcgattctctgtgaccactatgagggacttcgggatgggaaagcggagtgtggaggagcggattcaggaggaggctcagtgtctgatagaggagcttcggaaatccaagggggccctcatggaccccaccttcctcttccagtccattaccgccaacatcatctgctccatcgtctttggaaaacgattccactaccaagatcaagagttcctgaagatgctgaacttgttctaccagactttttcactcatcagctctgtattcggccagctgtttgagctcttctctggcttcttgaaatactttcctggggcacacaggcaagtttacaaaaacctgcaggaaatcaatgcttacattggccacagtgtggagaagcaccgtgaaaccctggaccccagcgcccccaaggacctcatcgacacctacctgctccacatggaaaaagagaaatccaacgcacacagtgaattcagccaccagaacctcaacctcaacacgctctcgctcttctttgctggcactgagaccaccagcaccactctccgctacggcttcctgctcatgctcaaataccctcatgttgcagagagagtctacagggagattgaacaggtgattggcccacatcgccctccagagcttcatgaccgagccaaaatgccatacacagaggcagtcatctatgagattcagagattttccgaccttctccccatgggtgtgccccacattgtcacccaacacaccagcttccgagggtacatcatccccaaggacacagaagtatttctcatcctgagcactgctctccatgacccacactactttgaaaaaccagacgccttcaatcctgaccactttctggatgccaatggggcactgaaaaagactgaagcttttatccccttctccttagggaagcggatttgtcttggtgaaggcatcgcccgtgcggaattgttcctcttcttcaccaccatcctccagaacttctccatggccagccccgtggccccagaagacatcgatctgacaccccaggagtgtggtgtgggcaaaatacccccaacataccagatccgcttcctgccccgctgaaggggctgagggaagggggtcaaaggattccagggtcattcagtgtccccgcctctgtagacaatggctctgactccccgcaacttcctgcctctgagagacctgctacaagccagcttccttcccctccatggcaccagttgtctgaggtcacattgcaagtgagtgcaggagtgagattatcgaaaattataatatacaaaatcatatatatatatatgttcttgttttttgagacagagtctcacactgttgcccaggctggagtgcagtggcgtgatcttggctcactgcaacctccacccccggggatcaagcaactctcctgcctcagcctccctagaggctgggattacaggcatgcactaccacgcttggctaatttttgtatttttagtagagatggggtttcactgtgtaggccaggctggtctcgaactcctgaactcaagtgattcacccaccttagcctcccaaagtgctgggattacaggcgtgagtcaccgtgcccagccatgtatatatataattttaaaaattaagctgaaattcacataacataaaattagccgttttaaagtgtaaaatttagtggcgtgtggttcattcacaaagctgtacaaccaccaccatctagttccaaacattttctttttttctgagatggagtctcactctgtcacccaggttcgagttcagtggtgccatctctgtccactgcaacctccacatcctgggttcaagtgattctcctgcctcagcctctggaggagctggtatcacaggcgtcccccaccacgcctggctaaattttgtatttttaggtggtcttgaactcctgatgtcaggtgattctcctagctccaaatgttttcattatctctcccccaacaaaacccatacctatcaagctgtcactccccataccccattctctttttcatctcggcccctgtcaatctggtttttgtcactatggacttaccaattctgaatatttcccataaacagaatcatacaatatttgatttttttttttttttgaaactaagccttgctctgtctcccaggctggagtgctatggtgcaatttttgttcactgcaacctctgccttccaagatcaagagattctccagtctcagctcccaagtagctgggattacaggcatgtactaccatgcctggctaattttcttgtagttttagtagggacatgttggccaggctggtggtgagctcctggcctcaggtgatccacccacctcagtgttcctaagtgctgatattacaggcataatatgtgatcttttgtgtctggttgctttcatgttgaatgctatttttgaggttcgtgcctgttgtagaccacagtcacacactgctgtagtcttcccgagtcctcattcccagctgcctcttcctactgcttccgtctatcaaaaagcccccttggcccaggttccctgagctgtgggattctgcactggtgctttggattccctgatatgttccttcaaatctgctgagaattaaataaacatctctaaagcctgacctcccc

SEQ ID NO: 401 - DNA, 2527 bp, Homo sapiens
  ref <308>: DATABASE ACCESSION NUMBER: M30448
  ref <309>: DATABASE ENTRY DATE: 2001-06-18
tccgggcctggcctgtacggtcgccgccgttccctggaagtagcaacttccctaccccaccccagtcctggtccccgtccagccgctgacgtgaagatgagcagctcagaggaggtgtcctggatttcctggttctgtgggctccgtggcaatgaattcttctgtgaagtggatgaagactacatccaggacaaatttaatcttactggactcaatgagcaggtccctcactaccgacaagctctagacatgatcttggacctggagcctgatgaagaactggaagacaaccccaaccagagtgacctgattgagcaggcagccgagatgctttatggattgatccacgcccgctacatccttaccaaccgtggcatcgcccagatgttggaaaagtaccagcaaggagactttggttactgtcctcgtgtgtactgtgagaaccagccaatgcttcccattggcctttcagacatcccaggtgaagccatggtgaagctctactgccccaagtgcatggatgtgtacacacccaagtcatcaagacaccatcacacggatggcgcctacttcggcactggtttccctcacatgctcttcatggtgcatcccgagtaccggcccaagagacctgccaaccagtttgtgcccaggctctacggtttcaagatccatgcgatggcctaccagctgcagctccaagccgccagcaacttcaagagcccagtcaagacgattcgctgattccctcccccacctgtcctgcagtctttgacttttcctttcttttttgccaccctttcaggaaccctgtatggtttttagtttaaattaaaggagtcgttattgtggtgggaatatgaaataaagtagaagaaaaggccatgaaaaaaaaaaaaaaaaaaaaaaaaaaggtttgtgttctcgacgccttggtagttggcataggctaaagaaaagggatctcagccccgaggaagggtcaccctcctagagatagctactaccccgtctcaggagaccctggtatttctagagcacgctttgctttcaccaaacccaaggaggtgacaggaggagcccccgcacaggacctaagaatgctgtgaccagaagatgggatcgcggaacagcagcagtgcaggatccggtccggagacccctccgagggcttgccccgaagaggggctggcctgcgtcggagtgaggaagaggaagaagaggatgaagatgtggatctggcccaggtactggcctatctcctccgcagaggccaagtgaggttggtgcagggaggaggtgcagcaaatttacaattcattcaggccctcttggactcagaggaagagaatgacagagcttgggatggtcgtcttggggatcgatacaacccacctgtggatgctacccctgacacccgggagctggaattcctggagttgtgaacgccgcggactccggagccgcacaaaccagggctcgccatgaagccaggattcagtcccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggaggcttccattctggtggcaaccggggtcgtggtcggggaggaaaaagaggaaaccagtcggggaagaatgtgatggtggagccgcatcggactgagggtgtcttcatttgtcgaggaaaggagatgcactggtcaccaagaacctggtcctgggaatcaagttatggagagaagagagtctcgattcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagtttccccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggaatgtggccctgaaagcccacaccttcctgcgctaatggaggacactttgtgatttccattaaggccaactgcattgactccacagcctagcggtcaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcccgtgtgtttttctaattaaaagactcctccgtc

SEQ ID NO: 402 - DNA, 2961 bp, Homo sapiens
  ref <308>: DATABASE ACCESSION NUMBER: M30818
  ref <309>: DATABASE ENTRY DATE: 2001-06-18
aagagatgatttctccatcctgaacgtgcagcgagcttgtcaggaagatcggaggtgccaagtagcagagaaagcatcccccagctctgacagggagacagcacatgtctaaggcccacaagccttggccctaccggaggagaagtcaattttcttctcgaaaatacctgaaaaaagaaatgaattccttccagcaacagccaccgccattcggcacagtgccaccacaaatgatgtttcctccaaactggcagggggcagagaaggacgctgctttcctcgccaaggacttcaactttctcactttgaacaatcagccaccaccaggaaacaggagccaaccaagggcaatggggcccgagaacaacctgtacagccagtacgagcagaaggtgcgcccctgcattgacctcatcgactccctgcgggctctgggtgtggagcaggacctggccctgccagccatcgccgtcatcggggaccagagctcgggcaagagctctgtgctggaggcactgtcaggagtcgcgcttcccagaggcagcggaatcgtaaccaggtgtccgctggtgctgaaactgaaaaagcagccctgtgaggcatgggccggaaggatcagctaccggaacaccgagctagagcttcaggaccctggccaggtggagaaagagatacacaaagcccagaacgtcatggccgggaatggccggggcatcagccatgagctcatcagcctggagatcacctcccctgaggttccagacctgaccatcattgaccttcccggcatcaccagggtggctgtggacaaccagccccgagacatcggactgcagatcaaggctctcatcaagaagtacatccagaggcagcagacgatcaacttggtggtggttccctgtaacgtggacattgccaccacggaggcgctgagcatggcccatgaggtggacccggaaggggacaggaccatcggtatcctgaccaaaccagatctaatggacaggggcactgagaaaagcgtcatgaatgtggtgcggaacctcacgtaccccctcaagaagggctacatgattgtgaagtgccggggccagcaggagatcacaaacaggctgagcttggcagaggcaaccaagaaagaaattacattctttcaaacacatccatatttcagagttctcctggaggaggggtcagccacggttccccgactggcagaaagacttaccactgaactcatcatgcatatccaaaaatcgctcccgttgttagaaggacaaataagggagagccaccagaaggcgaccgaggagctgcggcgttgcggggctgacatccccagccaggaggccgacaagatgttctttctaattgagaaaatcaagatgtttaatcaggacatcgaaaagttagtagaaggagaagaagttgtaagggagaatgagacccgtttatacaacaaaatcagagaggattttaaaaactgggtaggcatacttgcaactaatacccaaaaagttaaaaatattatccacgaagaagttgaaaaatatgaaaagcagtatcgaggcaaggagcttctgggatttgtcaactacaagacatttgagatcatcgtgcatcagtacatccagcagctggtggagcccgcccttagcatgctccagaaagccatggaaattatccagcaagctttcattaacgtggccaaaaaacattttggcgaatttttcaaccttaaccaaactgttcagagcacgattgaagacataaaagtgaaacacacagcaaaggcagaaaacatgatccaacttcagttcagaatggagcagatggttttttgtcaagatcagatttacagtgttgttctgaagaaagtccgagaagagatttttaaccctctggggacgccttcacagaatatgaagttgaactctcattttcccagtaatgagtcttcggtttcctcctttactgaaataggcatccacctgaatgcctacttcttggaaaccagcaaacgtctcgccaaccagatcccatttataattcagtattttatgctccgagagaatggtgactccttgcagaaagccatgatgcagatactacaggaaaaaaatcgctattcctggctgcttcaagagcagagtgagaccgctaccaagagaagaatccttaaggagagaatttaccggctcactcaggcgcgacacgcactctgtcaattctccagcaaagagatccactgaagggcggcgatgcctgtggttgttttcttgtgcgtactcattcattctaaggggagtcggtgcaggatgccgcttctgctttggggccaaactcttctgtcactatcagtgtccatctctactgtactccctcagcatcagagcatgcatcaggggtccacacaggctcagctctctccaccacccagctcttccctgaccttcacgaagggatggctctccagtccttgggtcccgtagcacacagttacagtgtcctaagatactgctatcattcttcgctaatttgtatttgtattcccttccccctacaagattatgagaccccagagggggaaggtctgggtcaaattcttcttttgtatgtccagtctcctgcacagcacctgcagcattgtaactgcttaataaatgacatctcactgaacgaatgagtgctgtgtaagtgatggagatacctgaggctattgctcaagcccaggccttggacatttagtgactgttagccggtccctttcagatccagtggccatgccccctgcttcccatggttcactgtcattgtgtttcccagcctctccactcccccgccagaaaggagcctgagtgattctcttttcttcttgtttccctgattatgatgagcttccattgttctgttaagtcttgaagaggaatttaataaagcaaagaaactttttaaaaacgt

SEQ ID NO: 403 - DNA, 2372 bp, Homo sapiens
  ref <308>: DATABASE ACCESSION NUMBER: M31932
  ref <309>: DATABASE ENTRY DATE: 2001-06-18
ttctgggatggctatggagacccaaatgtctcagaatgtatgtcccagaaacctgtggctgcttcaaccattgacagttttgctgctgctggcttctgcagacagtcaagctgcagctcccccaaaggctgtgctgaaacttgagcccccgtggatcaacgtgctccaggaggactctgtgactctgacatgccagggggctcgcagccctgagagcgactccattcagtggttccacaatgggaatctcattcccacccacacgcagcccagctacaggttcaaggccaacaacaatgacagcggggagtacacgtgccagactggccagaccagcctcagcgaccctgtgcatctgactgtgctttccgaatggctggtgctccagacccctcacctggagttccaggagggagaaaccatcatgctgaggtgccacagctggaaggacaagcctctggtcaaggtcacattcttccagaatggaaaatcccagaaattctcccgtttggatcccaccttctccatcccacaagcaaaccacagtcacagtggtgattaccactgcacaggaaacataggctacacgctgttctcatccaagcctgtgaccatcactgtccaagtgcccagcatgggcagctcttcaccaatggggatcattgtggctgtggtcattgcgactgctgtagcagccattgttgctgctgtagtggccttgatctactgcaggaaaaagcggatttcagccaattccactgatcctgtgaaggctgcccaatttgagccacctggacgtcaaatgattgccatcagaaagagacaacttgaagaaaccaacaatgactatgaaacagctgacggcggctacatgactctgaaccccagggcacctactgacgatgataaaaacatctacctgactcttcctcccaacgaccatgtcaacagtaataactaaagagtaacgttatgccatgtggtcatactctcagcttgctagtggatgacaaaaagaggggaattgttaaaggaaaatttaaatggagactggaaaaatcctgagcaaacaaaaccacctggcccttagaaatagctttaactttgcttaaactacaaacacaagcaaaacttcacggggtcatactacatacaagcataagcaaaacttaacttggatcatttctggtaaatgcttatgttagaaataagacaaccccagccaatcacaagcagcctactaacatataattaggtgactagggactttctaagaagatacctacccccaaaaaacaattatgtaattgaaaaccaaccgattgcctttattttgcttccacattttcccaataaatacttgcctgtgacattttgccactggaacactaaacttcatgaattgcgcctcagatttttgctttaacatctttttttttttttgacagagtctcaatctgttacccaggctggagtgcagtggtgctatcttggctcactgcaaacccgcctcccaggtttaagcgattctcatgcctcagcctcccagtagctgggattagaggcatgtgcatcatacccagctaatttttgtattttttattttttatttttagtagagacagggtttcgcaatgttggccaggcgatctcgaacttctggcctctagcgatctgccgcctcggcctcccaaagtgctgggatgaccagcatcagccccaatgtccagcctctttaacatcttctttcctatgccctctctgtggatccctactgctggtttctgccttctccatgctgagaacaaaatcacctattcactgcttatgcagtcggaagctccagaagaacaaagagcccaattaccagaaccacattaagtctccattgttttgccttgggatttgagaagagaattagagaggtgaggatctggtatttcctggactaaattccccttggaagacgaagggatgctgcagttccaaaagagaaggactcttccagagtcatctacctgagtcccaaagctccctgtcctgaaagccacagacaatatggtcccaaatgactgactgcaccttctgtgcctcagccgttcttgacatcaagaatcttctgttccacatccacacagccaatacaattagtcaaaccactgttattaacagatgtagcaacatgagaaacgcttatgttacaggttacatgagagcaatcatgtaagtctatatgacttcagaaatgttaaaatagactaacctctaacaacaaattaaaagtgattgtttcaaggtgatgcaattattgatgacctattctatttgtctataatgatcatatattacctttgtaataaaacattataatc

SEQ ID NO: 404 - DNA, 1480 bp, Homo sapiens
  ref <308>: DATABASE ACCESSION NUMBER: M37033
  ref <309>: DATABASE ENTRY DATE: 2001-06-18
accagccttgtctcggccacctcaaggataatcactaaattctgccgaaaggactgaggaacggtgcctggaaaagggcaagaatatcacggcatgggcatgagtagcttgaaactgctgaagtatgtcctgtttttcttcaacttgctcttttggatctgtggctgctgcattttgggctttgggatctacctgctgatccacaacaacttcggagtgctcttccataacctcccctccctcacgctgggcaatgtgtttgtcatcgtgggctctattatcatggtagttgccttcctgggctgcatgggctctatcaaggaaaacaagtgtctgcttatgtcgttcttcatcctgctgctgattatcctccttgctgaggtgaccttggccatcctgctctttgtatatgaacagaagctgaatgagtatgtggctaagggtctgaccgacagcatccaccgttaccactcagacaatagcaccaaggcagcgtgggactccatccagtcatttctgcagtgttgtggtataaatggcacgagtgattggaccagtggcccaccagcatcttgcccctcagatcgaaaagtggagggttgctatgcgaaagcaagactgtggtttcattccaatttcctgtatatcggaatcatcaccatctgtgtatgtgtgattgaggtgttggggatgtcctttgcactgaccctgaactgccagattgacaaaaccagccagaccatagggctatgatctgcagtagttctgtggtgaagagacttgtttcatctccggaaatgcaaaaccatttatagcatgaagccctacatgatcactgcaggatgatcctcctcccatcctttccctttttaggtccctgtcttatacaaccagagaagtgggtgttggccaggcacatcccatctcaggcagcaagacaatctttcactcactgacggcagcagccatgtctctcaaagtggtgaaactaatatctgagcatcttttagacaagagaggcaaagacaaactggatttaatggcccaacatcaaagggtgaacccaggatatgaatttttgcatcttcccattgtcgaattagtctccagcctctaaataatgcccagtcttctccccaaagtcaagcaagagactagttgaagggagttctggggccaggctcactggaccattgtcacaaccctctgtttctctttgactaagtgccctggctacaggaattacacagttctctttctccaaagggcaagatctcatttcaatttctttattagagggccttattgatgtgttctaagtctttccagaaaaaaactatccagtgatttatatcctgatttcaaccagtcacttagctgataatcacagtaagaagacttctggtattatctctctatcagataagattttgttaatgtactattttactcttcaataaataaaacagtttattatctc

SEQ ID NO: 405 - DNA, 1416 bp, Homo sapiens
  Modified_base 1 ... 1416: n = a,c,g, or t
  ref <308>: DATABASE ACCESSION NUMBER: M55914
  ref <309>: DATABASE ENTRY DATE: 2001-06-18
aggaattccggaattccggaattccgatggatggaacagaaaataaatctaagtttggtgcgaacgccattctgggggtgtcccttgccgtctgcaaagctggtgccgttgagaagggggtcccctgtaccgccacatcgcgtacttggctggcaacttcgaagtcatcctgccagtcccggcgttcaagtgtcatcatcaatggcggttctcatgctggcaacaagctggccatgcagagtctgtcctcccagtcggtgcagcaaactcagggaagccatgccgcattggagcagaggtttaccacaacctgaagaatgtcatcaaggagaaatatgggaaagatgccaccaatgtggggatttgcgcgggtttgctcccaacatcctggagaataaagaaggcctggagctgctgaagactgctattggaaagcctggcctacactgtaaaggtggtcatggcatggacgtagcggcctccgagttcttcaggtcagggaactatgacctggacttcaagtctcccgatgaccccagcaggtacatctcgcctgaccagctggctgacctgtacaagtccttcatcaaggactacccagtggtgtctatcgaagatccctttgaccaggatgactggggagcttcagaagttcacagccagtgcaggaatccaggtagtggggggatgactcacagtgaccaacccaaagaggatcgccaaggcgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactggggcagatcaagactggtgccccttgccgatcacgcgcttggccaagtacaaccagctcctcagaattgaagaggagctgggcagcaaggctaagtttgccggcaggaacttcagaaaccccttggccaagtaagctgtgggcaggcaagccttcggtcacctgttggctacagacccctcccctggtgtcagctcaggcagctcgaggcccccgaccaacacttgcaggggtccctgctagttagcgcccaccgccgtggagttcgtaccgcttccttagaactctacagaagccaagctccctggaagccctgttggcagctctagctttgcagttgtgtaattggcccaagtcattgtttttctcgccttactttccaccaagtgtctagagtcatgtgagcctngtgtcatctccggggtggccacaggctagatccccggtggttttgtgctcaaaataaaaagcctcagtgacccatgaaaaaaaaaaaggaattccggaattccg

SEQ ID NO: 406 - DNA, 1244 bp, Homo sapiens
  ref <308>: DATABASE ACCESSION NUMBER: M63438
  ref <309>: DATABASE ENTRY DATE: 2001-06-18
atggaagccccagctcagcttctcttcctcctgctactctggctcccagataccaccggagaaattgtgttgacacagtctccagccaccctgtctttgtctccaggggaaagagccaccctctcctgcagggccagtcagagtgttggcagctacttagcctggtaccaacagaaacctggccaggctcccaggcccctcatctatgatgcatccaacagggccactggcatcccagccaggttcagtggcagtgggtctgggacagacttcactctcaccatcagcagcctagagcctgaagattttgcagtttattactgtcaacaccgtgacaattggcctccgggggccactttcggcggagggaccaaggtggagatcaaacataccaccggagaaattgtgttgacacagtctccagccaccctgtctttgtctccaggggaaagagccaccctctcctgcagggccagtcagagtgttggcagctacttagcctggtaccaacagaaacctggccaggctcccaggcccctcatctatgatgcatccaacagggccactggcatcccagccaggttcagtggcagtgggtctgggacagacttcactctcaccatcagcagcctagagcctgaagattttgcagtttattactgtcaacaccgtgacaattggcctccgggggccactttcggcggagggaccaaggtggagatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttagagggagaagtgcccccacctgctcctcagttccagcctgaccccctcccatcctttggcctctgaccctttttccacaggggacctacccctattgcggtcctccagctcatctttcacctcacccccctcctcctccttggctttaattatgctaatgttggaggagaatgaataaataaagtgaatctttgc

SEQ ID NO: 407 - DNA, 2239 bp, Homo sapiens
  ref <308>: DATABASE ACCESSION NUMBER: M65254
  ref <309>: DATABASE ENTRY DATE: 2001-06-18
gaattccgtcccgagctccgcaatgaagacgtgcagctccgactcaacagtattaagaagttatcaacaattgccctagcacttggagtagaaaggacccgaagtgaattgttgccatttcttacagatacaatttatgatgttgatgaggtactattagctcttgctgagcagctgggaaatttcactggcctagtgggaggtcctgactttgcccactgtctgctgcctcctttggaaaatctggcaactgtggaagagactgttgttcgtgacaaggctgtggagtccctgagacagatctcccaggagcatactcctgttgctctggaagcttattttgtacctctggtgaaacgcttagcaagtggggattggttcacctctcgcacatctgcatgtggtttgttcagcgtttgctatcccagggcatcaaatgctgttaaagcagaaaccagacagcaattccgttccttgtgctcagatgacacaccaatggtacgacgtgctgctgcttccaaattgggtgaatttgcaaaagttttggaattagacagtgtgaaaagtgaaattgttccactgttcactagtctagcttcagatgaacaggattcagtgcgcctccttgctgtggaagcttgtgtcagtattgcccagttattgtctcaggatgaccttgagactttggtgatgcctacacttcgacaagcagcagaagataaatcttggcgcgttcgctatatggtggctgacagattttcagagctccagaaagccatgggtcctaaaatcaccctaaatgacctcatccccgcctttcagaacctacttaaagactgtgaagctgaagtccgggcagctgctgcccacaaagtaaaagaacttggtgagaacttgcccattgaagatagagagaccataattatgaatcaaattctgccttatataaaggaattagtatccgataccaatcaacatgtcaaatcggctctagcttctgtaattatgggattgtctactattttgggcaaagaaaataccattgaacatcttctacctcttttcttagctcagttaaaggatgagtgtcctgacgttcgtttgaatatcatctccaatttggattgtgtaaatgaagtgattggaatccgtcggctctctcagtctctccttcctgccatagtggagctggcagaagatgccaaatggagggtccgcctggccatcattgagtatatgccgctgctggcaggccagctgggtgtggaattctttgatgaaaagctgaattctttatgtatggcttggctcgtggaccatgtatacgccatccgagaagctgccaccaacaacctcatgaaactagttcagaagtttggtacagagtgggcccaaaatactattgttcccaaagtgttagtaatggcaaatgatcctaattacttgcatagaatgaccactttattctgcattaatgcactgtctgaggcctgtggtcaggaaataactactaagcaaatgctgcccatcgtattaaaaatggcaggagaccaagtagcaaatgttcgcttcaatgtggccaaatctctacaaaagattggaccaattctagataccaatgctttacagggagaagtgaagccagtactacagaagttaggtcaagatgaagacatggatgtcaaatactttgcacaggaagctataagtgttcttgcattggcataatgaggagcaggagggaaaaggcctttactagattcttgtcacaaatttctagtcaatgtgttcttaactgggtggagaaagaatggaaaaccttcaagatctcatccaagcaaatggcaacaacttagaagaaatcatttagtgacttaattctttctaaagatgaaatgggattgttttttactcgtattccttgttaaatcattatttaagccgttcttattgaccaattcctgacacttgattgtctcctaatgctttatccatcaccacctgggctcctgcatcctcactgtggaatcaggcaccagccacataatgttccagacaaagcctggaagggtgtggacccagacgtggagtggagtgattctcttgacgtttacatatatctctgtgtctctccatcattccaaagctaaatgtacatgtttagaataacttattttataaactcttcgggagacatgttgagatttgaccgtaatgaaagccacattttccggaattc

SEQ ID NO: 408 - DNA, 2875 bp, Homo sapiens
  ref <308>: DATABASE ACCESSION NUMBER: M68874
  ref <309>: DATABASE ENTRY DATE: 2001-06-18
gaattctccggagctgaaaaaggatcctgactgaaagctagaggcattgaggagcctgaagattctcaggttttaaagacgctagagtgccaaagaagactttgaagtgtgaaaacatttcctgtaattgaaaccaaaatgtcatttatagatccttaccagcacattatagtggagcaccagtattcccacaagtttacggtagtggtgttacgtgccaccaaagtgacaaagggggcctttggtgacatgcttgatactccagatccctatgtggaactttttatctctacaacccctgacagcaggaagagaacaagacatttcaataatgacataaaccctgtgtggaatgagacctttgaatttattttggatcctaatcaggaaaatgttttggagattacgttaatggatgccaattatgtcatggatgaaactctagggacagcaacatttactgtatcttctatgaaggtgggagaaaagaaagaagttccttttattttcaaccaagtcactgaaatggttctagaaatgtctcttgaagtttgctcatgcccagacctacgatttagtatggctctgtgtgatcaggagaagactttcagacaacagagaaaagaacacataagggagagcatgaagaaactcttgggtccaaagaatagtgaaggattgcattctgcacgtgatgtgcctgtggtagccatattgggttcaggtgggggtttccgagccatggtgggattctctggtgtgatgaaggcattatacgaatcaggaattctggattgtgctacctacgttgctggtctttctggctccacctggtatatgtcaaccttgtattctcaccctgattttccagagaaagggccagaggagattaatgaagaactaatgaaaaatgttagccacaatccccttttacttctcacaccacagaaagttaaaagatatgttgagtctttatggaagaagaaaagctctggacaacctgtcacctttactgacatctttgggatgttaataggagaaacactaattcataatagaatgaatactactctgagcagtttgaaggaaaaagttaatactgcacaatgccctttacctcttttcacctgtcttcatgtcaaacctgacgtttcagagctgatgtttgcagattgggttgaatttagtccatacgaaattggcatggctaaatatggtacttttatggctcccgacttatttggaagcaaattttttatgggaacagtcgttaagaagtatgaagaaaaccccttgcatttcttaatgggtgtctggggcagtgccttttccatattgttcaacagagttttgggcgtttctggttcacaaagcagaggctccacaatggaggaagaattagaaaatattaccacaaagcatattgtgagtaatgatagctcggacagtgatgatgaatcacacgaacccaaaggcactgaaaatgaagatgctggaagtgactatcaaagtgataatcaagcaagttggattcatcgtatgataatggccttggtgagtgattcagctttattcaataccagagaaggacgtgctgggaaggtacacaacttcatgctgggcttgaatctcaatacatcttatccactgtctcctttgagtgactttgccacacaggactcctttgatgatgatgaactggatgcagctgtagcagatcctgatgaatttgagcgaatatatgagcctctggatgtcaaaagtaaaaagattcatgtagtggacagtgggctcacatttaacctgccgtatcccttgatactgagacctcagagaggggttgatctcataatctcctttgacttttctgcaaggccaagtgactctagtcctccgttcaaggaacttctacttgcagaaaagtgggctaaaatgaacaagctcccctttccaaagattgatccttatgtgtttgatcgggaagggctgaaggagtgctatgtctttaaacccaagaatcctgatatggagaaagattgcccaaccatcatccactttgttctggccaacatcaacttcagaaagtacaaggctccaggtgttccaagggaaactgaggaagagaaagaaatcgctgactttgatatttttgatgacccagaatcaccattttcaaccttcaattttcaatatccaaatcaagcattcaaaagactacatgatcttatgcacttcaatactctgaacaacattgatgtgataaaagaagccatggttgaaagcattgaatatagaagacagaatccatctcgttgctctgtttcccttagtaatgttgaggcaagaagatttttcaacaaggagtttctaagtaaacccaaagcatagttcatgtactggaaatggcagcagtttctgatgctgaggcagtttgcaatcccatgacaactggatttaaaagtacagtacagatagtcgtactgatcatgagagactggctgatactcaaagttgcagttacttagctgcatgagaataatactattataagttaggtgacaaatgatgttgattatgtaaggatatacttagctacattttcagtcagtatgaacttcctgatacaaatgtagggatatatactgtatttttaaacatttctcaccaactttcttatgtgtgttctttttaaaaattttttttcttttaaaatatttaacagttcaatctcaataagacctcgcattatgtatgaatgttattcactgactagatttattcataccatgagacaacactatttttatttatatatgcatatatatacatacatgaaataaatacatcaatataaaaataaaaaaaaacggaattc

SEQ ID NO: 409 - DNA, 3178 bp, Homo sapiens
  Modified_base 1 ... 3178: n = a,c,g, or t
  ref <308>: DATABASE ACCESSION NUMBER: M73547
  ref <309>: DATABASE ENTRY DATE: 2001-06-18
agttgagcgcagtcgccgctccagtctatccggcactaggaacagccccgggggcgagacggtccccgccatgtctgcggccatgagggagaggttcgaccggttcctgcacgagaagaactgcatgactgaccttctggccaagctcgaggccaaaaccggcgtgaacaggagcttcatcgctcttggtgtcatcggactggtggccttgtacctggtgttcggttatggagcctctctcctctgcaacctgataggatttggctacccagcctacatctcaattaaagctatagagagtcccaacaaagaagatgatacccagtggctgacctactgggtagtgtatggtgtgttcagcattgctgaattcttctctgatatcttcctgtcatggttccccttctactacatgctgaagtgtggcttcctgttgtggtgcatggccccgagcccttctaatggggctgaactgctctacaagcgcatcatccgtcctttcttcctgaagcacgagtcccagatggacagtgtggtcaaggaccttaaagacaagtccaaagagactgcagatgccatcactaaagaagcgaagaaagctaccgtgaatttactgggtgaagaaaagaagagcacctaaaccagactaaaccagactggatggaaacttcctgccctctctgtaccttcctactggagcttgatgttatattagggactgtggtataattattttaataatgttgccttggaaacattttgagatattaaagattggaatgtgttgtaagtttctttgcttacttttactgtctatatatatagggagcactttaaacttaatgcagtgggcagtgtccacgtttttggaaaatgtattttgcctctgggtaggaaaagatgtatgttgctatcctgcaggaaatataaacttaaaataaaattatataccccacaggctgtgtactttactgggctctccctgcacgnattttctctgtagttacatttaggntaatctttatggttctacttcctntaatgtacaattttatataattcngnaatgtttttaatgtatttgtgcacatgtacatatggaaatgttactgtctgactacancatgcatcatgctcatggggagggagcaggggaaggttgtatgtgtcatttataacttctgtacagtaagaccacctgcaacaagctggaggaaccattgtgctggtgtggtctactaaataatactttaggaaatacgtgattaatatgcaagtgaacaaagtgagaaatgaaatcgaatggagattggcctggttgtttccgtagtatatggcatatgaataccaggatagctttataaagcagttagttagttagttactcactctagtgataaatcgggaaatttacacacacacacacacacacacacacacacacacacacacacacacacacacagagtaccctgtaactctcaattccctgaaaaactagtaatactgtcttatctgctataaactttacatatttgtctattgtcaagatgctacantggannccatttctggttttatcttcanagnggaganacatgttgatttagtcttctttcccaatcttcttttttaanccagtttnaggnncttctgnagatttgnccacctctgattacatgtatgttctngtttgtatcatnagcaacaacatgctaatgncgacacctagctctnagngcaattctgggagantganaggnngtatanagtnncccataatctgcttggcaatagttaagtcaatctatcttcagtttttctctggcctttaaggtcaaacacaagaggcttccctagtttacaagtcagagtcacttgtagtccatttaaatgccctcatccgtattctttgtgttgataagctgcacangactacatagtaagtacagancagtaaagttaanncggatgtctccattgatctgccaantcgntatagagagcaatttgtctggactagaaaatctgagttttacaccatactgttaagagtccttttgaattaaactagactaaaacaagtgtataactaaactaacaagattaaatatccagccagtacagtattttttaaggcaaataaagatgattagctcaccttgagntaacaatcaggtaagatcatnacaatgtctcatgatgtnaanaatattaaagatatcaatactaagtgacagtatcacnnctaatataatatggatcagagcatttattttggggaggaaaacagtggtgattaccggcattttattaaacttaaaactttgtagaaagcaaacaaaattgttcttgggagaaaatcaacttttagattaaaaaaattttaagtanctaggagtatttaaatccttttcccataaataaaagtacagttttcttggtggcagaatgaaaatcagcaacntctagcatatagactatataatcagattgacagcatatagaatatattatcagacaagatgaggaggtacaaaagttactattgctcataatgacttacaggctaaaantagntntaaaatactatattaaattctgaatgcaatttttttttgttcccttgagaccaaaatttaagttaactgttgctggcagtctaagtgtaaatgttaacagcaggagaagttaagaattgagcagttctgttgcatgatttcccaaatgaaatactgccttggctagagtttgaaaaactaattgagcctgtgcctggctagaaaacaagcgtttatttgaatgtgaatagtgtttcaaaggtatgtagttacagaattcctaccaaacagcttaaattcttcaagaaagaattcctgcagcagttattcccttacctgaaggcttcaatcatttggatcaacaactgctactctcgggaagactcctctactcacagctgaagaaaatgagcacacccttcacactgttatcacctatcctgaagatgtgatacactgaatggaaataaatagatgtaaataaaattgagntctcatttaaaaaaaaccatgtgcccaatgggaaaatgacctcatgttgtggtttaaacagcaactgcacccactagcacagcccattgagctancctatatatacatctctgtcagtgcccctc

SEQ ID NO: 410 - DNA, 2228 bp, Homo sapiens
  ref <308>: DATABASE ACCESSION NUMBER: M77142
  ref <309>: DATABASE ENTRY DATE: 2001-06-18
gaggtagtgaagggcagggagctggacctggaggcgccgccgcgacagcagcagccatggaggacgagatgcccaagactctatacgtcggtaacctttccagagatgtgacagaagctctaattctgcaactctttagccagattggaccttgtaaaaactgcaaaatgattatggatacagctggaaatgatccctattgttttgtggagtttcatgagcatcgtcatgcagctgcagcattagctgctatgaatggacggaagataatgggtaaggaagtcaaagtgaattgggcaacaacccctagcagtcaaaagaaagatacaagcaatcatttccatgtctttgttggtgatctcagcccacaaattacaactgaagatataaaagctgcttttgcaccatttggaagaatatcagatgcccgagtggtaaaagacatggcaacaggaaagtctaagggatatggctttgtctcctttttcaacaaatgggatgctgaaaacgccattcaacagatgggtggccagtggcttggtggaagacaaatcagaactaactgggcaacccgaaagcctcccgctccaaagagtacatatgagtcaaataccaaacagctatcatatgatgaggttgtaaatcagtctagtccaagcaactgtactgtatactgtggaggtgttacttctgggctaacagaacaactaatgcgtcagactttttcaccatttggacaaataatggaaattcgagtctttccagataaaggatattcatttgttcggttcaattcccatgaaagtgcagcacatgcaattgtttctgttaatggtactaccattgaaggtcatgttgtgaaatgctattggggcaaagaaactcttgatatgataaatcccgtgcaacagcagaatcaaattggatatccccaaccttatggccagtggggccagtggtatggaaatgcacaacaaattggccagtatatgcctaatggttggcaagttcctgcatatggaatgtatggccaggcatggaaccagcaaggatttaatcagacacagtcttctgcaccatggatgggaccaaattatggagtgcaaccgcctcaagggcaaaatggcagcatgttgcccaatcagccttctgggtatcgagtggcagggtatgaaacccagtgaataaggactccagaatctaaagccagtggcttgaggctacagggagtgtagtaaagccgttgtttacttaaagatttatcaaatcagtcagtgcaaatgtcagatacaatgtattcatttaaaagattcatttttaatcatgaaattacttatcatccacattgttttaaaaagaaacaagatgctggatgtctgccaatttttgccttcattaccttttttgataaagtttctcagatccttgtttcaaacacaaatgcagggattgctgccactttttaactattaagaggcagaaaattgcacaatattgaacttttttccactgaagtagtgtgcagttctagtttgcattcctgatatgatttaaaacatgtaatataaagatgttaaaaaaaaaaaccaaaactgtgcagagtctagaagttgtttgtcatcttcagcttgtgcacaattctgttttaggttaaaaaaaggcattgtttgagctgtcccatctccactgttatccctttgggttttttaatataaattattagtttacatcatttttgtatctacatcttttttcacaaatttgtcttgccttattaaagttctgtaaaatatacttaaatggaaaaaatgatgttcatttagattgaaaacttttctcagatggattgataattgcattcatcttgtgttttatatgagaaggtgcctcaagaatttcctgttggatttgtttaaaaggatttttatctttcgtgataaactttgctgtgtaccaggaactataaaaacaaaaacttgttactaaagaaaatatctgaaatgtgataagttcttatgccatgttaatttcatgtgtcaacttcaacatttacatgtattatttcattatgtaaaatgttttagcaatttaatattttgcacagttagcaaactttgtatgtcatttccttcaaggcatcatgcagagttgacatgagatttataaggttttaagttgtttgcatgtgaaaatcaaatacatactttggtagtctttgaaaaaaaaaa

SEQ ID NO: 411 - DNA, 4051 bp, Homo sapiens
  ref <308>: DATABASE ACCESSION NUMBER: M80899
  ref <309>: DATABASE ENTRY DATE: 2001-06-18
ttacccttcctaaagtggaaggtgacctcaagggcccagaagctgacatcaagggcccaaaagtggacatcaacacccctgatgtggatgttcatggcccagactggcacctgaagatgcccaaggtgaaaatgcccaaattcagcatgcctggcttcaaaggagaaggtccagatgtggatgtgaacctgcccaaggctgacattgatgtctcaggacccaaagtggacgttgatgttcctgatgtgaatatcgaaggtccagatgcgaaactaaagggccccaagttcaagatgcctgagatgagcatcaaagcccccaagatctccatgcctgatattgacttaaacctgaaaggacccaaagtgaagggtgatgtggatgttacccttcctaaagtggaaggtgacctcaagggcccagaagctgacatcaagggcccaaaagtggacatcaacacccctgatgtggatgttcatggcccagactggcacctgaagatgcccaaggtgaaaatgcccaaattcagcatgcctggcttcaaaggagaaggtccagatgtggatgtgagcctgcccaaggccgacatcgatgtctcgggacccaaggtggacgttgatattccagatgtgaatatcgaaggtccagacccaaaactgaaggtccccaaggtcaagatgcctgaaataaatatcaaagctcccaagatctccatacctgatgttgacctggatttgaaaggacccaaagtaaaaggagattttgatgtgtctgtccctaaggttgaagggactttgaaaggcccagaagtagatcttaaaggtccacgtctggatttcgaaggccctgatgccaaactcagtggcccatctttgaagatgccatcgctggagatatctgctcctaaagtaactgctcctgatgttgatttgcatctcaaggcaccaaaaattggattttcaggtccgaagttagaaggtggtgaagtggacctcaagggacccaaagttgaagctccaagcttagatgtacacatggacagcccagatattaacatcgaagggccagatgttaaaatccccaaatttaagaaacccaagtttggatttgggccaaaaagccccaaagctgacatcaagtcaccttcactggatgtcactgttcctgaggcagagctgaaccttgagactcctgaaattagtgttggtggcaagggcaagaaaagtaagtttaaaatgcctaaaattcatatgagtggtcctaagattaaggccaaaaaacagggatttgacctgaatgttcctgggggtgaaattgatgccagcctcaaggctccggatgtagatgtcaacatcgcagggccggatgctgcactcaaagtcgacgtgaaatcgcccaaaaccaagaaaacgatgtttggaaaaatgtacttcccagatgtagagtttgacattaaatcacctaaatttaaagctgaggcccctctccctagccccaaactggagggtgaactccaggcacctgatctggaactttctttgccagcgattcacgtcgaaggtcttgacatcaaggcgaaggctcccaaggtcaagatgccagatgtggacatctcagtgccaaaaatagagggtgacctgaaaggccccaaagtgcaggcaaacttgggtgcacctgacatcaacatcgaaggcctagatgctaaagtcaaaacaccgtccttcggcatttctgcccctcaagtctccatccctgatgtgaatgtaaacttgaaaggaccaaagataaagggtgatgtccccagcgtgggactggaaggaccagatgtagatctgcaaggtccagaagcaaaaattaagttccccaagttttccatgcccaagatcggcatcccaggtgtgaaaatggagggtgggggagccgaggtccatgcccagctaccctctcttgaaggagacttgagaggaccagatgttaagctcgaagggcccgatgtttctctaaaggggccaggagtagacttaccttcagtgaacctctctatgccaaaagtctctgggcctgaccttgatctgaacttgaaaggaccaagtttgaagggagacctggatgcatctgttcccagcatgaaggtgcatgctccagggctcaacctcagtggtgtcggtggcaaaatgcaggtgggaggagacggtgtgaaagtgccagggatcgatgccacaacaaagcttaacgttggggcaccagatgtgacactgaggggaccaagcctgcagggagatctggctgtctctggtgacatcaaatgccctaaagtatccgtaggagctcctgatctaagcttggaggcatccgaaggcagcattaaacttcccaaaatgaagctgccccaatttggtatctctactccggggtccgacttgcacgtcaatgccaaggggccacaggtttctggcgaactgaaggggccaggtgtggatgtgaacctgaaagggtctcggatttcagcaccgaatgtggactttaacttggaaggaccaaaagtgaaagggagccttggggccactggtgagatcaaaggccccactgtcggaggaggtcttccaggcattggtgttcaaggcctagaaggaaacctccagatgcctggaattaagtcctctggatgtgatgtgaacctgccaggcgtgaatgtgaaactcccaactgggcagatttctgggcctgaaatcaaaggtggtctgaaaggttcagaagtaggtttccatggggctgctcctgatatcagtgtgaaggggcctgcctttaatatggcatctcctgagtcagattttggcatcaacttgaagggcccaaaaatcaaaggaggtgcggatgtttcagggggtgtcagtgccccagacatcagccttggtgaagggcatttgagtgttaaaggttccgggggtgagtggaagggaccccaagtctcctctgctctcaacttggacacatctaagtttgctgggggccttcatttctcaggaccaaaggtggaaggaggtgtgaaaggaggtcagattggactccaggctcctgggctgagtgtgtctgggcctcaaggtcacttggaaagtggatctggaaaagtaacattccctaaaatgaagatccccaaatttaccttctctggccgtgagctggttggcagagaaatgggggtggatgttcacttccctaaagcagaggccagcatccaagctggtgctggagacggcgagtgggaagagtctgaagtcaaactgaaaaagtccaagatcaaaatgcccaagtttaatttttccaaacctaaagggaaaggtggtgtcactggctcaccagaagcatcaatttctgggtccaaaggtgacctgaaaagttcaaaggccagcctgggctctctggaaggagaggcagaggccgaagcctcttcaccgaaaggcaaattctccttatttaaaagtaagaagccacggcaccgctcaaattcattcagtgatgaaagagagttctctggaccttccaccccgacggggacgctggagtttgaaggtggggaagtgtctctggaaggtgggaaagttaaagggaaacacgggaagctgaaattcggtacctttggtggattggggtcaaagagcaaaggtcattatgaggtgactgggagcgatgatgagacaggcaagttacaggggagtggggtgtccctggcctctaagaagtcccgactgtcctcctcttctagcaatgacagtgggaataaggttggcatccagcttcccgaggtggagctgtcagtttccacaaagaaagagtagcaggcctttgtatgtgtgtacatatatatatatataacaaaacatcagccttgggtggtgtgttcctatataaactccaaagggaaacacaccgactgcctcagcaatcatgcaaagaccttgcctggcccggtggcaagcgctgaaaaaccgaccgcctgtaggctcctggaactatacagataggtaaagagttccaagttcgtccggaattc

SEQ ID NO: 412 - DNA, 7332 bp, Homo sapiens
  ref <308>: DATABASE ACCESSION NUMBER: M83822
  ref <309>: DATABASE ENTRY DATE: 2001-06-18
ttcagacaaatttaatcacaatgaccacatataatgtgctgtttgagattcttatagaacagattggtactcaggtgatacataaacagcatccagatcctgattcttcagtgaagatacaaaaccctcagatactaaaagtaattgcgaccctacttcgaaattctccccagtgcccagagagcatggaggttcgcagagcctttctttctgacatgattaaactttttaataacagtagagaaaacaggaggagcttgctacaatgctctgtgtggcaagaatggatgctttctctctgctattttaatcctaagaattcagatgagcaaaagataacagaaatggtatacgccatattcagaatcctgctttaccatgcagtcaaatatgagtggggtggctggcgtgtatgggtagacactttatcaatcactcattcaaaggtcacttttgaaatacacaaagaaaaccttgccaatatatttagggaacagcaaggaaaagttgatgaagaaatagggctgtgttcttcaacttcagttcaagcagcctctggcattagaagggatattaatgtttcagtaggatcccagcaaccagatacgaaggattctcctgtctgtcctcatttcaccacaaatggtaatgaaaattcaagtatagagaagacaagttcactagaatctgcatctaatattgaactgcaaactactaatacatcttatgaagaaatgaaagctgagcaagaaaatcaggagttaccagatgaaggcactttggaagaaacactgacaaatgagacaaggaatgcagatgatttagaagtatcttctgacataatagaagctgtggctatttcctctaattcttttataacaactggcaaagattcaatgactgtcagtgaagtaactgcttctataagttctccttcagaagaggatgcctcagagatgccagaattcttggataaatctatagtagaggaagaggaagatgatgattatgtggaactgaaagtagaaggcagtcctactgaggaagctaatctacccacagagctccaagataacagtttgtctccagctgcatctgaagccggtgaaaaactggacatgtttggtaatgatgacaaattaatatttcaagaaggaaaacctgttactgaaaagcaaactgatactgaaactcaagattctaaagattctggaattcagactatgacagcatcagggtcttcagctatgtcaccagaaactactgtttcccaaatagctgtagaatcagaccttggtcagatgctggaggaagggaagaaagcaactaacctcactagagaaaccaaattaattaatgattgtcatggtagtgtctctgaggcttcttctgagcaaaagattgcgaagttggatgtttccaatgttgctacagatactgagaggctggagttgaaggccagtcccaacgtggaagcacctcaacctcatcgacatgtgcttgagatatcaaggcaacatgagcagccagggcaaggaatagcaccagatgcagttaatggacaaaggagggattccagatctactgtgtttcgtattcctgagttcaactggtctcagatgcatcaacgtttgctcactgatctattattttcaatagaaacagatatacagatgtggagaagccattcaacaaagacagttatggacttcgtgaatagcagtgataatgtcatctttgtacacaacacaattcatctcatctctcaagtgatggacaatatggtcatggcttgtgggggtatactgccattgctttcagctgctacatcggctacacatgaactggaaaatattgaacctactcaaggcctttcaatagaagcctctgtgacatttttgcagaggctaattagccttgtggatgtgcttatatttgcaagttctcttggctttactgaaattgaagctgaaaaaagtatgtcatctggaggaattttgcggcagtgtctccgactagtttgtgcagtcgcagtaaggaattgcttggagtgtcaacagcattcacaactgaaaactaggggagataaagccttgaaaccaatgcatagccttattcctttagggaaatctgcagcgaagagcccagtggacattgtgactggcggtatatctccagtaagagatcttgacaggcttctacaggacatggatattaatcggcttagggcagttgttttcagagacatagaggatagcaaacaagctcaatttttagccttggcagtagtatactttatctctgttcttatggtctccaagtacagagacattttggaaccccaaaatgaaaggcatagccagtcatgtacagaaactggcagtgaaaatgagaatgtatcactctctgaaatcacaccagcagcattcagcactttaactacggcatcagtggaagaatctgaaagcacatcatctgctcgaaggagggactcaggcattggggaagaaacagccactggtttaggaagccatgtggaagtaactcctcacacagcacctcctggtgtcagtgcaggcccagatgcaatcagcgaggtgctatctactctttctttagaagtcaataagtctccggaaaccaaaaatgatagaggaaatgacttggacactaaggctacaccgtcagtttcagtttcaaaaaacgtcaatgtgaaagacattctccgaagcttggttaacataccagcagatggagtcacagtggatcctgcccttctgccaccagcctgccttggagcccttggtgatctatctgtggaacaacccgtgcagttcagatcttttgacagaagtgtcattgttgcagcaaaaaagtcagcagtctcaccttccacctttaatacaagcatacctaccaatgctgtcagtgtggtttcctcagtagattcagcccaagcctcagatatgggaggagaatcaccaggcagtagatcatctaatgcaaaattgccctcagttccaacagttgattcagtttcacaagatccggtttcaaatatgagtattacagagaggcttgaacacgctttggaaaaggcagctcctctccttcgtgagatttttgtggattttgcaccttttctttctcggacacttttgggtagccatggacaagaactgcttatagaaggaacaagtctggtttgcatgaagtcgagtagttcagttgtggaattggttatgctactgtgttctcaggagtggcaaaattctattcagaagaatgcaggccttgcttttatcgaacttgtcaatgaaggaaggttgcttagccagacaatgaaggatcatctagtaagagtagcaaatgaagctgaatttatcctgagcaggcagagagcagaagatattcacagacatgcggaatttgagtcactgtgtgcccagtattctgcagacaaacgagaagatgagaagatgtgtgatcatttgataagagcagcaaaatatcgtgaccacgtgacagcaactcaactaatccagaaaattatcaacattctcacagacaagcatggagcctggggaaattctgcagtgagtcgtcctcttgagttctggcgccttgactactgggaagatgacttgcggcgccggcgacgatttgtgcgtaaccctctaggatcgacacatcctgaagcgacactaaaaacagccgtggaacatgtgtgcatttttaaattgagagagaacagcaaagccacagatgaagatatccttgctaaaggaaaacagtccatcaggagtcaggctttaggaaatcagaactcagaaaacgagatcctcctggaaggcgatgatgatactctgtcatccgtggatgagaaagatttagagaatcttgccggtcctgttagcctgagcacaccagctcagcttgtggccccctctgttgtagtaaagggcactctttctgtcacctcctccgaactctattttgaggtggatgaagaggatcctaacttcaaaaaaatcgaccccaagatcttggcatatacagaagggctgcatggaaaatggctgttcacagagatacgatcaatcttttctcgtcgttatcttttgcaaaatacagccctggagatctttatggcaaacagagttgctgtgatgttcaacttcccagaccctgcaacagtaaagaaagtggttaactttctacctcgtgttggcgttggaacaagttttggattgcctcaaaccagacgtatttcattagctagtccacgtcagctttttaaggcttctaatatgacccagcgatggcaacacagagagatatctaattttgagtacttgatgtttctcaacacgatagcaggacggagttataatgacttaaatcagtatccagtgtttccttgggtcatcactaattatgaatcagaagaactggatcttaccttgcccaccaacttcagagatttgtccaagccaataggagctctgaacccaaaaagagcagcattcttcgctgagcgttatgaatcatgggaagatgatcaagttccaaagtttcactatggtactcattactcaactgcaagttttgttcttgcatggctgctaagaatagaaccctttacaacttatttcctaaatttgcaaggaggcaaatttgatcatgcagatcgaactttttcatcaatttccagagcttggcgaaacagtcagcgtgatacctctgatattaaggagttgatccctgaattttattatctccctgagatgtttgtcaacttcaataattataatcttggagtgatggatgatgggacagtagtgtctgatgtcgaacttcctccttgggccaaaacctcagaagaatttgttcacataaacagattggccctggagagtgaatttgtttcctgccagcttcaccaatggattgatctcatttttggctataaacagcaaggaccagaagctgtccgagccctcaatgtgttctattacttgacctatgaaggagctgtcaatctgaattcaataactgatcctgtgttgagagaggctgttgaagctcaaatccgaagttttggacagactccttctcaactactcatagagccccatcctcccagaggttctgccatgcaagtgagtccattgatgttcacagacaaagcccagcaggatgttatcatggtcctcaagtttccctccaactcccctgttactcacgtggcagccaacacccagcctggtttggcaactcccgctgtgatcacagtcactgctaacaggttatttgcggtgaacaaatggcacaaccttcctgctcatcaaggtgctgtacaagaccagccataccagctgccagtggaaatcgatcctctcatagccagcaatacaggaatgcacaggaggcaaatcactgaccttttagaccaaagtattcaagtgcattcccagtgctttgtcatcacttcagacaaccgctatattctcgtctgtggcttctgggataaaagtttcagagtctattctacagacacaggaagattgatccaagtggtgtttggccattgggatgtcgtcacttgccttgctcgttctgagtcatatattgggggaaattgctacattctctcagggtcacgtgatgcaactcttttgctgtggtattggaatggaaatgcagtgggattggagataacccaggcagtgagactgctgctcctcgggccattttgaccggccatgactatgaggtcacatgtgctgcggtgtgtgcggagctaggcctggtgttgagtggttcacaagaaggaccatgtctcatacattccatgaatggagacttgttgaggaccttggagggtcctgaaaactgcctgaaaccaaaactcattcaggcttcaagagagggtcattgtgtcatattctatgaaaacggcctcttctgtacattcagtgtgaatggaaaactccaggccacgatggaaacagatgataacataagagccatccagctgagccgagatgggcagtacctgctcacaggaggagacagaggagtggtcgtggtccggcaggtgtcggacctcaagcagctctttgcctatccaggatgtgacgctggaatccgggccatggcgctgtcttacgaccagaggtgcatcatttctggcatggcttcaggaagcattgtgctattttacaacactttaaccggtggcatcatgataccaaacccgctactgatggtgacagctgtacatcaactctgcccctaggatgagcagaagtacctggagcataattctcttctaccacatctgaatgtaacttaaatttgctcaaagaagcaaaatattttttaaagttattaataattgctatttttgtagtctttgcttgacttttttgggggggattagcaaagcagaaaactggctgctgggttctgtagttttaaaaaatctatatttttagtcataatgagaagtctattttcaccaattatggaaacatacagtggagcaagtaaaccacttattccagctataatattatgaagaacatttcccatgcatctacaagcttgagaaataggattttcacagtggggaagtgggttacaatattggaataggaaaatttgatgctgtaatttgggtcctgtatttttccaaacaactgtgcttcttcagcactaatatttctgggatttaaatagtaatgtttaaattatggtaaatgtaatttaaaacatctcaattaagtctgtctatcaatattgttcttcaagcatgttttagacctagaaaagtatggtttgggggaggctattttattgtgtggttagcacaaggaatctaatttatagcaagtgtgaaatagttaccattttttcctgatctgtcatcttcatagcacaacaaaacgaaatgatggaaatgctcttgagctcacaacatttgtttttcttttaaagtaaatgcaagtaccaaagctcactactgcggtttgcctgtgcctggacaatgaggcggagccactgttgttggggcacccccttccctccccgggtttgcaaatagaggctaccgggtgctgtattcagcaacacctgttttactatttgttattaaactatcatctccaccttccttttgattagcaatttgtactaagaaacgaaacaatgttatttggtggtgtataattctacttttctagtagattactgtgtggaattctgtgaaaaatatttgagaaaaggcctgtattgcataaataaattctttgtatgttgtgaaaaaaa

SEQ ID NO: 413 - DNA, 1188 bp, Homo sapiens
  ref <308>: DATABASE ACCESSION NUMBER: M90657
  ref <309>: DATABASE ENTRY DATE: 2001-06-18
tcgagatccattgtgctctaaaggctcgccctcctgtgcatcgcggctaatttggggtatcactgagctgaagacaaagagaagggggagaaaacctagcagaccaccatgtgctatgggaagtgtgcacgatgcatcggacattctctggtggggctcgccctcctgtgcatcgcggctaatattttgctttactttcccaatggggaaacaaagtatgcctccgaaaaccacctcagccgcttcgtgtggttcttttctggcatcgtaggaggtggcctgctgatgctcctgccagcatttgtcttcattgggctggaacaggatgactgctgtggctgctgtggccatgaaaactgtggcaaacgatgtgcgatgctttcttctgtattggctgctctcattggaattgcaggatctggctactgtgtcattgtggcagcccttggcttagcagaaggaccactatgtcttgattccctcggccagtggaactacacctttgccagcaccgagggccagtaccttctggatacctccacatggtccgagtgcactgaacccaagcacattgtggaatggaatgtatctctgttttctatcctcttggctcttggtggaattgaattcatcttgtgtcttattcaagtaataaatggagtgcttggaggcatatgtggcttttgctgctctcaccaacagcaatatgactgctaaaagaaccaacccaggacagagccacaatcttcctctatttcattgtaatttatatatttcacttgtattcatttgtaaaactttgtattagtgtaacatactccccacagtctacttttacaaacgcctgtaaagactggcatcttcacaggatgtcagtgtttaaatttagtaaacttcttttttgtttgtttatttgtgtaacatactccccacagtctacttttacaaacgcctgtaaagactggcatcttcacaggatgtcagtgtttaaatttagtaaacttcttttttgtttgtttatttgtttttgtttttttttaaggaatgaggaaacaaaccaccctctgggggtagtttacagactgagtgacagtactcagtatatctgagataaactctataatgttttggataaaaataacattccatggcacatatatacaatagtgattggctttagagcacaat

SEQ ID NO: 414 - DNA, 4077 bp, Homo sapiens
  ref <308>: DATABASE ACCESSION NUMBER: M93718
  ref <309>: DATABASE ENTRY DATE: 2001-06-18
gaattcccactctgctgcctgctccagcagacggacgcacagtaacatgggcaacttgaagagcgtggcccaggagcctgggccaccctgcggcctggggctggggctgggccttgggctgtgcggcaagcagggcccagccaccccggcccctgagcccagccgggccccagcatccctactcccaccagcgccagaacacagccccccgagctccccgctaacccagcccccagaggggcccaagttccctcgtgtgaagaactgggaggtggggagcatcacctatgacaccctcagcgcccaggcgcagcaggatgggccctgcaccccaagacgctgcctgggctccctggtatttccacggaaactacagggccggccctcccccggccccccggcccctgagcagctgctgagtcaggcccgggacttcatcaaccagtactacagctccattaagaggagcggctcccaggcccacgaacagcggcttcaagaggtggaagccgaggtggcagccacaggcacctaccagcttagggagagcgagctggtgttcggggctaagcaggcctggcgcaacgctccccgctgcgtgggccggatccagtgggggaagctgcaggtgttcgatgcccgggactgcaggtctgcacaggaaatgttcacctacatctgcaaccacatcaagtatgccaccaaccggggcaaccttcgctcggccatcacagtgttcccgcagcgctgccctggccgaggagacttccgaatctggaacagccagctggtgcgctacgcgggctaccggcagcaggacggctctgtgcggggggacccagccaacgtggagatcaccgagctctgcattcagcacggctggaccccaggaaacggtcgcttcgacgtgctgcccctgctgctgcaggccccagatgagcccccagaactcttccttctgccccccgagctggtccttgaggtgcccctggagcaccccacgctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggatgtggctgtctgcatggacctggatacccggaccacctcgtccctgtggaaagacaaggcagcagtggaaatcaacgtggccgtgctgcacagttaccagctagccaaagtcaccatcgtggaccaccacgccgccacggcctctttcatgaagcacctggagaatgagcagaaggccagggggggctgccctgcagactgggcctggatcgtgccccccatctcgggcagcctcactcctgttttccatcaggagatggtcaactatttcctgtccccggccttccgctaccagccagacccctggaaggggagtgccgccaagggcaccggcatcaccaggaagaagacctttaaagaagtggccaacgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtcctgtgtatggatgagtatgacgtggtgtccctcgaacacgagacgctggtgctggtggtaaccagcacatttgggaatggggatcccccggagaatggagagagctttgcagctgccctgatggagatgtccggcccctacaacagctcccctcggccggaacagcacaagagttataagatccgcttcaacagcatctcctgctcagacccactggtgtcctcttggcggcggaagaggaaggagtccagtaacacagacagtgcaggggccctgggcaccctcaggttctgtgtgttcgggctcggctcccgggcatacccccacttctgcgcctttgctcgtgccgtggacacacggctggaggaactgggcggggagcggctgctgcagctgggccagggcgacgagctgtgcggccaggaggaggccttccgaggctgggcccaggctgccttccaggccgcctgtgagaccttctgtgtgggagaggatgccaaggccgccgcccgagacatcttcagccccaaacggagctggaagcgccagaggtaccggctgagcgcccaggccgagggcctgcagttgctgccaggtctgatccacgtgcacaggcggaagatgttccaggctacaatccgctcagtggaaaacctgcaaagcagcaagtccacgagggccaccatcctggtgcgcctggacaccggaggccaggaggggctgcagtaccagccgggggaccacataggtgtctgcccgcccaaccggcccggccttgtggaggcgctgctgagccgcgtggaggacccgccggcgcccactgagcccgtggcagtagagcagctggagaagggcagccctggtggccctccccccggctgggtgcgggacccccggctgcccccgtgcacgctgcgccaggctctcaccttcttcctggacatcacctccccacccagccctcagctcttgcggctgctcagcaccttggcagaagagcccagggaacagcaggagctggaggccctcagccaggatccccgacgctacgaggagtggaagtggttccgctgccccacgctgctggaggtgctggagcagttcccgtcggtggcgctgcctgccccactgctcctcacccagctgcctctgctccagccccggtactactcagtcagctcggcacccagcacccacccaggagagatccacctcactgtagctgtgctggcatacaggactcaggatgggctgggccccctgcactatggagtctgctccacgtggctaagccagctcaagcccggagaccctgtgccctgcttcatccggggggctccctccttccggctgccacccgatcccagcttgccctgcatcctggtgggtccaggcactggcattgcccccttccggggattctggcaggagcggctgcatgacattgagagcaaagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaagacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcccgaccaggatcagccccgctcctcccctcttgaggtggtgccttctcacatctgtccagaggctgcaaggattcagcattattcctccaggaaggagcaaaacgcctcttttccctctctaggcctgttgcctcgggcctgggtccgccttaatctggaaggcccctcccagcagcggtaccccagggcctactgccacccgcttcctgtttcttagtccgaatgttagattcctcttgcctctctcaggagtatcttacctgtaaagtctaatctctaaatcaagtatttattattgaagatttaccataagggactgtgccagatgttaggagaactactaaagtgcctaccccagctc

SEQ ID NO: 415 - DNA, 2517 bp, Homo sapiens
  ref <308>: DATABASE ACCESSION NUMBER: M96577
  ref <309>: DATABASE ENTRY DATE: 2001-06-18
ggaattccgtggccgggactttgcaggcagcggcggccgggggcggagcgggatcgagccctcgccgaggcctgccgccatgggcccgcgccgccgccgccgcctgtcacccgggccgcgcgggccgtgagcgtcatggccttggccggggcccctgcgggcggcccatgcgcgccggcgctggaggccctgctcggggccggcgcgctgcggctgctcgactcctcgcagatcgtcatcatctccgccgcgcaggacgccagcgccccgccggctcccaccggccccgcggcgcccgccgccggcccctgcgaccctgacctgctgctcttcgccacaccgcaggcgccccggcccacacccagtgcgccgcggcccgcgctcggccgcccgccggtgaagcggaggctggacctggaaactgaccatcagtacctggccgagagcagtgggccagctcggggcagaggccgccatccaggaaaaggtgtgaaatccccgggggagaagtcacgctatgagacctcactgaatctgaccaccaagcgcttcctggagctgctgagccactcggctgacggtgtcgtcgacctgaactgggctgccgaggtgctgaaggtgcagaagcggcgcatctatgacatcaccaacgtccttgagggcatccagctcattgccaagaagtccaagaaccacatccagtggctgggcagccacaccacagtgggcgtcggcggacggcttgaggggttgacccaggacctccgacagctgcaggagagcgagcagcagctggaccacctgatgaatatctgtactacgcagctgcgcctgctctccgaggacactgacagccagcgcctggcctacgtgacgtgtcaggaccttcgtagcattgcagaccctgcagagcagatggttatggtgatcaaagcccctcctgagacccagctccaagccgtggactcttcggagaactttcagatctcccttaagagcaaacaaggcccgatcgatgttttcctgtgccctgaggagaccgtaggtgggatcagccctgggaagaccccatcccaggaggtcacttctgaggaggagaacagggccactgactctgccaccatagtgtcaccaccaccatcatctcccccctcatccctcaccacagatcccagccagtctctactcagcctggagcaagaaccgctgttgtcccggatgggcagcctgcgggctcccgtggacgaggaccgcctgtccccgctggtggcggccgactcgctcctggagcatgtgcgggaggacttctccggcctcctccctgaggagttcatcagcctttccccaccccacgaggccctcgactaccacttcggcctcgaggagggcgagggcatcagagacctcttcgactgtgactttggggacctcacccccctggatttctgacagggcttggagggaccagggtttccagagtagctcaccttgtctctgcagccctggagccccctgtccctggccgtcctcccagcctgtttggaaacatttaatttatacccctctcctctgtctccagaagcttctagctctggggtctggctaccgctaggaggctgagcaagccaggaagggaaggagtctgtgtggtgtgtatgtgcatgcagcctacacccacacgtgtgtaccgggggtgaatgtgtgtgagcatgtgtgtgtgcatgtaccggggaatgaaggtgaacatacacctctgtgtgtgcactgcagacacgccccagtgtgtccacatgtgtgtgcatgagtccatctctgcgcgtgggggggctctaactgcactttcggcccttttgctcgtggggtcccacaaggcccagggcagtgcctgctcccagaatctggtgctctgaccaggccaggtggggaggctttggctggctgggcgtgtaggacggtgagagcacttctgtcttaaaggttttttctgattgaagctttaatggagcgttatttatttatcgaggcctctttggtgagcctggggaatcagcaaaaggggaggaggggtgtggggttgataccccaactccctctacccttgagcaagggcaggggtccctgagctgttcttctgccccatactgaaggaactgaggcctgggtgatttatttattgggaaagtgagggagggagacagactgactgacagccatgggtggtcagatggtggggtgggccctctccagggggccagttcagggcccagctgccccccaggatggatatgagatgggagaggtgagtgggggaccttcactgatgtgggcaggaggggtggtgaaggcctcccccagcccagaccctgtggtccctcctgcagtgtctgaagcgcctgcctccccactgctctgccccaccctccaatctgcactttgatttgcttcctaacagctctgttccctcctgctttggttttaataaatattttgatgacgttaaaaaaaggaattcgatat

SEQ ID NO: 416 - DNA, 1829 bp, Homo sapiens
  ref <308>: DATABASE ACCESSION NUMBER: NM_000017
  ref <309>: DATABASE ENTRY DATE: 2001-06-18
gggattcgggcctgggactgtgtctgtcgcccatggccgccgcgctgctcgcccgggcctcgggccctgcccgcagagctctctgtcctagggcctggcggcagttacacaccatctaccagtctgtggaactgcccgagacacaccagatgttgctccagacatgccgggactttgccgagaaggagttgtttcccattgcagcccaggtggataaggaacatctcttcccagcggctcaggtgaagaagatgggcgggcttgggcttctggccatggacgtgcccgaggagcttggcggtgctggcctcgattacctggcctacgccatcgccatggaggagatcagccgtggctgcgcctccaccggagtcatcatgagtgtcaacaactctctctacctggggcccatcttgaagtttggctccaaggagcagaagcaggcgtgggtcacgcctttcaccagtggtgacaaaattggctgctttgccctcagcgaaccagggaacggcagtgatgcaggagctgcgtccaccaccgcccgggccgagggcgactcatgggttctgaatggaaccaaagcctggatcaccaatgcctgggaggcttcggctgccgtggtctttgccagcacggacagagccctgcaaaacaagggcatcagtgccttcctggtccccatgccaacgcctgggctcacgttggggaagaaagaagacaagctgggcatccggggctcatccacggccaacctcatctttgaggactgtcgcatccccaaggacagcatcctgggggagccagggatgggcttcaagatagccatgcaaaccctggacatgggccgcatcggcatcgcctcccaggccctgggcattgcccagaccgccctcgattgtgctgtgaactacgctgagaatcgcatggccttcggggcgcccctcaccaagctccaggtcatccagttcaagttggcagacatggccctggccctggagagtgcccggctgctgacctggcgcgctgccatgctgaaggataacaagaagcctttcatcaaggaggcagccatggccaagctggccgcctcggaggccgcgaccgccatcagccaccaggccatccagatcctgggcggcatgggctacgtgacagagatgccggcagagcggcactaccgcgacgcccgcatcactgagatctacgagggcaccagcgaaatccagcggctggtgatcgccgggcatctgctcaggagctaccggagctgagcccgcggcggactgccccaggactgcgggaaggcgcgggagccaggggcctccaccccaaccccggctcagagactgggcggcccggcgggggctccctggggaccccagatgggctcagtgctgccacccagatcagatcacatgggaatgaggccctccgaccattggcagctccgcctctgggcctttccgcctcctcaccactgtgcctcaagttcctcatctaagtggccctggctcctgggggcggggttgtgggggggctgagcgacactcagggacacctcagttgtcctcccgcgggccctggtgccctggcatgaaggcccagtgcgacaggcccttggtggggtctgtcttttccttgaggtcagaggtcaggagcagggctggggtcaggatgacgaggcctggggtcctggtgttgggcaggtggtggggctgggccatggagctggcccagaggcccctcagccctttgtaaagtctgatgaaggcaggggtggtgattcatgctgtgtgactgactgtgggtaataaacacacctgtccccc

SEQ ID NO: 417 - DNA, 1497 bp, Homo sapiens
  ref <308>: DATABASE ACCESSION NUMBER: NM_000022
  ref <309>: DATABASE ENTRY DATE: 2001-06-18
accgctggccccagggaaagccgagcggccaccgagccggcagagacccaccgagcggcggcggagggagcagcgccggggcgcacgagggcaccatggcccagacgcccgccttcgacaagcccaaagtagaactgcatgtccacctagacggatccatcaagcctgaaaccatcttatactatggcaggaggagagggatcgccctcccagctaacacagcagaggggctgctgaacgtcattggcatggacaagccgctcacccttccagacttcctggccaaatttgactactacatgcctgctatcgcgggctgccgggaggctatcaaaaggatcgcctatgagtttgtagagatgaaggccaaagagggcgtggtgtatgtggaggtgcggtacagtccgcacctgctggccaactccaaagtggagccaatcccctggaaccaggctgaaggggacctcaccccagacgaggtggtggccctagtgggccagggcctgcaggagggggagcgagacttcggggtcaaggcccggtccatcctgtgctgcatgcgccaccagcccaactggtcccccaaggtggtggagctgtgtaagaactaccagcagcagaccgtggtagccattgacctggctggagatgagaccatcccaggaagcagcctcttgcctggacatgtccaggcctaccaggaggctgtgaagagcggcattcaccgtactgtccacgccggggaggtgggctcggccgaagtagtaaaagaggctgtggacatactcaagacagagcggctgggacacggctaccacaccctggaagaccaggccctttataacaggctgcggcaggaaaacatgcacttcgagatctgcccctggtccagctacctcactggtgcctggaagccggacacggagcatgcagtcattcggctcaaaaatgaccaggctaactactcgctcaacacagatgacccgctcatcttcaagtccaccctggacactgattaccagatgaccaaacgggacatgggctttactgaagaggagtttaaaaggctgaacatcaatgcggccaaatctagtttcctcccagaagatgaaaagagggagcttctcgacctgctctataaagcctatgggatgccaccttcagcctctgcagggcagaacctctgaagacgccactcctccaagccttcaccctgtggagtcaccccaactctgtggggctgagcaacatttttacatttattccttccaagaagaccatgatctcaatagtcagttactgatgctcctgaaccctatgtgtccatttctgcacacacgtatacctcggcatggccgcgtcacttctctgattatgtgccctggcagggaccagcgcccttgcacatgggcatggttgaatctgaaaccctccttctgtggcaacttgtactgaaaatctggtgctcaataaagaagcccatggctggtggcatgc

SEQ ID NO: 418 - DNA, 4321 bp, Homo sapiens
  ref <308>: DATABASE ACCESSION NUMBER: NM_000044
  ref <309>: DATABASE ENTRY DATE: 2001-06-18
cgagatcccggggagccagcttgctgggagagcgggacggtccggagcaagcccacaggcagaggaggcgacagagggaaaaagggccgagctagccgctccagtgctgtacaggagccgaagggacgcaccacgccagccccagcccggctccagcgacagccaacgcctcttgcagcgcggcggcttcgaagccgccgcccggagctgccctttcctcttcggtgaagtttttaaaagctgctaaagactcggaggaagcaaggaaagtgcctggtaggactgacggctgcctttgtcctcctcctctccaccccgcctccccccaccctgccttccccccctcccccgtcttctctcccgcagctgcctcagtcggctactctcagccaacccccctcaccacccttctccccacccgcccccccgcccccgtcggcccagcgctgccagcccgagtttgcagagaggtaactccctttggctgcgagcgggcgagctagctgcacattgcaaagaaggctcttaggagccaggcgactggggagcggcttcagcactgcagccacgacccgcctggttagaattccggcggagagaaccctctgttttcccccactctctctccacctcctcctgccttccccaccccgagtgcggagcagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcgtttggagactgccagggaccatgttttgcccattgactattactttccaccccagaagacctgcctgatctgtggagatgaagcttctgggtgtcactatggagctctcacatgtggaagctgcaaggtcttcttcaaaagagccgctgaagggaaacagaagtacctgtgcgccagcagaaatgattgcactattgataaattccgaaggaaaaattgtccatcttgtcgtcttcggaaatgttatgaagcagggatgactctgggagcccggaagctgaagaaacttggtaatctgaaactacaggaggaaggagaggcttccagcaccaccagccccactgaggagacaacccagaagctgacagtgtcacacattgaaggctatgaatgtcagcccatctttctgaatgtcctggaagccattgagccaggtgtagtgtgtgctggacacgacaacaaccagcccgactcctttgcagccttgctctctagcctcaatgaactgggagagagacagcttgtacacgtggtcaagtgggccaaggccttgcctggcttccgcaacttacacgtggacgaccagatggctgtcattcagtactcctggatggggctcatggtgtttgccatgggctggcgatccttcaccaatgtcaactccaggatgctctacttcgcccctgatctggttttcaatgagtaccgcatgcacaagtcccggatgtacagccagtgtgtccgaatgaggcacctctctcaagagtttggatggctccaaatcaccccccaggaattcctgtgcatgaaagcactgctactcttcagcattattccagtggatgggctgaaaaatcaaaaattctttgatgaacttcgaatgaactacatcaaggaactcgatcgtatcattgcatgcaaaagaaaaaatcccacatcctgctcaagacgcttctaccagctcaccaagctcctggactccgtgcagcctattgcgagagagctgcatcagttcacttttgacctgctaatcaagtcacacatggtgagcgtggactttccggaaatgatggcagagatcatctctgtgcaagtgcccaagatcctttctgggaaagtcaagcccatctatttccacacccagtgaagcattggaaaccctatttccccaccccagctcatgccccctttcagatgtcttctgcctgttataactctgcactactcctctgcagtgccttggggaatttcctctattgatgtacagtctgtcatgaacatgttcctgaattctatttgctgggctttttttttctctttctctcctttctttttcttcttccctccctatctaaccctcccatggcaccttcagactttgcttcccattgtggctcctatctgtgttttgaatggtgttgtatgcctttaaatctgtgatgatcctcatatggcccagtgtcaagttgtgcttgtttacagcactactctgtgccagccacacaaacgtttacttatcttatgccacgggaagtttagagagctaagattatctggggaaatcaaaacaaaaaacaagcaaacaaaaaaaaaa

SEQ ID NO: 419 - DNA, 1560 bp, Homo sapiens
  ref <308>: DATABASE ACCESSION NUMBER: NM_000050
  ref <309>: DATABASE ENTRY DATE: 2001-06-18
cgagcccgagtggttcactgcactgtgaaaacagattccagacgccgggaactcacgcctccaatcccagacgctatgtccagcaaaggctccgtggttctggcctacagtggcggcctggacacctcgtgcatcctcgtgtggctgaaggaacaaggctatgacgtcattgcctatctggccaacattggccagaaggaagacttcgaggaagccaggaagaaggcactgaagcttggggccaaaaaggtgttcattgaggatgtcagcagggagtttgtggaggagttcatctggccggccatccagtccagcgcactgtatgaggaccgctacctcctgggcacctctcttgccaggccctgcatcgcccgcaaacaagtggaaatcgcccagcgggagggggccaagtatgtgtcccacggcgccacaggaaaggggaacgatcaggtccggtttgagctcagctgctactcactggccccccagataaaggtcattgctccctggaggatgcctgaattctacaaccggttcaagggccgcaatgacctgatggagtacgcaaagcaacacgggattcccatcccggtcactcccaagaacccgtggagcatggatgagaacctcatgcacatcagctacgaggctggaatcctggagaaccccaagaaccaagcgcctccaggtctctacacgaagacccaggacccagccaaagcccccaacacccctgacattctcgagatcgagttcaaaaaaggggtccctgtgaaggtgaccaacgtcaaggatggcaccacccaccagacctccttggagctcttcatgtacctgaacgaagtcgcgggcaagcatggcgtgggccgtattgacatcgtggagaaccgcttcattggaatgaagtcccgaggtatctacgagaccccagcaggcaccatcctttaccatgctcatttagacatcgaggccttcaccatggaccgggaagtgcgcaaaatcaaacaaggcctgggcttgaaatttgctgagctggtgtataccggtttacggcctagccctgagtgtgaatttgtccgccactgcatcgccaagtcccaggagcgagtggaagggaaagtgcaggtgtccgtcctcaagggccaggtgtacatcctcggccgggagtccccactgtctctctacaatgaggagctggtgagcatgaacgtgcagggtgattatgagccaactgatgccaccgggttcatcaacatcaattccctcaggctgaaggaatatcatcgtctccagagcaaggtcactgccaaatagacccgtgtacaatgaggagctggggcctcctcaatttgcagatcccccaagtacaggcgctaattgttgtgataatttgtaattgtgacttgttctccccggctggcagcgtagtggggctgccaggccccagctttgttccctggtccccctgaagcctgcaaacgttgtcatcgaagggaagggtggggggcagctgcggtggggagctataaaaatgacaattaaaagagaaaaaaaaaaaaa

SEQ ID NO: 420 - DNA, 4437 bp, Homo sapiens
  ref <308>: DATABASE ACCESSION NUMBER: NM_000057
  ref <309>: DATABASE ENTRY DATE: 2001-06-18
gcgcggcggccgtggttgcggcgcgggaagtttggatcctggttccgtccgctaggagtctgcgtgcgaggattatggctgctgttcctcaaaataatctacaggagcaactagaacgtcactcagccagaacacttaataataaattaagtctttcaaaaccaaaattttcaggtttcacttttaaaaagaaaacatcttcagataacaatgtatctgtaactaatgtgtcagtagcaaaaacacctgtattaagaaataaagatgttaatgttaccgaagacttttccttcagtgaacctctacccaacaccacaaatcagcaaagggtcaaggacttctttaaaaatgctccagcaggacaggaaacacagagaggtggatcaaaatcattattgccagatttcttgcagactccgaaggaagttgtatgcactacccaaaacacaccaactgtaaagaaatcccgggatactgctctcaagaaattagaatttagttcttcaccagattctttaagtaccatcaatgattgggatgatatggatgactttgatacttctgagacttcaaaatcatttgttacaccaccccaaagtcactttgtaagagtaagcactgctcagaaatcaaaaaagggtaagagaaacttttttaaagcacagctttatacaacaaacacagtaaagactgatttgcctccaccctcctctgaaagcgagcaaatagatttgactgaggaacagaaggatgactcagaatggttaagcagcgatgtgatttgcatcgatgatggccccattgctgaagtgcatataaatgaagatgctcaggaaagtgactctctgaaaactcatttggaagatgaaagagataatagcgaaaagaagaagaatttggaagaagctgaattacattcaactgagaaagttccatgtattgaatttgatgatgatgattatgatacggattttgttccaccttctccagaagaaattatttctgcttcttcttcctcttcaaaatgccttagtacgttaaaggaccttgacacatctgacagaaaagaggatgttcttagcacatcaaaagatcttttgtcaaaacctgagaaaatgagtatgcaggagctgaatccagaaaccagcacagactgtgacgctagacagataagtttacagcagcagcttattcatgtgatggagcacatctgtaaattaattgatactattcctgatgataaactgaaacttttggattgtgggaacgaactgcttcagcagcggaacataagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtcggccaattaaatcagtatcagaaagactttcctcagccaagacagactgtcttccagtgtcatctactgctcaaaatataaacttctcagagtcaattcagaattatactgacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggaggtggtaagagtttgtgttaccagctccctgcctgtgtttctcctggggtcactgttgtcatttctcccttgagatcacttatcgtagatcaagtccaaaagctgacttccttggatattccagctacatatctgacaggtgataagactgactcagaagctacaaatatttacctccagttatcaaaaaaagacccaatcataaaacttctatatgtcactccagaaaagatctgtgcaagtaacagactcatttctactctggagaatctctatgagaggaagctcttggcacgttttgttattgatgaagcacattgtgtcagtcagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtttagcatgagctttaacagacataatctgaaatactatgtattaccgaaaaagcctaaaaaggtggcatttgattgcctagaatggatcagaaagcaccacccatatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgatggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttggggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcagaatctttatcttctgatcctgaggttttgcttcaaattgatggtgttactgaagacaaactggaaaaatatggtgcggaagtgatttcagtattacagaaatactctgaatggacatcgccagctgaagacagttccccagggataagcctgtccagcagcagaggccccggaagaagtgccgctgaggagcttgacgaggaaatacccgtatcttcccactactttgcaagtaaaaccagaaatgaaaggaagaggaaaaagatgccagcctcccaaaggtctaagaggagaaaaactgcttccagtggttccaaggcaaagggggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataaagctgttattcttgttataccaaaaaaaaaaaaaaaaaaaaa

SEQ ID NO: 421 - DNA, 2016 bp, Homo sapiens
  ref <308>: DATABASE ACCESSION NUMBER: NM_000060
  ref <309>: DATABASE ENTRY DATE: 2001-06-18
gccagctggagcgttttcggggctgtaaagggagaatggcgcatgcgcatattcagggcggaaggcgcgctaagagcagatttgtggtctgcattatgtctggagccagaagtaagcttgctcttttcctctgcggctgttacgtggttgccctgggagcccacaccggggaggagagcgtggctgaccatcacgaggctgaatattatgtggctgccgtgtatgagcatccatccatcctgagtctgaaccctctggctctcatcagccgccaagaggccttggagctcatgaaccagaaccttgacatctatgaacagcaagtgatgactgcagcccaaaaggatgtacagattatagtgtttccagaagatggcattcatggattcaactttacaagaacatccatttatccatttttggacttcatgccgtctccccaggtggtcaggtggaacccatgcctggagcctcaccgcttcaatgacacagaggtgctccagcgcctgagttgtatggccatcaggggagatatgttcttggtggccaatcttgggacaaaggagccttgtcatagcagtgacccaaggtgcccaaaagatgggagataccagttcaacacaaatgtcgtgttcagcaataatggaacccttgttgaccgctaccgtaaacacaacctctactttgaggcagcattcgatgttcctcttaaagtggatctcatcacctttgataccccctttgctggcaggtttggcatcttcacatgctttgatatattgttctttgaccctgccatcagagtcctcagagactacaaggtgaagcatgttgtgtacccaactgcctggatgaaccagctcccactcttggcagcaattgagattcagaaagcttttgctgttgcctttggcatcaacgttctggcagctaatgtccaccacccagttctggggatgacaggaagtggcatacacacccctctggagtccttttggtaccatgacatggaaaatcccaaaagtcaccttataattgcccaggtggccaaaaatccagtgggtctcattggtgcagagaatgcaacaggtgaaacggacccatcccatagtaagtttttaaaaattttgtcaggcgatccgtactgtgagaaggatgctcaggaagtccactgtgatgaggccaccaagtggaacgtgaatgctcctcccacatttcactctgagatgatgtatgacaatttcaccctggtccctgtctggggaaaggaaggctatctccacgtctgttccaatggcctctgctgttatttactttacgagaggcccaccttatccaaagagctgtatgccctgggggtctttgatgggcttcacacagtacatggcacttactacatccaagtgtgtgccctggtcaggtgtgggggtcttggcttcgacacctgcggacaggaaatcacagaggccacggggatatttgagtttcacctgtggggcaacttcagtacttcctatatctttcctttgtttctgacctcagggatgaccctagaagtccctgaccagcttggctgggagaatgaccactatttcctgaggaaaagtaggctgtcctctgggctggtgacggcggctctctatgggcgcttgtatgagagggactaggaaaagtgtgtggtctgtggggcggactctggccatcatgttgacagccttgcacttccacaggctacaagccctgggaccatctttctgccttaagggcaggagcccacttctgtggcaccagattccaccctgggaactgtggaaaaagtaggagaggcagattccctcagtgtcttcctcttaaacctcaatcatcgagacattagggggtattttctgttcacatttatctttttcaagccacatcttcctctaacaaatctctcagtatgcgattggtctcaagctaaaacaaaaataaatgtcagtttatattttacacatccaaaaaaaaaaaaaaaaaaaa

SEQ ID NO: 422 - DNA, 5067 bp, Homo sapiens
  ref <308>: DATABASE ACCESSION NUMBER: NM_000064
  ref <309>: DATABASE ENTRY DATE: 2001-06-18
ctcctccccatcctctccctctgtccctctgtccctctgaccctgcactgtcccagcaccatgggacccacctcaggtcccagcctgctgctcctgctactaacccacctccccctggctctggggagtcccatgtactctatcatcacccccaacatcttgcggctggagagcgaggagaccatggtgctggaggcccacgacgcgcaaggggatgttccagtcactgttactgtccacgacttcccaggcaaaaaactagtgctgtccagtgagaagactgtgctgacccctgccaccaaccacatgggcaacgtcaccttcacgatcccagccaacagggagttcaagtcagaaaaggggcgcaacaagttcgtgaccgtgcaggccaccttcgggacccaagtggtggagaaggtggtgctggtcagcctgcagagcgggtacctcttcatccagacagacaagaccatctacacccctggctccacagttctctatcggatcttcaccgtcaaccacaagctgctacccgtgggccggacggtcatggtcaacattgagaacccggaaggcatcccggtcaagcaggactccttgtcttctcagaaccagcttggcgtcttgcccttgtcttgggacattccggaactcgtcaacatgggccagtggaagatccgagcctactatgaaaactcaccacagcaggtcttctccactgagtttgaggtgaaggagtacgtgctgcccagtttcgaggtcatagtggagcctacagagaaattctactacatctataacgagaagggcctggaggtcaccatcaccgccaggttcctctacgggaagaaagtggagggaactgcctttgtcatcttcgggatccaggatggcgaacagaggatttccctgcctgaatccctcaagcgcattccgattgaggatggctcgggggaggttgtgctgagccggaaggtactgctggacggggtgcagaacctccgagcagaagacctggtggggaagtctttgtacgtgtctgccaccgtcatcttgcactcaggcagtgacatggtgcaggcagagcgcagcgggatccccatcgtgacctctccctaccagatccacttcaccaagacacccaagtacttcaaaccaggaatgccctttgacctcatggtgttcgtgacgaaccctgatggctctccagcctaccgagtccccgtggcagtccagggcgaggacactgtgcagtctctaacccagggagatggcgtggccaaactcagcatcaacacacaccccagccagaagcccttgagcatcacggtgcgcacgaagaagcaggagctctcggaggcagagcaggctaccaggaccatgcaggctctgccctacagcaccgtgggcaactccaacaattacctgcatctctcagtgctacgtacagagctcagacccggggagaccctcaacgtcaacttcctcctgcgaatggaccgcgcccacgaggccaagatccgctactacacctacctgatcatgaacaagggcaggctgttgaaggcgggacgccaggtgcgagagcccggccaggacctggtggtgctgcccctgtccatcaccaccgacttcatcccttccttccgcctggtggcgtactacacgctgatcggtgccagcggccagagggaggtggtggccgactccgtgtgggtggacgtcaaggactcctgcgtgggctcgctggtggtaaaaagcggccagtcagaagaccggcagcctgtacctgggcagcagatgaccctgaagatagagggtgaccacggggcccgggtggtactggtggccgtggacaagggcgtgttcgtgctgaataagaagaacaaactgacgcagagtaagatctgggacgtggtggagaaggcagacatcggctgcaccccgggcagtgggaaggattacgccggtgtcttctccgacgcagggctgaccttcacgagcagcagtggccagcagaccgcccagagggcagaacttcagtgcccgcagccagccgcccgccgacgccgttccgtgcagctcacggagaagcgaatggacaaagtcggcaagtaccccaaggagctgcgcaagtgctgcgaggacggcatgcgggagaaccccatgaggttctcgtgccagcgccggacccgtttcatctccctgggcgaggcgtgcaagaaggtcttcctggactgctgcaactacatcacagagctgcggcggcagcacgcgcgggccagccacctgggcctggccaggagtaacctggatgaggacatcattgcagaagagaacatcgtttcccgaagtgagttcccagagagctggctgtggaacgttgaggacttgaaagagccaccgaaaaatggaatctctacgaagctcatgaatatatttttgaaagactccatcaccacgtgggagattctggctgtcagcatgtcggacaagaaagggatctgtgtggcagaccccttcgaggtcacagtaatgcaggacttcttcatcgacctgcggctaccctactctgttgttcgaaacgagcaggtggaaatccgagccgttctctacaattaccggcagaaccaagagctcaaggtgagggtggaactactccacaatccagccttctgcagcctggccaccaccaagaggcgtcaccagcagaccgtaaccatcccccccaagtcctcgttgtccgttccatatgtcatcgtgccgctaaagaccggcctgcaggaagtggaagtcaaggctgccgtctaccatcatttcatcagtgacggtgtcaggaagtccctgaaggtcgtgccggaaggaatcagaatgaacaaaactgtggctgttcgcaccctggatccagaacgcctgggccgtgaaggagtgcagaaagaggacatcccacctgcagacctcagtgaccaagtcccggacaccgagtctgagaccagaattctcctgcaagggaccccagtggcccagatgacagaggatgccgtcgacgcggaacggctgaagcacctcattgtgaccccctcgggctgcggggaacagaacatgatcggcatgacgcccacggtcatcgctgtgcattacctggatgaaacggagcagtgggagaagttcggcctagagaagcggcagggggccttggagctcatcaagaaggggtacacccagcagctggccttcagacaacccagctctgcctttgcggccttcgtgaaacgggcacccagcacctggctgaccgcctacgtggtcaaggtcttctctctggctgtcaacctcatcgccatcgactcccaagtcctctgcggggctgttaaatggctgatcctggagaagcagaagcccgacggggtcttccaggaggatgcgcccgtgatacaccaagaaatgattggtggattacggaacaacaacgagaaagacatggccctcacggcctttgttctcatctcgctgcaggaggctaaagatatttgcgaggagcaggtcaacagcctgccaggcagcatcactaaagcaggagacttccttgaagccaactacatgaacctacagagatcctacactgtggccattgctggctatgctctggcccagatgggcaggctgaaggggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcc

SEQ ID NO: 423 - DNA, 1551 bp, Homo sapiens
  ref <308>: DATABASE ACCESSION NUMBER: NM_000067
  ref <309>: DATABASE ENTRY DATE: 2001-06-18
ggcgcccaagccgccgccgccagatcggtgccgattcctgccctgccccgaccgccagcgcgaccatgtcccatcactgggggtacggcaaacacaacggacctgagcactggcataaggacttccccattgccaagggagagcgccagtcccctgttgacatcgacactcatacagccaagtatgacccttccctgaagcccctgtctgtttcctatgatcaagcaacttccctgaggatcctcaacaatggtcatgctttcaacgtggagtttgatgactctcaggacaaagcagtgctcaagggaggacccctggatggcacttacagattgattcagtttcactttcactggggttcacttgatggacaaggttcagagcatactgtggataaaaagaaatatgctgcagaacttcacttggttcactggaacaccaaatatggggattttgggaaagctgtgcagcaacctgatggactggccgttctaggtatttttttgaaggttggcagcgctaaaccgggccttcagaaagttgttgatgtgctggattccattaaaacaaagggcaagagtgctgacttcactaacttcgatcctcgtggcctccttcctgaatccctggattactggacctacccaggctcactgaccacccctcctcttctggaatgtgtgacctggattgtgctcaaggaacccatcagcgtcagcagcgagcaggtgttgaaattccgtaaacttaacttcaatggggagggtgaacccgaagaactgatggtggacaactggcgcccagctcagccactgaagaacaggcaaatcaaagcttccttcaaataagatggtcccatagtctgtatccaaataatgaatcttcgggtgtttccctttagctaagcacagatctaccttggtgatttggaccctggttgctttgtgtctagttttctagacccttcatctcttacttgatagacttactaataaaatgtgaagactagaccaattgtcatgcttgacacaactgctgtggctggttggtgctttgtttatggtagtagtttttctgtaacacagaatataggataagaaataagaataaagtaccttgactttgttcacagcatgtagggtgatgagcactcacaattgttgactaaaatgctgcttttaaaacataggaaagtagaatggttgagtgcaaatccatagcacaagataaattgagctagttaaggcaaatcaggtaaaatagtcatgattctatgtaatgtaaaccagaaaaaataaatgttcatgatttcaagatgttatattaaagaaaaactttaaaaattattatatatttatagcaaagttatcttaaatatgaattctgttgtaatttaatgacttttgaattacagagatataaatgaagtattatctgtaaaaattgttataattagagttgtgatacagagtatatttccattcagacaatatatcataacttaataaatattgtattttagatatattctctaataaaattcagaattct

SEQ ID NO: 424 - DNA, 822 bp, Homo sapiens
  ref <308>: DATABASE ACCESSION NUMBER: NM_000073
  ref <309>: DATABASE ENTRY DATE: 2001-06-18
gggctgctccacgcttttgccggagacagagactgacatggaacaggggaagggcctggctgtcctcatcctggctatcattcttcttcaaggtactttggcccagtcaatcaaaggaaaccacttggttaaggtgtatgactatcaagaagatggttcggtacttctgacttgtgatgcagaagccaaaaatatcacatggtttaaagatgggaagatgatcggcttcctaactgaagataaaaaaaaatggaatctgggaagtaatgccaaggaccctcgagggatgtatcagtgtaaaggatcacagaacaagtcaaaaccactccaagtgtattacagaatgtgtcagaactgcattgaactaaatgcagccaccatatctggctttctctttgctgaaatcgtcagcattttcgtccttgctgttggggtctacttcattgctggacaggatggagttcgccagtcgagagcttcagacaagcagactctgttgcccaatgaccagctctaccagcccctcaaggatcgagaagatgaccagtacagccaccttcaaggaaaccagttgaggaggaattgaactcaggactcagagtagtccaggtgttctcctcctattcagttcccagaatcaaagcaatgcattttggaaagctcctagcagagagactttcagccctaaatctagactcaaggttcccagagatgacaaatggagaagaaaggccatcagagcaaatttgggggtttctcaaataaaataaaaataaaaacaaatactgtgtttcagaagcgccacctattggggaaaattgt

SEQ ID NO: 425 - DNA, 987 bp, Homo sapiens
  ref <308>: DATABASE ACCESSION NUMBER: NM_000077
  ref <309>: DATABASE ENTRY DATE: 2001-06-18
cggagagggggagaacagacaacgggcggcggggagcagcatggagccggcggcggggagcagcatggagccttcggctgactggctggccacggccgcggcccggggtcgggtagaggaggtgcgggcgctgctggaggcgggggcgctgcccaacgcaccgaatagttacggtcggaggccgatccaggtcatgatgatgggcagcgcccgagtggcggagctgctgctgctccacggcgcggagcccaactgcgccgaccccgccactctcacccgacccgtgcacgacgctgcccgggagggcttcctggacacgctggtggtgctgcaccgggccggggcgcggctggacgtgcgcgatgcctggggccgtctgcccgtggacctggctgaggagctgggccatcgcgatgtcgcacggtacctgcgcgcggctgcggggggcaccagaggcagtaaccatgcccgcatagatgccgcggaaggtccctcagacatccccgattgaaagaaccagagaggctctgagaaacctcgggaaacttagatcatcagtcaccgaaggtcctacagggccacaactgcccccgccacaacccaccccgctttcgtagttttcatttagaaaatagagcttttaaaaatgtcctgccttttaacgtagatataagccttcccccactaccgtaaatgtccatttatatcattttttatatattcttataaaaatgtaaaaaagaaaaacaccgcttctgccttttcactgtgttggagttttctggagtgagcactcacgccctaagcgcacattcatgtgggcatttcttgcgagcctcgcagcctccggaagctgtcgacttcatgacaagcattttgtgaactagggaagctcaggggggttactggcttctcttgagtcacactgctagcaaatggcagaaccaaagctcaaataaaaataaaataattttcattcattcactc

SEQ ID NO: 426 - DNA, 1689 bp, Homo sapiens
  ref <308>: DATABASE ACCESSION NUMBER: NM_000086
  ref <309>: DATABASE ENTRY DATE: 2001-06-18
cccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggggaggagaccgtcccggagccccggctccctctgttggaccatcagggcgcgcattggaagaacgcggtgggcttctggctgctgggcctttgcaacaacttctcttatgtggtgatgctgagtgccgcccacgacatccttagccacaagaggacatcgggaaaccagagccatgtggacccaggcccaacgccgatcccccacaacagctcatcacgatttgactgcaactctgtctctacggctgctgtgctcctggcggacatcctccccacactcgtcatcaaattgttggctcctcttggccttcacctgctgccctacagcccccgggttctcgtcagtgggatttgtgctgctggaagcttcgtcctggttgccttttctcattctgtggggaccagcctgtgtggtgtggtcttcgctagcatctcatcaggccttggggaggtcaccttcctctccctcactgccttctaccccagggccgtgatctcctggtggtcctcagggactgggggagctgggctgctgggggccctgtcctacctgggcctcacccaggccggcctctcccctcagcagaccctgctgtccatgctgggtatccctgccctgctgctggccagctatttcttgttgctcacatctcctgaggcccaggaccctggaggggaagaagaagcagagagcgcagcccggcagcccctcataagaaccgaggccccggagtcgaagccaggctccagctccagcctctcccttcgggaaaggtggacagtattcaagggtctgctgtggtacattgttcccttggtcgtagtttactttgccgagtatttcattaaccagggactttttgaactcctctttttctggaacacttccctgagtcacgctcagcaataccgctggtaccagatgctgtaccaggctggcgtctttgcctcccgctcttctctccgctgctgtcgcatccgtttcacctgggccctggccctgctgcagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttccttgcaggggggccagccattgtctcccacttggggagtttcttcctggcatcatgccttctgaataaatgccgattttgtccatgg

SEQ ID NO: 427 - DNA, 2500 bp, Homo sapiens
  ref <308>: DATABASE ACCESSION NUMBER: NM_000087
  ref <309>: DATABASE ENTRY DATE: 2001-06-18
tatattacttaaacaaccaaagatatgaaactatccatgaagaacaatattatcaatacacagcagtcttttgtaaccatgcccaatgtgattgtaccagatattgaaaaggaaatacgaaggatggaaaatggagcatgcagctccttttctgaggatgatgacagtgcctatacatctgaagaatcagagaatgaaaaccctcatgcaaggggttcctttagttataagtcactcagaaagggaggaccatcacagagggagcagtacctgcctggtgccattgccatttttaatgtgaacaacagcagcaataaggaccaggaaccagaggaaaaaaagaaaaagaaaaaagaaaagaagagcaagtcagatgataaaaacgaaaataaaaacgacccagagaagaaaaagaagaaaaaggacaaagagaagaaaaagaaagaggagaaaagcaaagataagaaagaacaccacaagaaagaagttgtggttattgatccctcgggaaacacatattacaactggctgttttgcatcacattacctgttatgtacaactggacaatggttattgccagagcatgttttgatgaacttcaatctgattacctagaatattggctcattttggattacgtatcagacatagtctatttaatcgatatgtttgtacgaacaaggacaggttacctagaacaaggactgctggtaaaggaagaacttaaactcataaataaatataaatccaacttgcaatttaaacttgatgttctgtcactgataccaactgatttgctgtattttaagttagggtggaactatccagaaattagattaaacaggttgttacggttctctcgtatgtttgagttcttccagagaacagaaacaaggacaaactatccaaacatcttcaggatttccaaccttgttatgtatatcgtcatcattatccactggaatgcatgtgtgttctactctatttctaaagctattggatttggaaatgatacatgggtctaccctgatattaatgatcctgaatttggccgtttggctagaaaatacgtatacagcctttactggtctacactgactttgactaccattggtgaaacaccccctcccgtgagggattctgagtatgtctttgtggtggttgatttcctaattggagtgttaatttttgctaccatcgttggtaacataggttctatgatttccaacatgaatgcagccagagcagaatttcaagcaagaattgatgctatcaagcaatatatgcattttcgaaatgtaagcaaagatatggaaaagagggttattaaatggtttgactacctgtggaccaacaaaaaaacagttgatgagaaagaagtcttaaagtatctacctgataaactaagagcagaaattgccatcaacgttcacttagacacattaaaaaaggtacgcatttttgctgattgtgaagctggtctgttggtggagttggtcttgaaattgcaaccccaagtctacagtcctggagattatatttgcaagaaaggggatatcggacgagagatgtacattatcaaggaaggcaaactcgctgtggtggcagatgatggagtcactcagtttgtggtattgagcgatggcagcaccttcggtgagatcagcattcttaacattaaagggagcaaagctggcaatcgaagaacggccaatattaaaagtattggctactcagacctgttctgtctctcaaaagatgacctcatggaagctctaactgagtacccagatgccaaaactatgctagaagaaaaagggaagcaaattttaatgaaagatggtctactggatctaaacattgcaaatgctggcagtgatcctaaagatcttgaagagaaggttactcgaatggaggggtcagtagacctcctgcaaaccaggtttgcccgaatcttggctgagtatgagtccatgcagcagaaactgaaacaaagattaaccaaggttgagaaatttctgaaaccgcttattgacacagaattttcaagtattgagggaccttggagcgaaagtgggcccatcgactctacatagaaccgaaaagctggtcattaacagggacatgcctcatgatccttttgatcctatgactgacatcaactaaaatttaaaagaagaggaagactcagttgggaaatttttccatgaggaaaatgtgctttggtgcaaggtacagcccacacctctctgagagatactatgattaaaaaagctttatatctgggatttttcacaactgataatgtgcaaagatataaactgattaacttgtcagtgtctgtattttctgattttttcacatacgctcattttatgtaatattcttcataaaaatgaataagtagccctcactttcatgccatttccattgttgagtgaagcgtatttgaagtaactgagaattaccatgtacatcatatttgggataacattttta

SEQ ID NO: 428 - DNA, 5460 bp, Homo sapiens
  ref <308>: DATABASE ACCESSION NUMBER: NM_000090
  ref <309>: DATABASE ENTRY DATE: 2001-06-18
cgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaagccagaaccatgccaaatatgtgtctgtgactcaggatccgttctctgcgatgacataatatgtgacgatcaagaattagactgccccaacccagaaattccatttggagaatgttgtgcagtttgcccacagcctccaactgctcctactcgccctcctaatggtcaaggacctcaaggccccaagggagatccaggccctcctggtattcctgggagaaatggtgaccctggtattccaggacaaccagggtcccctggttctcctggcccccctggaatctgtgaatcatgccctactggtcctcagaactattctccccagtatgattcatatgatgtcaagtctggagtagcagtaggaggactcgcaggctatcctggaccagctggccccccaggccctcccggtccccctggtacatctggtcatcctggttcccctggatctccaggataccaaggaccccctggtgaacctgggcaagctggtccttcaggccctccaggacctcctggtgctataggtccatctggtcctgctggaaaagatggagaatcaggtagacccggacgacctggagagcgaggattgcctggacctccaggtatcaaaggtccagctgggatacctggattccctggtatgaaaggacacagaggcttcgatggacgaaatggagaaaagggtgaaacaggtgctcctggattaaagggtgaaaatggtcttccaggcgaaaatggagctcctggacccatgggtccaagaggggctcctggtgagcgaggacggccaggacttcctggggctgcaggtgctcggggtaatgacggtgctcgaggcagtgatggtcaaccaggccctcctggtcctcctggaactgccggattccctggatcccctggtgctaagggtgaagttggacctgcagggtctcctggttcaaatggtgcccctggacaaagaggagaacctggacctcagggacacgctggtgctcaaggtcctcctggccctcctgggattaatggtagtcctggtggtaaaggcgaaatgggtcccgctggcattcctggagctcctggactgatgggagcccggggtcctccaggaccagccggtgctaatggtgctcctggactgcgaggtggtgcaggtgagcctggtaagaatggtgccaaaggagagcccggaccacgtggtgaacgcggtgaggctggtattccaggtgttccaggagctaaaggcgaagatggcaaggatggatcacctggagaacctggtgcaaatgggcttccaggagctgcaggagaaaggggtgcccctgggttccgaggacctgctggaccaaatggcatcccaggagaaaagggtcctgctggagagcgtggtgctccaggccctgcagggcccagaggagctgctggagaacctggcagagatggcgtccctggaggtccaggaatgaggggcatgcccggaagtccaggaggaccaggaagtgatgggaaaccagggcctcccggaagtcaaggagaaagtggtcgaccaggtcctcctgggccatctggtccccgaggtcagcctggtgtcatgggcttccccggtcctaaaggaaatgatggtgctcctggtaagaatggagaacgaggtggccctggaggacctggccctcagggtcctcctggaaagaatggtgaaactggacctcaaggacccccagggcctactgggcctggtggtgacaaaggagacacaggaccccctggtccacaaggattacaaggcttgcctggtacaggtggtcctccaggagaaaatggaaaacctggggaaccaggtccaaagggtgatgccggtgcacctggagctccaggaggcaagggtgatgctggtgcccctggtgaacgtggacctcctggattggcaggggccccaggacttagaggtggagctggtccccctggtcccgaaggaggaaagggtgctgctggtcctcctgggccacctggtgctgctggtactcctggtctgcaaggaatgcctggagaaagaggaggtcttggaagtcctggtccaaagggtgacaagggtgaaccaggcggcccaggtgctgatggtgtcccagggaaagatggcccaaggggtcctactggtcctattggtcctcctggcccagctggccagcctggagataagggtgaaggtggtgcccccggacttccaggtatagctggacctcgtggtagccctggtgagagaggtgaaactggccctccaggacctgctggtttccctggtgctcctggacagaatggtgaacctggtggtaaaggagaaagaggggctccgggtgagaaaggtgaaggaggccctcctggagttgcaggaccccctggaggttctggacctgctggtcctcctggtccccaaggtgtcaaaggtgaacgtggcagtcctggtggacctggtgctgctggcttccctggtgctcgtggtcttcctggtcctcctggtagtaatggtaacccaggacccccaggtcccagcggttctccaggcaaggatgggcccccaggtcctgcgggtaacactggtgctcctggcagccctggagtgtctggaccaaaaggtgatgctggccaaccaggagagaagggatcgcctggtgcccagggcccaccaggagctccaggcccacttgggattgctgggatcactggagcacggggtcttgcaggaccaccaggcatgccaggtcctaggggaagccctggccctcagggtgtcaagggtgaaagtgggaaaccaggagctaacggtctcagtggagaacgtggtccccctggaccccagggtcttcctggtctggctggtacagctggtgaacctggaagagatggaaaccctggatcagatggtcttccaggccgagatggatctcctggtggcaagggtgatcgtggtgaaaatggctctcctggtgcccctggcgctcctggtcatccaggcccacctggtcctgtcggtccagctggaaagagtggtgacagaggagaaagtggccctgctggccctgctggtgctcccggtcctgctggttcccgaggtgctcctggtcctcaaggcccacgtggtgacaaaggtgaaacaggtgaacgtggagctgctggcatcaaaggacatcgaggattccctggtaatccaggtgccccaggttctccaggccctgctggtcagcagggtgcaatcggcagtccaggacctgcaggccccagaggacctgttggacccagtggacctcctggcaaagatggaaccagtggacatccaggtcccattggaccaccagggcctcgaggtaacagaggtgaaagaggatctgagggctccccaggccacccagggcaaccaggccctcctggacctcctggtgcccctggtccttgctgtggtggtgttggagccgctgccattgctgggattggaggtgaaaaagctggcggttttgccccgtattatggagatgaaccaatggatttcaaaatcaacaccgatgagattatgacttcactcaagtctgttaatggacaaatagaaagcctcattagtcctgatggttctcgtaaaaaccccgctagaaactgcagagacctgaaattctgccatcctgaactcaagagtggagaatactgggttgaccctaaccaaggatgcaaattggatgctatcaaggtattctgtaatatggaaactggggaaacatgcataagtgccaatcctttgaatgttccacggaaacactggtggacagattctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcattgcatacatggatcaggccagtggaaatgtaaagaaggccctgaagctgatggggtcaaatgaaggtgaattcaaggctgaaggaaatagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaacactgtgttatattctttgaatcctagcccatctgcagagcaatgactgtgctcaccagtaaaagataacctttctttctgaaatagtcaaatacgaaattagaaaagccctccctattttaactacctcaactggtcagaaacacagattgtattctatgagtcccagaagatgaaaaaaattttatacgttgataaaacttataaatttcattgattaatctcctggaagattggtttaaaaagaaaagtgtaatgcaagaatttaaagaaatatttttaaagccacaattattttaatattggatatcaactgcttgtaaaggtgctcctcttttttcttgtcattgctggtcaagattactaatatttgggaaggctttaaagacgcatgttatggtgctaatgtactttcacttttaaactctagatcagaattgttgacttgcattcagaacataaatgcacaaaatctgtacatgtctcccatcagaaagattcattggcatgccacagggattctcctccttcatcctgtaaaggtcaacaataaaaaccaaattatggggctgcttttgtcacactagcatagagaatgtgttgaaatttaactttgtaagcttgtatgtggttgttgatcttttttttccttacagacacccataataaaata

SEQ ID NO: 429 - DNA, 2439 bp, Homo sapiens
  ref <308>: DATABASE ACCESSION NUMBER: NM_000095
  ref <309>: DATABASE ENTRY DATE: 2001-06-18
cagcacccagctccccgccaccgccatggtccccgacaccgcctgcgttcttctgctcaccctggctgccctcggcgcgtccggacagggccagagcccgttgggctcagacctgggcccgcagatgcttcgggaactgcaggaaaccaacgcggcgctgcaggacgtgcgggactggctgcggcagcaggtcagggagatcacgttcctgaaaaacacggtgatggagtgtgacgcgtgcgggatgcagcagtcagtacgcaccggcctacccagcgtgcggcccctgctccactgcgcgcccggcttctgcttccccggcgtggcctgcatccagacggagagcggcggccgctgcggcccctgccccgcgggcttcacgggcaacggctcgcactgcaccgacgtcaacgagtgcaacgcccacccctgcttcccccgagtccgctgtatcaacaccagcccggggttccgctgcgaggcttgcccgccggggtacagcggccccacccaccagggcgtggggctggctttcgccaaggccaacaagcaggtttgcacggacatcaacgagtgtgagaccgggcaacataactgcgtccccaactccgtgtgcatcaacacccggggctccttccagtgcggcccgtgccagcccggcttcgtgggcgaccaggcgtccggctgccagcgcggcgcacagcgcttctgccccgacggctcgcccagcgagtgccacgagcatgcagactgcgtcctagagcgcgatggctcgcggtcgtgcgtgtgtcgcgttggctgggccggcaacgggatcctctgtggtcgcgacactgacctagacggcttcccggacgagaagctgcgctgcccggagccgcagtgccgtaaggacaactgcgtgactgtgcccaactcagggcaggaggatgtggaccgcgatggcatcggagacgcctgcgatccggatgccgacggggacggggtccccaatgaaaaggacaactgcccgctggtgcggaacccagaccagcgcaacacggacgaggacaagtggggcgatgcgtgcgacaactgccggtcccagaagaacgacgaccaaaaggacacagaccaggacggccggggcgatgcgtgcgacgacgacatcgacggcgaccggatccgcaaccaggccgacaactgccctagggtacccaactcagaccagaaggacagtgatggcgatggtataggggatgcctgtgacaactgtccccagaagagcaacccggatcaggcggatgtggaccacgactttgtgggagatgcttgtgacagcgatcaagaccaggatggagacggacatcaggactctcgggacaactgtcccacggtgcctaacagtgcccaggaggactcagaccacgatggccagggtgatgcctgcgacgacgacgacgacaatgacggagtccctgacagtcgggacaactgccgcctggtgcctaaccccggccaggaggacgcggacagggacggcgtgggcgacgtgtgccaggacgactttgatgcagacaaggtggtagacaagatcgacgtgtgtccggagaacgctgaagtcacgctcaccgacttcagggccttccagacagtcgtgctggacccggagggtgacgcgcagattgaccccaactgggtggtgctcaaccagggaagggagatcgtgcagacaatgaacagcgacccaggcctggctgtgggttacactgccttcaatggcgtggacttcgagggcacgttccatgtgaacacggtcacggatgacgactatgcgggcttcatctttggctaccaggacagctccagcttctacgtggtcatgtggaagcagatggagcaaacgtattggcaggcgaaccccttccgtgctgtggccgagcctggcatccaactcaaggctgtgaagtcttccacaggccccggggaacagctgcggaacgctctgtggcatacaggagacacagagtcccaggtgcggctgctgtggaaggacccgcgaaacgtgggttggaaggacaagaagtcctatcgttggttcctgcagcaccggccccaagtgggctacatcagggtgcgattctatgagggccctgagctggtggccgacagcaacgtggtcttggacacaaccatgcggggtggccgcctgggggtcttctgcttctcccaggagaacatcatctgggccaacctgcgttaccgctgcaatgacaccatcccagaggactatgagacccatcagctgcggcaagcctagggaccagggtgaggacccgccggatgacagccaccctcaccgcggctggatgggggctctgcacccagcccaaggggtggccgtcctgagggggaagtgagaagggctcagagaggacaaaataaagtgtgtgtgcaggg

SEQ ID NO: 430 - DNA, 3321 bp, Homo sapiens
  ref <308>: DATABASE ACCESSION NUMBER: NM_000096
  ref <309>: DATABASE ENTRY DATE: 2001-06-18
atgaagattttgatacttggtatttttctgtttttatgtagtaccccagcctgggcgaaagaaaagcattattacattggaattattgaaacgacttgggattatgcctctgaccatggggaaaagaaacttatttctgttgacacggaacattccaatatctatcttcaaaatggcccagatagaattgggagactatataagaaggccctttatcttcagtacacagatgaaacctttaggacaactatagaaaaaccggtctggcttgggtttttaggccctattatcaaagctgaaactggagataaagtttatgtacacttaaaaaaccttgcctctaggccctacacctttcattcacatggaataacttactataaggaacatgagggggccatctaccctgataacaccacagattttcaaagagcagatgacaaagtatatccaggagagcagtatacatacatgttgcttgccactgaagaacaaagtcctggggaaggagatggcaattgtgtgactaggatttaccattcccacattgatgctccaaaagatattgcctcaggactcatcggacctttaataatctgtaaaaaagattctctagataaagaaaaagaaaaacatattgaccgagaatttgtggtgatgttttctgtggtggatgaaaatttcagctggtacctagaagacaacattaaaacctactgctcagaaccagagaaagttgacaaagacaacgaagacttccaggagagtaacagaatgtattctgtgaatggatacacttttggaagtctcccaggactctccatgtgtgctgaagacagagtaaaatggtacctttttggtatgggtaatgaagttgatgtgcacgcagctttctttcacgggcaagcactgactaacaagaactaccgtattgacacaatcaacctctttcctgctaccctgtttgatgcttatatggtggcccagaaccctggagaatggatgctcagctgtcagaatctaaaccatctgaaagccggtttgcaagcctttttccaggtccaggagtgtaacaagtcttcatcaaaggataatatccgtgggaagcatgttagacactactacattgccgctgaggaaatcatctggaactatgctccctctggtatagacatcttcactaaagaaaacttaacagcacctggaagtgactcagcggtgttttttgaacaaggtaccacaagaattggaggctcttataaaaagctggtttatcgtgagtacacagatgcctccttcacaaatcgaaaggagagaggccctgaagaagagcatcttggcatcctgggtcctgtcatttgggcagaggtgggagacaccatcagagtaaccttccataacaaaggagcatatcccctcagtattgagccgattggggtgagattcaataagaacaacgagggcacatactattccccaaattacaacccccagagcagaagtgtgcctccttcagcctcccatgtggcacccacagaaacattcacctatgaatggactgtccccaaagaagtaggacccactaatgcagatcctgtgtgtctagctaagatgtattattctgctgtggatcccactaaagatatattcactgggcttattgggccaatgaaaatatgcaagaaaggaagtttacatgcaaatgggagacagaaagatgtagacaaggaattctatttgtttcctacagtatttgatgagaatgagagtttactcctggaagataatattagaatgtttacaactgcacctgatcaggtggataaggaagatgaagactttcaggaatctaataaaatgcactccatgaatggattcatgtatgggaatcagccgggtctcactatgtgcaaaggagattcggtcgtgtggtacttattcagcgccggaaatgaggccgatgtacatggaatatacttttcaggaaacacatatctgtggagaggagaacggagagacacagcaaacctcttccctcaaacaagtcttacgctccacatgtggcctgacacagaggggacttttaatgttgaatgccttacaactgatcattacacaggcggcatgaagcaaaaatatactgtgaaccaatgcaggcggcagtctgaggattccaccttctacctgggagagaggacatactatatcgcagcagtggaggtggaatgggattattccccacaaagggagtgggaaaaggagctgcatcatttacaagagcagaatgtttcaaatgcatttttagataagggagagttttacataggctcaaagtacaagaaagttgtgtatcggcagtatactgatagcacattccgtgttccagtggagagaaaagctgaagaagaacatctgggaattctaggtccacaacttcatgcagatgttggagacaaagtcaaaattatctttaaaaacatggccacaaggccctactcaatacatgcccatggggtacaaacagagagttctacagttactccaacattaccaggtgaaactctcacttacgtatggaaaatcccagaaagatctggagctggaacagaggattctgcttgtattccatgggcttattattcaactgtggatcaagttaaggacctctacagtggattaattggccccctgattgtttgtcgaagaccttacttgaaagtattcaatcccagaaggaagctggaatttgcccttctgtttctagtttttgatgagaatgaatcttggtacttagatgacaacatcaaaacatactctgatcaccccgagaaagtaaacaaagatgatgaggaattcatagaaagcaataaaatgcatgctattaatggaagaatgtttggaaacctacaaggcctcacaatgcacgtgggagatgaagtcaactggtatctgatgggaatgggcaatgaaatagacttacacactgtacattttcacggccatagcttccaatacaagcacaggggagtttatagttctgatgtctttgacattttccctggaacataccaaaccctagaaatgtttccaagaacacctggaatttggttactccactgccatgtgaccgaccacattcatgctggaatggaaaccacttacaccgttctacaaaatgaagacaccaaatctggctgaatgaaataaattggtgataagtggaaaaaagagaaaaaccaatgattcataacaatgtatgtgaaagtgtaaaatagaatgttactttggaatgactataaacattaaaagagactggagcat

SEQ ID NO: 431 - DNA, 643 bp, Homo sapiens
  ref <308>: DATABASE ACCESSION NUMBER: NM_000100
  ref <309>: DATABASE ENTRY DATE: 2001-06-18
cccgcgcgtcacgtgaccccagcgcctacttgggctgaggagccgccgcgtcccctcgccgagtcccctcgccagattccctccgtcgccgccaagatgatgtgcggggcgccctccgccacgcagccggccaccgccgagacccagcacatcgccgaccaggtgaggtcccagcttgaagagaaagaaaacaagaagttccctgtgtttaaggccgtgtcattcaagagccaggtggtcgcggggacaaactacttcatcaaggtgcacgtcggcgacgaggacttcgtacacctgcgagtgttccaatctctccctcatgaaaacaagcccttgaccttatctaactaccagaccaacaaagccaagcatgatgagctgacctatttctgatcctgactttggacaaggcccttcagccagaagactgacaaagtcatcctccgtctaccagagcgtgcacttgtgatcctaaaataagcttcatctccgctgtgcccttggggtggaaggggcaggattctgcagctgcttttgcatttctcttcctaaatttcattgtgttgatttctttccttcccaataggtgatcttaattactttcagaatattttcaaaatagatatatttttaaaatccttac

SEQ ID NO: 432 - DNA, 687 bp, Homo sapiens
  ref <308>: DATABASE ACCESSION NUMBER: NM_000101
  ref <309>: DATABASE ENTRY DATE: 2001-06-18
gcagtgtcccagccgggttcgtgtcgccatggggcagatcgagtgggccatgtgggccaacgagcaggcgctggcgtccggcctgatcctcatcaccgggggcatcgtggccacagctgggcgcttcacccagtggtactttggtgcctactccattgtggcgggcgtgtttgtgtgcctgctggagtacccccgggggaagaggaagaagggctccaccatggagcgctggggacagaagcacatgaccgccgtggtgaagctgttcgggccctttaccaggaattactatgttcgggccgtcctgcatctcctgctctcggtgcccgccggcttcctgctggccaccatccttgggaccgcctgcctggccattgcgagcggcatctacctactggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggcggcggcggggggacccccgggaggtccccaggtcaaccccatcccggtgaccgacgaggtcgtgtgacctcgccccggacctgccctcccaccaggtgcacccacctgcaataaacgcagcgaaggccgggaaaaaaa

SEQ ID NO: 433 - DNA, 5128 bp, Homo sapiens
  ref <308>: DATABASE ACCESSION NUMBER: NM_000104
  ref <309>: DATABASE ENTRY DATE: 2001-06-18
actctggagtgggagtgggagcgagcgcttctgcgactccagttgtgagagccgcaagggcatgggaattgacgccactcaccgacccccagtctcaatctcaacgctgtgaggaaacctcgactttgccaggtccccaagggcagcggggctcggcgagcgaggcacccttctccgtccccatcccaatccaagcgctcctggcactgacgacgccaagagactcgagtgggagttaaagcttccagtgagggcagcaggtgtccaggccgggcctgcgggttcctgttgacgtcttgccctaggcaaaggtcccagttccttctcggagccggctgtcccgcgccactggaaaccgcacctccccgcagcatgggcaccagcctcagcccgaacgacccttggccgctaaacccgctgtccatccagcagaccacgctcctgctactcctgtcggtgctggccactgtgcatgtgggccagcggctgctgaggcaacggaggcggcagctccggtccgcgcccccgggcccgtttgcgtggccactgatcggaaacgcggcggcggtgggccaggcggctcacctctcgttcgctcgcctggcgcggcgctacggcgacgttttccagatccgcctgggcagctgccccatagtggtgctgaatggcgagcgcgccatccaccaggccctggtgcagcagggctcggccttcgccgaccggccggccttcgcctccttccgtgtggtgtccggcggccgcagcatggctttcggccactactcggagcactggaaggtgcagcggcgcgcagcccacagcatgatgcgcaacttcttcacgcgccagccgcgcagccgccaagtcctcgagggccacgtgctgagcgaggcgcgcgagctggtggcgctgctggtgcgcggcagcgcggacggcgccttcctcgacccgaggccgctgaccgtcgtggccgtggccaacgtcatgagtgccgtgtgtttcggctgccgctacagccacgacgaccccgagttccgtgagctgctcagccacaacgaagagttcgggcgcacggtgggcgcgggcagcctggtggacgtgatgccctggctgcagtacttccccaacccggtgcgcaccgttttccgcgaattcgagcagctcaaccgcaacttcagcaacttcatcctggacaagttcttgaggcactgcgaaagccttcggcccggggccgccccccgcgacatgatggacgcctttatcctctctgcggaaaagaaggcggccggggactcgcacggtggtggcgcgcggctggatttggagaacgtaccggccactatcactgacatcttcggcgccagccaggacaccctgtccaccgcgctgcagtggctgctcctcctcttcaccaggtatcctgatgtgcagactcgagtgcaggcagaattggatcaggtcgtggggagggaccgtctgccttgtatgggtgaccagcccaacctgccctatgtcctggccttcctttatgaagccatgcgcttctccagctttgtgcctgtcactattcctcatgccaccactgccaacacctctgtcttgggctaccacattcccaaggacactgtggtttttgtcaaccagtggtctgtgaatcatgacccagtgaagtggcctaacccggagaactttgatccagctcgattcttggacaaggatggcctcatcaacaaggacctgaccagcagagtgatgattttttcagtgggcaaaaggcggtgcattggcgaagaactttctaagatgcagctttttctcttcatctccatcctggctcaccagtgcgatttcagggccaacccaaatgagcctgcgaaaatgaatttcagttatggtctaaccattaaacccaagtcatttaaagtcaatgtcactctcagagagtccatggagctccttgatagtgctgtccaaaatttacaagccaaggaaacttgccaataagaagcaagaggcaagctgaaattttagaaatattcacatcttcggagatgaggagtaaaattcagtttttttccagttcctcttttgtgctgcttctcaattagcgtttaaggtgagcataaatcaactgtccatcaggtgaggtgtgctccatacccagcggttcttcatgagtagtgggctatgcaggagcttctgggagatttttttgagtcaaagacttaaagggcccaatgaattattatatacatactgcatcttggttatttctgaaggtagcattctttggagttaaaatgcacatatagacacatacacccaaacacttacaccaaactactgaatgaagaagtattttggtaaccaggccatttttggtgggaatccaagattggtctcccatatgcagaaatagacaaaaagtatattaaacaaagtttcagagtatattgttgaagagacagagacaagtaatttcagtgtaaagtgtgtgattgaaggtgataagggaaaagataaagaccagaaattcccttttcaccttttcaggaaaataacttagactctagtatttatgggtggatttatccttttgccttctggtatacttccttacttttaaggataaatcataaagtcagttgctcaaaaagaaatcaatagttgaattagtgagtatagtggggttccatgagttatcatgaattttaaagtatgcattattaaattgtaaaactccaaggtgatgttgtacctcttttgcttgccaaagtacagaatttgaattatcagcaaagaaaaaaaaaaaagccagccaagctttaaattatgtgaccataatgtactgatttcagtaagtctcataggttaaaaaaaaaagtcaccaaatagtgtgaaatatattacttaactgtccgtaagcagtatattagtattatcttgttcaggaaaaggttgaataatatatgccttgtgtaatattgaaaattgaaaagtacaactaacgcaaccaagtgtgctaaaaatgagcttgattaaatcaaccacctatttttgacatggaaatgaagcagggtttcttttcttcactcaaattttggcgaatctcaaaattagatcctaagatgtgttcttatttttataacatctttattgaaattctatttataatacagaatcttgttttgaaaataacctaattaatatattaaaattccaaattcatggcatgcttaaattttaactaaattttaaagccattctgattattgagttccagttgaagttagtggaaatctgaacattctcctgtggaaggcagagaaatctaagctgtgtctgcccaatgaataatggaaaatgccatgaattacctggatgttctttttacgaggtgacaagagttggggacagaactcccattacaactgaccaagtttctcttctagatgattttttgaaagttaacattaatgcctgctttttggaaagtcagaatcagaagatagtcttggaagctgtttggaaaagacagtggagatgaggtcagttgtgttttttaagatggcaattactttggtagctgggaaagcataaagctcaaatgaaatgtatgcattcacatttagaaaagtgaattgaagtttcaagttttaaagttcattgcaattaaacttccaaagaaagttctacagtgtcctaagtgctaagtgcttattacattttattaagctttttggaatctttgtaccaaaattttaaaaaagggagtttttgatagttgtgtgtatgtgtgtgtggggtggggggatggtaagagaaaagagagaaacactgaaaagaaggaaagatggttaaacattttcccactcattctgaattaattaatttggagcacaaaattcaaagcatggacatttagaagaaagatgtttggcgtagcagagttaaatctcaaataggctattaaaaaagtctacaacatagcagatctgttttgtggtttggaatattaaaaaacttcatgtaattttattttaaaatttcatagctgtacttcttgaatataaaaaatcatgccagtatttttaaaggcattagagtcaactacacaaagcaggcttgcccagtacatttaaattttttggcacttgccattccaaaatattatgccccaccaaggctgagacagtgaatttgggctgctgtagcctatttttttagattgagaaatgtgtagctgcaaaaataatcatgaaccaatctggatgcctcattatgtcaaccaggtccagatgtgctataatctgtttttacgtatgtaggcccagtcgtcatcagatgcttgcggcaaaagaaagctgtgtttatatggaagaaagtaaggtgcttggagtttacctggcttatttaatatgcttataacctagttaaagaaaggaaaagaaaacaaaaaacgaatgaaaataactgaatttggaggctggagtaatcagattactgctttaatcagaaaccctcattgtgtttctaccggagagagaatgtatttgctgacaaccattaaagtcagaagttttactccaggttattgcaataaagtataatgtttattaaatgcttcatttgtatgtcaaagctttgactctataagcaaattgcttttttccaaaacaaaaagatgtctcaggtttgttttgtgaattttctaaaagctttcatgtcccagaacttagcctttacctgtgaagtgttactacagccttaatattttcctagtagatctatattagatcaaatagttgcatagcagtatatgttaatttgtgtgtttttagctgtgacacaactgtgtgattaaaaggtatactttagtagacatttataactcaaggataccttcttatttaatcttttcttatttttgtactttatcatgaatgcttttagtgtgtgcataatagctacagtgcatagttgtagacaaagtacattctggggaaacaacatttatatgtagcctttactgtttgatataccaaattaaaaaaaaattgtatctcattacttatactgggacaccattaccaaaataataaaaatcactttcataatcttgaaaaaa

SEQ ID NO: 434 - DNA, 14069 bp, Homo sapiens
  ref <308>: DATABASE ACCESSION NUMBER: NM_000109
  ref <309>: DATABASE ENTRY DATE: 2001-06-18
cgttaaatgcaaacgctgctctggctcatgtgtttgctccgaggtataggttttgttcgactgacgtatcagatagtcagagtggttaccacaccgacgttgtagcagctgcataataaatgactgaaagaatcatgttaggcatgcccacctaacctaacttgaatcatgcgaaaggggagctgttggaattcaaatagactttctggttcccagcagtcggcagtaatagaatgctttcaggaagatgacagaatcaggagaaagatgctgttttgcactatcttgatttgttacagcagccaacttattggcatgatggagtgacaggaaaaacagctggcatggaagatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccgagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 435 - DNA, 6450 bp, Homo sapiens
  ref <308>: DATABASE ACCESSION NUMBER: NM_000125
  ref <309>: DATABASE ENTRY DATE: 2001-06-18
gagttgtgcctggagtgatgtttaagccaatgtcagggcaaggcaacagtccctggccgtcctccagcacctttgtaatgcatatgagctcgggagaccagtacttaaagttggaggcccgggagcccaggagctggcggagggcgttcgtcctgggagctgcacttgctccgtcgggtcgccggcttcaccggaccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggccaaattcagataatcgacgccagggtggcagagaaagattggccagtaccaatgacaagggaagtatggctatggaatctgccaaggagactcgctactgtgcagtgtgcaatgactatgcttcaggctaccattatggagtctggtcctgtgagggctgcaaggccttcttcaagagaagtattcaaggacataacgactatatgtgtccagccaccaaccagtgcaccattgataaaaacaggaggaagagctgccaggcctgccggctccgcaaatgctacgaagtgggaatgatgaaaggtgggatacgaaaagaccgaagaggagggagaatgttgaaacacaagcgccagagagatgatggggagggcaggggtgaagtggggtctgctggagacatgagagctgccaacctttggccaagcccgctcatgatcaaacgctctaagaagaacagcctggccttgtccctgacggccgaccagatggtcagtgccttgttggatgctgagccccccatactctattccgagtatgatcctaccagacccttcagtgaagcttcgatgatgggcttactgaccaacctggcagacagggagctggttcacatgatcaactgggcgaagagggtgccaggctttgtggatttgaccctccatgatcaggtccaccttctagaatgtgcctggctagagatcctgatgattggtctcgtctggcgctccatggagcacccagtgaagctactgtttgctcctaacttgctcttggacaggaaccagggaaaatgtgtagagggcatggtggagatcttcgacatgctgctggctacatcatctcggttccgcatgatgaatctgcagggagaggagtttgtgtgcctcaaatctattattttgcttaattctggagtgtacacatttctgtccagcaccctgaagtctctggaagagaaggaccatatccaccgagtcctggacaagatcacagacactttgatccacctgatggccaaggcaggcctgaccctgcagcagcagcaccagcggctggcccagctcctcctcatcctctcccacatcaggcacatgagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacagtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcacttccccctataggaatacaaggggccacacagggaaggcagatcccctagttggccaagacttattttaacttgatacactgcagattcagagtgtcctgaagctctgcctctggctttccggtcatgggttccagttaattcatgcctcccatggacctatggagagcaacaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgagcacagccagacttgctcaggtggccctgcacaggctgcagctacctaggaacattccttgcagaccccgcattgcctttgggggtgccctgggatccctggggtagtccagctcttattcatttcccagcgtggccctggttggaagaagcagctgtcaagttgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtagctgctcgggcttctcttggtatgtcttgtttggaaaagtggatttcattcatttctgattgtccagttaagtgatcaccaaaggactgagaatctgggagggcaaaaaaaaaaaaaaaagtttttatgtgcacttaaatttggggacaattttatgtatctgtgttaaggatatgcttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcactaatccagatgcctattgttggatattgaatgacagacaatcttatgtagcaaagattatgcctgaaaaggaaaattattcagggcagctaattttgcttttaccaaaatatcagtagtaatatttttggacagtagctaatgggtcagtgggttctttttaatgtttatacttagattttcttttaaaaaaattaaaataaaacaaaaaaaatttctaggactagacgatgtaataccagctaaagccaaacaattatacagtggaaggttttacattattcatccaatgtgtttctattcatgttaagatactactacatttgaagtgggcagagaacatcagatgattgaaatgttcgcccaggggtctccagcaactttggaaatctctttgtatttttacttgaagtgccactaatggacagcagatattttctggctgatgttggtattgggtgtaggaacatgatttaaaaaaaaaactcttgcctctgctttcccccactctgaggcaagttaaaatgtaaaagatgtgatttatctggggggctcaggtatggtggggaagtggattcaggaatctggggaatggcaaatatattaagaagagtattgaaagtatttggaggaaaatggttaattctgggtgtgcaccaaggttcagtagagtccacttctgccctggagaccacaaatcaactagctccatttacagccatttctaaaatggcagcttcagttctagagaagaaagaacaacatcagcagtaaagtccatggaatagctagtggtctgtgtttcttttcgccattgcctagcttgccgtaatgattctataatgccatcatgcagcaattatgagaggctaggtcatccaaagagaagaccctatcaatgtaggttgcaaaatctaacccctaaggaagtgcagtctttgatttgatttccctagtaaccttgcagatatgtttaaccaagccatagcccatgccttttgagggctgaacaaataagggacttactgataatttacttttgatcacattaaggtgttctcaccttgaaatcttatacactgaaatggccattgatttaggccactggcttagagtactccttcccctgcatgacactgattacaaatactttcctattcatactttccaattatgagatggactgtgggtactgggagtgatcactaacaccatagtaatgtctaatattcacaggcagatctgcttggggaagctagttatgtgaaaggcaaataaagtcatacagtagctcaaaaggcaaccataattctctttggtgcaagtcttgggagcgtgatctagattacactgcaccattcccaagttaatcccctgaaaacttactctcaactggagcaaatgaactttggtcccaaatatccatcttttcagtagcgttaattatgctctgtttccaactgcatttcctttccaattgaattaaagtgtggcctcgtttttagtcatttaaaattgttttctaagtaattgctgcctctattatggcacttcaattttgcactgtcttttgagattcaagaaaaatttctattcatttttttgcatccaattgtgcctgaacttttaaaatatgtaaatgctgccatgttccaaacccatcgtcagtgtgtgtgtttagagctgtgcaccctagaaacaacatacttgtcccatgagcaggtgcctgagacacagacccctttgcattcacagagaggtcattggttatagagacttgaattaataagtgacattatgccagtttctgttctctcacaggtgataaacaatgctttttgtgcactacatactcttcagtgtagagctcttgttttatgggaaaaggctcaaatgccaaattgtgtttgatggattaatatgcccttttgccgatgcatactattactgatgtgactcggttttgtcgcagctttgctttgtttaatgaaacacacttgtaaacctcttttgcactttgaaaaagaatccagcgggatgctcgagcacctgtaaacaattttctcaacctatttgatgttcaaataaagaattaaact

SEQ ID NO: 436 - DNA, 3304 bp, Homo sapiens
  ref <308>: DATABASE ACCESSION NUMBER: NM_000127
  ref <309>: DATABASE ENTRY DATE: 2001-06-18
gcgaccgaacgcggcggtcggcagcgttcgcgcgggggcctgcgaagcgctgctcggggccggcactgcccgcggggaggacgcgccgccgccgccacccagcgccgccgccgccgccgcctccagccgggccgccgcgcgtcccgggggccggccccgcgagcgcaggagtaaacaccgccggagtcttggagccgctgcagaagggaataaagagagatgcagggatttgtgaggttacggcgccccagctgcaagatgcactagccggctgaacccgggatcggctgacttgttggaaccggagtgctctgcacggagagtggtggatgagttgaagttgccttcccggggctcattttccacgctgccgagaggaatccgagaggcaaggcaatcacttcgtcttgccattgattgggtatcgggagctttttttttctcccctctctctttcttttcctccgtcttgttgcatgcaagaaaattacagtccgctgctcgcccgccctgggtgcgagatattcagccccgctctctcccgtgcattgtgcaacccaaagatgaaagaccgaaggggagaaagttaaagaaatcgcccacatgcgctggatcagtccacggcttggggaaaggcatccagagaaggtgggagcggagagtttgaagtctttacaggcgggaagatggcggactggagctgaaagtgttgattgggaaacttgggtgattcttgtgtttatttacaatcctcttgacccaggcaggacacatgcaggccaaaaaacgctatttcatcctgctctcagctggctcttgtctcgcccttttgttttatttcggaggcttgcagtttagggcatcgaggagccacagccggagagaagaacacagcggtaggaatggcttgcaccaccccagtccggatcatttctggccccgcttcccggagcctctgcgccccttcgttccttgggatcaattggaaaacgaggattccagcgtgcacatttccccccggcagaagcgagatgccaactccagcatctacaaaggcaagaagtgccgcatggagtcctgcttcgatttcaccctttgcaagaaaaacggcttcaaagtctacgtatacccacagcaaaaaggggagaaaatcgccgaaagttaccaaaacattctagcggccatcgagggctccaggttctacacctcggaccccagccaggcgtgcctctttgtcctgagtctggatactttagacagagaccagttgtcacctcagtatgtgcacaatttgagatccaaagtgcagagtctccacttgtggaacaatggtaggaatcatttaatttttaatttatattccggcacttggcctgactacaccgaggacgtggggtttgacatcggccaggcgatgctggccaaagccagcatcagtactgaaaacttccgacccaactttgatgtttctattcccctcttttctaaggatcatcccaggacaggaggggagagggggtttttgaagttcaacaccatccctcctctcaggaagtacatgctggtattcaaggggaagaggtacctgacagggataggatcagacaccaggaatgccttatatcacgtccataacggggaggacgttgtgctcctcaccacctgcaagcatggcaaagactggcaaaagcacaaggattctcgctgtgacagagacaacaccgagtatgagaagtatgattatcgggaaatgctgcacaatgccactttctgtctggttcctcgtggtcgcaggcttgggtccttcagattcctggaggctttgcaggctgcctgcgtccctgtgatgctcagcaatggatgggagttgccattctctgaagtgattaattggaaccaagctgccgtcataggcgatgagagattgttattacagattccttctacaatcaggtctattcatcaggataaaatcctagcacttagacagcagacacaattcttgtgggaggcttatttttcttcagttgagaagattgtattaactacactagagattattcaggacagaatattcaagcacatatcacgtaacagtttaatatggaacaaacatcctggaggattgttcgtactaccacagtattcatcttatctgggagattttccttactactatgctaatttaggtttaaagcccccctccaaattcactgcagtcatccatgcggtgacccccctggtctctcagtcccagccagtgttgaagcttctcgtggctgcagccaagtcccagtactgtgcccagatcatagttctatggaattgtgacaagcccctaccagccaaacaccgctggcctgccactgctgtgcctgtcgtcgtcattgaaggagagagcaaggttatgagcagccgttttctgccctacgacaacatcatcacagacgccgtgctcagccttgacgaggacacggtgctttcaacaacagaggtggatttcgccttcacagtgtggcagagcttccctgagaggattgtggggtaccccgcgcgcagccacttctgggataactctaaggagcggtggggatacacatcaaagtggacgaacgactactccatggtgttgacaggagctgctatttaccacaaatattatcactacctatactcccattacctgccagccagcctgaagaacatggtggaccaattggccaattgtgaggacattctcatgaacttcctggtgtctgctgtgacaaaattgcctccaatcaaagtgacccagaagaagcagtataaggagacaatgatgggacagacttctcgggcttcccgttgggctgaccctgaccactttgcccagcgacagagctgcatgaatacgtttgccagctggtttggctacatgccgctgatccactctcagatgaggctcgaccccgtcctctttaaagaccaggtctctattttgaggaagaaataccgagacattgagcgactttgaggaatccggctgagtgggggaggggaagcaagaagggatgggggtcaagctgctctctcttcccagtgcagatccactcatcagcagagccagattgtgccaactatccaaaaacttagatgagcagaatgacaaaaaaaaaaaaggccaatgagaactcaactcctggctcctgggactgcaccagactgctccaaactcacctcactggcttctgtgtcccaagactaggttggtacagtttaattatggaacattaaataattatttttgaaaaaaaaaaaaaaaaaa

SEQ ID NO: 437 - DNA, 5503 bp, Homo sapiens
  ref <308>: DATABASE ACCESSION NUMBER: NM_000135
  ref <309>: DATABASE ENTRY DATE: 2001-06-18
agccgccgccggggctgtaggcgccaaggccatgtccgactcgtgggtcccgaactccgcctcgggccaggacccagggggccgccggagggcctgggccgagctgctggcgggaagggtcaagagggaaaaatataatcctgaaagggcacagaaattaaaggaatcagctgtgcgcctcctgcgaagccatcaggacctgaatgcccttttgcttgaggtagaaggtccactgtgtaaaaaattgtctctcagcaaagtgattgactgtgacagttctgaggcctatgctaatcattctagttcatttataggctctgctttgcaggatcaagcctcaaggctgggggttcccgtgggtattctctcagccgggatggttgcctctagcgtgggacagatctgcacggctccagcggagaccagtcaccctgtgctgctgactgtggagcagagaaagaagctgtcttccctgttagagtttgctcagtatttattggcacacagtatgttctcccgtctttccttctgtcaagaattatggaaaatacagagttctttgttgcttgaagcggtgtggcatcttcacgtacaaggcattgtgagcctgcaagagctgctggaaagccatcccgacatgcatgctgtgggatcgtggctcttcaggaatctgtgctgcctttgtgaacagatggaagcatcctgccagcatgctgacgtcgccagggccatgctttctgattttgttcaaatgtttgttttgaggggatttcagaaaaactcagatctgagaagaactgtggagcctgaaaaaatgccgcaggtcacggttgatgtactgcagagaatgctgatttttgcacttgacgctttggctgctggagtacaggaggagtcctccactcacaagatcgtgaggtgctggttcggagtgttcagtggacacacgcttggcagtgtaatttccacagatcctctgaagaggttcttcagtcataccctgactcagatactcactcacagccctgtgctgaaagcatctgatgctgttcagatgcagagagagtggagctttgcgcggacacaccctctgctcacctcactgtaccgcaggctctttgtgatgctgagtgcagaggagttggttggccatttgcaagaagttctggaaacgcaggaggttcactggcagagagtgctctcctttgtgtctgccctggttgtctgctttccagaagcgcagcagctgcttgaagactgggtggcgcgtttgatggcccaggcattcgagagctgccagctggacagcatggtcactgcgttcctggttgtgcgccaggcagcactggagggcccctctgcgttcctgtcatatgcagactggttcaaggcctcctttgggagcacacgaggctaccatggctgcagcaagaaggccctggtcttcctgtttacgttcttgtcagaactcgtgccttttgagtctccccggtacctgcaggtgcacattctccacccacccctggttcccagcaagtaccgctccctcctcacagactacatctcattggccaagacacggctggccgacctcaaggtttctatagaaaacatgggactctacgaggatttgtcatcagctggggacattactgagccccacagccaagctcttcaggatgttgaaaaggccatcatggtgtttgagcatacggggaacatcccagtcaccgtcatggaggccagcatattcaggaggccttactacgtgtcccacttcctccccgccctgctcacacctcgagtgctccccaaagtccctgactcccgtgtggcgtttatagagtctctgaagagagcagataaaatccccccatctctgtactccacctactgccaggcctgctctgctgctgaagagaagccagaagatgcagccctgggagtgagggcagaacccaactctgctgaggagcccctgggacagctcacagctgcactgggagagctgagagcctccatgacagaccccagccagcgtgatgttatatcggcacaggtggcagtgatttctgaaagactgagggctgtcctgggccacaatgaggatgacagcagcgttgagatatcaaagattcagctcagcatcaacacgccgagactggagccacgggaacacattgctgtggacctcctgctgacgtctttctgtcagaacctgatggctgcctccagtgtcgctcccccggagaggcagggtccctgggctgccctcttcgtgaggaccatgtgtggacgtgtgctccctgcagtgctcacccggctctgccagctgctccgtcaccagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaaattttgtacagcagcaatttcttactctctctgcaagttttcttcccagtcacgagatactttgtgcagctgcttatctccaggccttattaaaaagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacttaacttaccaagactggttacacctggagctggaaattcaacctgaagctgatgctctttcagatactgaacggcaggacttccaccagtgggcgatccatgagcactttctccctgagtcctcggcttcagggggctgtgacggagacctgcaggctgcgtgtaccattcttgtcaacgcactgatggatttccaccaaagctcaaggagttatgaccactcagaaaattctgatttggtctttggtggccgcacaggaaatgaggatattatttccagattgcaggagatggtagctgacctggagctgcagcaagacctcatagtgcctctcggccacaccccttcccaggagcacttcctctttgagattttccgcagacggctccaggctctgacaagcgggtggagcgtggctgccagccttcagagacagagggagctgctaatgtacaaacggatcctcctccgcctgccttcgtctgtcctctgcggcagcagcttccaggcagaacagcccatcactgccagatgcgagcagttcttccacttggtcaactctgagatgagaaacttctgctcccacggaggtgccctgacacaggacatcactgcccacttcttcaggggcctcctgaacgcctgtctgcggagcagagacccctccctgatggtcgacttcatactggccaagtgccagacgaaatgccccttaattttgacctctgctctggtgtggtggccgagcctggagcctgtgctgctctgccggtggaggagacactgccagagcccgctgccccgggaactgcagaagctacaagaaggccggcagtttgccagcgatttcctctcccctgaggctgcctccccagcacccaacccggactggctctcagctgctgcactgcactttgcgattcaacaagtcagggaagaaaacatcaggaagcagctaaagaagctggactgcgagagagaggagctattggttttccttttcttcttctccttgatgggcctgctgtcgtcacatctgacctcaaatagcaccacagacctgccaaaggctttccacgtttgtgcagcaatcctcgagtgtttagagaagaggaagatatcctggctggcactctttcagttgacagagagtgacctcaggctggggcggctcctcctccgtgtggccccggatcagcacaccaggctgctgcctttcgctttttacagtcttctctcctacttccatgaagacgcggccatcagggaagaggccttcctgcatgttgctgtggacatgtacttgaagctggtccagctcttcgtggctggggatacaagcacagtttcacctccagctggcaggagcctggagctcaagggtcagggcaaccccgtggaactgataacaaaagctcgtctttttctgctgcagttaatacctcggtgcccgaaaaagagcttctcacacgtggcagagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcgggtgcaccatggacatgtgtacattgaggttgtgggccttctcaaaccgccggccacactggtcacaggcaaagtccagctcagtctcagccttgtgtttggtcatgtggtacttgagggatgcccgctgcctgcactggaacccacagacctcacacctgggggacagaggcagataagaaggtgcgaggccacagccctgggagggggtcctgactcacacttactgcaaaggcttggctcccgaatgtcgcatttggtggacgagaaggtgcttccgctgcttgaaggtttgtccacattcgtcacagatatagttccgcacctctgagaggggagagtccagtgagtccaggcccctgatgctccaacctcccggggggacgacgatgacaatgtgaaaccatcacagctgggaagacatttctgcacatggttcaccatgcagtgggcccaagcaaggggcctatgagggcctcgtttattaagatctttaaactgctttatacactgtcacgtggcttcatcagctgtgtgcatttcaggatggtttttaaagaaacctcagaaagctatttccttaaaaaaaaaaaaaaaaaaaaaaaaaaaaaaaaaaaaaaaaaaaaaaaaaaaaaaa

SEQ ID NO: 438 - DNA, 1447 bp, Homo sapiens
  ref <308>: DATABASE ACCESSION NUMBER: NM_000137
  ref <309>: DATABASE ENTRY DATE: 2001-06-18
agtcctgctctccgcacgccaccttaggcccgcagccgtgccgggtgctcttcagcatgtccttcatcccggtggccgaggattccgacttccccatccacaacctgccctacggcgtcttctcgaccagaggcgacccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcacgagacattcagaagtgggagtatgtccctctcgggccattccttgggaagagttttgggaccactgtctctccgtgggtggtgcccatggatgctctcatgccctttgctgtgcccaacccgaagcaggaccccaggcccctgccgtatctgtgccatgacgagccctacacatttgacatcaacctctctgttaacctgaaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgc

SEQ ID NO: 439 - DNA, 723 bp, Homo sapiens
  ref <308>: DATABASE ACCESSION NUMBER: NM_000146
  ref <309>: DATABASE ENTRY DATE: 2001-06-18
agttgttgcttatgatgtgtgagtgaacatatgccatgcctggccttttttgtggttagctccttcttgccaaccaaccatgagctcccagattcgtcagaattattccaccgacgtggaggcagccgtcaacagcctggtcaatttgtacctgcaggcctcctacacctacctctctctgggcttctatttcgaccgcgatgatgtggctctggaaggcgtgagccacttcttccgcgaactggccgaggagaagcgcgagggctacgagcgtctcctgaagatgcaaaaccagcgtggcggccgcgctctcttccaggacatcaagaagccagctgaagatgagtggggtaaaaccccagacgccatgaaagctgccatgaccctggagaaaaagctgaaccaggcccttttggatcttcatgccctgggttctgcccgcacggacccccatctctgtgacttcctggagactcacttcctagatgaggaagtgaagcttatcaagaagatgggtgaccacctgaccaacctccacaggctgggtggcccggaggctgggctgggcgagtatctcttcgaaaggctcactctcaagcacgactaagagccttctgagcccagcgacttctgaagggccccttgcaaagtaatagggcttctgcctaagcctctccctccagccaataggcagctttcttaactatcctaacaagccttgga

SEQ ID NO: 440 - DNA, 2583 bp, Homo sapiens
  ref <308>: DATABASE ACCESSION NUMBER: NM_000149
  ref <309>: DATABASE ENTRY DATE: 2001-06-18
gttcccacttcctcccgccccaggaaacctgccatggcctcctggtgagctgtcctcatccactgctcgctgcctctccagatcttcagttgcttcaggccactttgaatgtatatgagccggtcgtaggggatatcgatggcttagcttgggctcagaggcctgaaaatcgcccccaccaatcacctgtttcccccaatctaccctcctgaaggtcactgacaaagacttcattgtctcctaggagaggctgccatatatcagggctgacgtaattccatcttaatatcagttacattataaaaatttacctcgtgcctgaggccccagagcccaagggtgcaaagcagtaattagtcaaagttcaacttcccctcccactctgggctcaggctgtccctgagggcctgtgttttgagtctctttccagaaccttggtgtgaacttaggtcttggcgtcgggatcccttttcgtcacactcaggtgacctacaggctccgctcgacactgcaaggcttagaccagttcggtccaacagagaaagcaggcaaccaccatgtcatttgaaaacagtttcatcgggatataattcgcaacccatacagtgaatccatttaagatactctgacccatggatcccctgggtgcagccaagccacaatggccatggcgccgctgtctggccgcactgctatttcagctgctggtggctgtgtgtttcttctcctacctgcgtgtgtcccgagacgatgccactggatcccctagggctcccagtgggtcctcccgacaggacaccactcccacccgccccaccctcctgatcctgctatggacatggcctttccacatccctgtggctctgtcccgctgttcagagatggtgcccggcacagccgactgccacatcactgccgaccgcaaggtgtacccacaggcagacacggtcatcgtgcaccactgggatatcatgtccaaccctaagtcacgcctcccaccttccccgaggccgcaggggcagcgctggatctggttcaacttggagccaccccctaactgccagcacctggaagccctggacagatacttcaatctcaccatgtcctaccgcagcgactccgacatcttcacgccctacggctggctggagccgtggtccggccagcctgcccacccaccgctcaacctctcggccaagaccgagctggtggcctgggcggtgtccaactggaagccggactcagccagggtgcgctactaccagagcctgcaggctcatctcaaggtggacgtgtacggacgctcccacaagcccctgcccaaggggaccatgatggagacgctgtcccggtacaagttctacctggccttcgagaactccttgcaccccgactacatcaccgagaagctgtggaggaacgccctggaggcctgggccgtgcccgtggtgctgggccccagcagaagcaactacgagaggttcctgccacccgacgccttcatccacgtggacgacttccagagccccaaggacctggcccggtacctgcaggagctggacaaggaccacgcccgctacctgagctactttcgctggcgggagacgctgcggcctcgctccttcagctgggcactggatttctgcaaggcctgctggaaactgcagcaggaatccaggtaccagacggtgcgcagcatagcggcttggttcacctgagaggccggcatggtgcctgggctgccgggaacctcatctgcctggggcctcacctgctggagtcctttgtggccaaccctctctcttacctgggacctcacacgctgggcttcacggctgccaggagcctctcccctccagaagacttgcctgctagggacctcgcctgctggggacctcgcctgttggggacctcacctgctggggacctcacctgctggggaccttggctgctggaggctgcacctactgaggatgtcggcggtcggggactttacctgctgggacctgctcccagagaccttgccacactgaatctcacctgctggggacctcaccctggagggccctgggccctggggaactggcttacttggggccccacccgggagtgatggttctggctgatttgtttgtgatgttgttagccgcctgtgaggggtgcagagagatcatcacggcacggtttccagatgtaatactgcaaggaaaaatgatgacgtgtctcctcactctagaggggttggtcccatgggttaagagctcaccccaggttctcacctcaggggttaagagctcagagttcagacaggtccaagttcaagcccaggaccaccacttatagggtacaggtgggatcgactgtaaatgaggacttctggaacattccaaatattctggggttgagggaaattgctgctgtctacaaaatgccaagggtggacaggcgctgtggctcacgcctgtaattccagcactttgggaggctgaggtaggaggattgattgaggccaagagttaaagaccagcctggtcaatatagcaagaccacgtctctaaataaaaaataataggccggccagca

SEQ ID NO: 441 - DNA, 1361 bp, Homo sapiens
  ref <308>: DATABASE ACCESSION NUMBER: NM_000154
  ref <309>: DATABASE ENTRY DATE: 2001-06-18
cccgagcatcccgcgccgacggggctgtgccggagcagctgtgcagagctgcaggcgcgcgtcatggctgctttgagacagccccaggtcgcggagctgctggccgaggcccggcgagccttccgggaggagttcggggccgagcccgagctggccgtgtcagcgccgggccgcgtcaacctcatcggggaacacacggactacaaccagggcctggtgctgcctatggctctggagctcatgacggtgctggtgggcagcccccgcaaggatgggctggtgtctctcctcaccacctctgagggtgccgatgagccccagcggctgcagtttccactgcccacagcccagcgctcgctggagcctgggactcctcggtgggccaactatgtcaagggagtgattcagtactacccagctgcccccctccctggcttcagtgcagtggtggtcagctcagtgcccctggggggtggcctgtccagctcagcatccttggaagtggccacgtacaccttcctccagcagctctgtccagactcgggcacaatagctgcccgcgcccaggtgtgtcagcaggccgagcacagcttcgcagggatgccctgtggcatcatggaccagttcatctcacttatgggacagaaaggccacgcgctgctcattgactgcaggtccttggagaccagcctggtgccactctcggaccccaagctggccgtgctcatcaccaactctaatgtccgccactccctggcctccagcgagtaccctgtgcggcggcgccaatgtgaagaagtggcccgggcgctgggcaaggaaagcctccgggaggtacaactggaagagctagaggctgccagggacctggtgagcaaagagggcttccggcgggcccggcacgtggtgggggagattcggcgcacggcccaggcagcggccgccctgagacgtggcgactacagagcctttggccgcctcatggtggagagccaccgctcactcagagacgactatgaggtgagctgcccagagctggaccagctggtggaggctgcgcttgctgtgcctggggtttatggcagccgcatgacgggcggtggcttcggtggctgcacggtgacactgctggaggcctccgctgctccccacgccatgcggcacatccaggagcactacggcgggactgccaccttctacctctctcaagcagccgatggagccaaggtgctgtgcttgtgaggcacccccaggacagcacacggtgagggtgcggggcctgcaggccagtcccacggctctgtgcccggtgccatcttccatatccgggtgctcaataaacttgtgcctccaatgtggta

SEQ ID NO: 442 - DNA, 2913 bp, Homo sapiens
  ref <308>: DATABASE ACCESSION NUMBER: NM_000158
  ref <309>: DATABASE ENTRY DATE: 2001-06-18
gtcccagctagagctccagcgcccgctcaggccccactcgaccctctcgggcctcggctacttggactgcggcggaatatggcggctccgatgactcccgcggctcggcccgaggactacgaggcggcgctcaatgccgccctggctgacgtgcccgaactggccagactcctggagatcgacccgtacttgaagccctacgccgtggacttccagcgcaggtataagcagtttagccaaattttgaagaacattggagaaaatgaaggtggtattgataagttttccagaggctatgaatcatttggcgtccacagatgtgctgatggtggtttatactccaaagaatgggccccgggagcagaaggagtttttcttactggagattttaatggttggaatccattttcgtacccatacaaaaaactggattatggaaaatgggagctgtatatcccaccaaagcagaataaatctgtactcgtgcctcatggatccaaattaaaggtagttattactagtaaaagcggagagatcttgtatcgtatttcaccgtgggcaaagtatgtggttcgtgaaggtgataatgtgaattatgattggatacactgggatccagaacactcatatgagtttaagcattccagaccaaagaagccacggagtctaagaatttatgaatctcatgtgggaatttcttcccatgaaggaaaagtagcttcttataaacattttacatgcaatgtactaccaagaatcaaaggccttggatacaactgcattcagttgatggcaatcatggagcatgcttactatgccagctttggttaccaaatcacaagcttctttgcagcttccagccgttatggaacacctgaagagctacaagaactggtagacacagctcattccatgggtatcatagtcctcttagatgtggtacacagccatgcttcaaaaaattcagcagatggattgaatatgtttgatgggacagattcctgttattttcattctggacctagagggactcatgatctttgggatagcagattgtttgcctactccagctgggaagttttaagattccttctgtcaaacataagatggtggttggaagaatatcgctttgatggatttcgttttgatggtgttacgtccatgctttatcatcaccatggagtgggtcaaggtttctcaggtgattacagtgaatatttcggactacaagtagatgaagatgccttgacttacctcatgttggcaaatcatttggttcacacgctgtgtcccgattctataacaatagctgaggatgtatcaggaatgccagctctgtgctctccaatttcccagggagggggtggttttgactatcgactagccatggcaattccagataagtggattcagctacttaaagagtttaaagatgaagactggaacatgggcgatatagtatacacgctcacaaacaggcgctaccttgaaaagtgcattgcttatgcagagagccatgatcaggcattggttggggataagtcgctggcattttggttgatggatgccgaaatgtatacaaacatgagtgtcctgactccttttactccagttattgatcgtggaatacagcttcataaaatgattcgactcattacgcatgggcttggtggagaaggctatctcaatttcatgggtaatgaatttgggcatcctgaatggttagacttcccaagaaaaggaaataatgagagttaccattatgccaggcggcagtttcatttaactgacgacgaccttcttcgctacaagttcctaaataattttgacagggatatgaatagattggaagaaagatatggttggcttgcagctccacaggcctacgtgagtgaaaaacatgaaggcaataagatcattgcttttgaaagagcaggtcttcttttcattttcaacttccatccaagcaagagctacactgactaccgagttggaacagcattgccagggaaattcaaaattgtgctagattcagatgcagcggaatatggagggcatcagagactggaccacagcactgactttttttctgaggcttttgaacataatgggcgtccctattctcttttggtgtacattccaagcagagtggccctcatccttcagaatgtggatctgccgaattgaagaggcctgatttcagctccaccagatgcagatttgtgttttgttttcttgttatcactgtcacacagcttataacatgtatgcttttcagaatacagttgtctagccaagccatcaagtgtctgaaattcaatattggtttatgcaaatacagcaaacttttatttaagtagataggagaatatgtttaaaatattaggaatcctagaccatattttcaagtcatcttagcagctaggattctcaaatggaagtgttatatataatatgttaaaaacattttgctttcctggctaattatttgatccttttaaatccaaatttgaatcatttgtcatgtatgattatttctgttaaatgtacacagtatttaagatggatatttggtggctctatttgttctgatatcttttggtctaaattatgaggtaccaagattgtttctttgtttctttttttcaaattgtgtttagaaatactgtaataaatatgcagtagtgatataaagaattatatccaaggtaatataaaagccattacgtatgaactcatccgtgtctcattttgtgttttattttgtgatctcttgtccactaagtatcttgttaaatgccagtatctcagtctttctgaagccctgaaatggtaattgtagcatttcagaaaatgtctttcatttcaatcaataaaaagcttttgtaaaaaaaaaaaaaaaaaaaaaaaaaa

SEQ ID NO: 443 - DNA, 2921 bp, Homo sapiens
  ref <308>: DATABASE ACCESSION NUMBER: NM_000161
  ref <309>: DATABASE ENTRY DATE: 2001-06-18
ccggctcggagtgtgatctaagcaggtcgcgtaccttcctcaggtgactccggccacagcccattgtccgcggccaccggcggagtttagccgcagacctcgaagcgccccggggtccttcccgaacggcagcggctgcggcgggtccatggagaagggccctgtgcgggcaccggcggagaagccgcggggcgccaggtgcagcaatgggttccccgagcgggatccgccgcggcccgggcccagcaggccggcggagaagcccccgcggcccgaggccaagagcgcgcagcccgcggacggctggaagggcgagcggccccgcagcgaggaggataacgagctgaacctccctaacctggcagccgcctactcgtccatcctgagctcgctgggcgagaacccccagcggcaagggctgctcaagacgccctggagggcggcctcggccatgcagttcttcaccaagggctaccaggagaccatctcagatgtcctaaacgatgctatatttgatgaagatcatgatgagatggtgattgtgaaggacatagacatgttttccatgtgtgagcatcacttggttccatttgttggaaaggtccatattggttatcttcctaacaagcaagtccttggcctcagcaaacttgcgaggattgtagaaatctatagtagaagactacaagttcaggagcgccttacaaaacaaattgctgtagcaatcacggaagccttgcggcctgctggagtcggggtagtggttgaagcaacacacatgtgtatggtaatgcgaggtgtacagaaaatgaacagcaaaactgtgaccagcacaatgttgggtgtgttccgggaggatccaaagactcgggaagagttcctgactctcattaggagctgagcttcattcagtgtgtgtgcgttggttgccgatcgtactgccagtagcattgtctgtctgtccggtcttgtttgtacattccattttcaattgttacagatgtgaactttattccttgtcactaattatatttaaaattatttctaggaagtcaaataaatataataaagggttgagcctctactttcttcttgccacctttttgtggcaatattaaagtgaactgctaatagtgtaagtatgtgcacaaaaccactgccagataaccagaggggcctgggaagggagaagaattagtgtatttttttcaaatagtacagtaatttgcctcataagcataggagcattgggaatgagagggaactgtgcccagtatactgttttttttcttcctccaataaaagtggtgtagtgccgaaagtgctaaaatatttagtgcggtattgctctgtgaattcaagttcaacagacttcactttggtcatgtttattaaaccaccagtgacatttaaaaatatatttttagcagtcgtaatgttagtcaccaagggaaggtggtggaatgtctatgtttttgattttactgtgagttaaaaaggcacatttctaccttctattgtttttaaattcaagaatagggaattagttcctggtgttgtttacgagtgtattctcgtgtcaacatacagggatttagacatttaactctctgtgccttgataagaatatcatttagagtgtagatacttttgcctttttaaaaaagccattattttatgagacttagtactcacactgcaaataactagtcagctcagttttaactttataggtttattgagtttcctttgtgtgatccatgtagatgcctcaaaatgtttcttcttcttcttttttttaatcttataagatatttttctaagtatttccagaaacatttgagagtgcccatcattttcaggtctgcagaaccatagcttccacgcacctgaacgagcacagaatgaactgacggtggaagacattatgagctgtgtccaacgttttaaccaaagcgtatcgtaccaacgatctgtgaaaatgcactggaagcttctggtcccggtttcctttgtggtctatgtgggtcttgtcctcattgtaactccgtatagatggtataggtattttaatcctggaagctgttgccttattaatgattatcttaaaatttcctccattggggcagcgtgggccaaattaaaacaaacaaaaccgcaactcctccacagaaacacaaacacagttattccatgaagtttagtatttggttgacatagtgctcttcaaattcatcccattaccctaaaagtaataactttgatgcttgctttaactttagtcccatctctgccactttgatgctatttgggttatgatggggcaagatggcagaggtattgggtttttttgtttttttccattcctctctacttctgtttcctagctttttctttctggagtttaagtacagtgatggttggcttgagtacctttttaaatctagcccagtataaacattagcctgcttaatatttagacatttataggtagaattctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaaggtctaatgtatccacaggctgttgtcttattagtaaatgcaaagtaatgactttgtctgttttactctagtctttagtacttcaaaattaccttttcatatccatgatcttgagtccatttgggggatttttaagaatttgatgtatttcaatacactgttcaaaattaaattgtttaattttatgtatgagtatgtatgttcctgaagttggtcctatttaaattattaaactattgtaactttaaaaaaaaaaaaaaaaaaaaa

SEQ ID NO: 444 - DNA, 3088 bp, Homo sapiens
  ref <308>: DATABASE ACCESSION NUMBER: NM_000165
  ref <309>: DATABASE ENTRY DATE: 2001-06-18
acaaaaaagcttttacgaggtatcagcacttttctttcattagggggaaggcgtgaggaaagtaccaaacagcagcggagttttaaactttaaatagacaggtctgagtgcctgaacttgccttttcattttacttcatcctccaaggagttcaatcacttggcgtgacttcactacttttaagcaaaagagtggtgcccaggcaacatgggtgactggagcgccttaggcaaactccttgacaaggttcaagcctactcaactgctggagggaaggtgtggctgtcagtacttttcattttccgaatcctgctgctggggacagcggttgagtcagcctggggagatgagcagtctgcctttcgttgtaacactcagcaacctggttgtgaaaatgtctgctatgacaagtctttcccaatctctcatgtgcgcttctgggtcctgcagatcatatttgtgtctgtacccacactcttgtacctggctcatgtgttctatgtgatgcgaaaggaagagaaactgaacaagaaagaggaagaactcaaggttgcccaaactgatggtgtcaatgtggacatgcacttgaagcagattgagataaagaagttcaagtacggtattgaagagcatggtaaggtgaaaatgcgaggggggttgctgcgaacctacatcatcagtatcctcttcaagtctatctttgaggtggccttcttgctgatccagtggtacatctatggattcagcttgagtgctgtttacacttgcaaaagagatccctgcccacatcaggtggactgtttcctctctcgccccacggagaaaaccatcttcatcatcttcatgctggtggtgtccttggtgtccctggccttgaatatcattgaactcttctatgttttcttcaagggcgttaaggatcgggttaagggaaagagcgacccttaccatgcgaccagtggtgcgctgagccctgccaaagactgtgggtctcaaaaatatgcttatttcaatggctgctcctcaccaaccgctcccctctcgcctatgtctcctcctgggtacaagctggttactggcgacagaaacaattcttcttgccgcaattacaacaagcaagcaagtgagcaaaactgggctaattacagtgcagaacaaaatcgaatggggcaggcgggaagcaccatctctaactcccatgcacagccttttgatttccccgatgataaccagaattctaaaaaactagctgctggacatgaattacagccactagccattgtggaccagcgaccttcaagcagagccagcagtcgtgccagcagcagacctcggcctgatgacctggagatctagatacaggcttgaaagcatcaagattccactcaattgtggagaagaaaaaaggtgctgtagaaagtgcaccaggtgttaattttgatccggtggaggtggtactcaacagccttattcatgaggcttagaaaacacaaagacattagaatacctaggttcactgggggtgtatggggtagatgggtggagagggaggggataagagaggtgcatgttggtatttaaagtagtggattcaaagaacttagattataaataagagttccattaggtgatacatagataagggctttttctccccgcaaacacccctaagaatggttctgtgtatgtgaatgagcgggtggtaattgtggctaaatatttttgttttaccaagaaactgaaataattctggccaggaataaatacttcctgaacatcttaggtcttttcaacaagaaaaagacagaggattgtccttaagtccctgctaaaacattccattgttaaaatttgcactttgaaggtaagctttctaggcctgaccctccaggtgtcaatggacttgtgctactatatttttttattcttggtatcagtttaaaattcagacaaggcccacagaataagattttccatgcatttgcaaatacgtatattctttttccatccacttgcacaatatcattaccatcactttttcatcattcctcagctactactcacattcatttaatggtttctgtaaacatttttaagacagttgggatgtcacttaacattttttttttttgagctaaagtcagggaatcaagccatgcttaatatttaacaatcacttatatgtgtgtcgaagagtttgttttgtttgtcatgtattggtacaagcagatacagtataaactcacaaacacagatttgaaaataatgcacatatggtgttcaaatttgaacctttctcatggatttttgtggtgtgggccaatatggtgtttacattatataattcctgctgtggcaagtaaagcacactttttttttctcctaaaatgtttttccctgtgtatcctattatggatactggttttgttaattatgattctttattttctctcctttttttaggatatagcagtaatgctattactgaaatgaatttcctttttctgaaatgtaatcattgatgcttgaatgatagaattttagtactgtaaacaggctttagtcattaatgtgagagacttagaaaaaatgcttagagtggactattaaatgtgcctaaatgaattttgcagtaactggtattcttgggttttcctacttaatacacagtaattcagaacttgtattctattatgagtttagcagtcttttggagtgaccagcaactttgatgtttgcactaagattttatttggaatgcaagagaggttgaaagaggattcagtagtacacatacaactaatttatttgaactatatgttgaagacatctaccagtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattcaataaagttttaatttagtataaacat

SEQ ID NO: 445 - DNA, 5054 bp, Homo sapiens
  ref <308>: DATABASE ACCESSION NUMBER: NM_000168
  ref <309>: DATABASE ENTRY DATE: 2001-06-18
cgatactacgtgggcatttttggtcgaagagagctgaagtaatgagaagacatcatggaggcccagtcccacagctccacgaccactgaaaagaaaaaagttgagaattccatagtgaagtgctccactcgaacagatgtgagcgagaaagccgttgcctccagcaccacttctaatgaggatgaaagtcctggacagacttatcacagagagagaagaaacgcaatcactatgcagccacagaatgtccaggggctcagcaaagtcagtgaggaaccttcaacatcgagtgacgagagggcctcattgatcaagaaagagatccatgggtccctgccacacgtggcggagccctctgtgccgtaccgcgggacggtgtttgccatggaccccaggaatggttacatggagccccactaccaccctcctcatcttttccctgccttccatcctcctgtaccaattgatgccagacatcatgagggccgttaccattacgatccatctccgattcctccattgcatatgacttccgccttatctagtagccctacgtatccggacctgcccttcattaggatctccccacaccggaaccccgctgctgcttccgagtctcccttcagccctccacatccctacattaatccctacatggactatatccgctccttgcacagcagcccatcgctctccatgatctcagcaacccgtgggctgagccctacagatgcgccccatgcaggagtcagcccagcagaatactatcatcagatggccctgctaactggccagcgcagcccctatgcagacattattccctcagctgccaccgccggcacgggggccatccacatggaatatcttcatgctatggatagcaccagattctccagccccaggctgtcagccaggccgagccgaaaacgtacactgtccatatcaccactctccgatcatagctttgaccttcagaccatgataaggacgtctcccaactccttggtcacgattctcaataattcccgtagcagctcttcagcaagtggctcctatggtcacttatctgcaagtgcaatcagccctgccttgagcttcacctactcttccgcgcccgtctctctccacatgcatcagcagatcctaagccgacaacagagcttaggttcagcctttggacacagccctccactcatccaccctgccccaacttttccaacacagaggcctattccagggatccctacggttctgaaccccgtccaggtcagctccggcccttctgagtcctcacagaacaagcccacgagtgagtctgcagtgagcagcactggtgacccgatgcacaacaagaggtccaagatcaaacccgatgaagacctccccagcccaggggctcgggggcagcaggaacagcccgaaggaacaacccttgtcaaggaggaaggggacaaagatgaaagcaaacaggagcctgaagtcatctatgagacaaactgccactgggaaggctgcgcgagggagttcgacacccaagagcagcttgtgcaccatataaataacgaccatattcatggagagaagaaggagttcgtgtgcaggtggctggactgctcaagagagcagaaacccttcaaagcccagtatatgttggtagtgcatatgagaagacacacgggcgagaagcctcacaaatgcacttttgaaggttgcacaaaggcctactcgagactagaaaacttgaaaacacacttgagatctcacactggagagaaaccatacgtctgtgagcacgaaggttgcaacaaggctttctcaaatgcctctgatcgcgccaaacaccaaaacagaacgcattccaatgagaaaccatatgtgtgcaaaatcccaggctgcactaagcgttacacagacccaagctccctccggaaacatgtgaagacagtgcatggcccagaggctcatgtcaccaagaagcagcgaggggacatccatcctcggccgccacccccgagagattccggcagccattcacagtccaggtcgcctggccgaccgactcagggagcccttggtgagcagcaggacctcagcaacactacctcaaagcgggaagaatgcctccaggtgaaaaccgtcaaggcagagaagccaatgacatctcagccaagccctggtggtcagtcttcatgcagcagccaacagtcccccatcagcaactattccaacagtgggctcgagcttcctctgaccgatggaggtagtataggagacctcagtgccatcgatgaaaccccaatcatggactcaaccatttccactgcaaccacagcccttgctttgcaagccaggagaaacccggcagggaccaaatggatggagcacgtaaaactagaaaggctaaaacaagtgaatggaatgtttccgcgactgaaccccattctaccccctaaagcccctgcggtctctcctctcataggaaatggcacacagtccaacaacacctgcagcttgggtgggcccatgacgcttctcccgggcagaagcgacctctctggggtggacgtcactatgctgaacatgctcaacagaagggacagcagcgccagcaccatcagctcggcctacctgagcagccgccgctcctcagggatctcgccctgcttctccagccgccgctccagcgaggcgtcacaggccgagggccggccgcagaacgtgagcgtggccgactcctacgaccccatctccaccgacgcctcgcgccgctccagcgaagccagccagagcgacggcctgcccagcctgctcagcctcacgcccgcccagcagtaccgcctcaaggccaagtacgcggctgccacaggagggccgccgccgacgcccctgcccaacatggagaggatgagcctgaagacgcgcctggcgctgctcggggatgccctcgagcctggcgtggccctgcctccagttcatgccccgaggaggtgcagcgacgggggagcccacggctacgggcggcgccacctgcagccgcacgatgcgctgggccacggcgtgaggagggccagcgacccggtgcggacaggctccgagggcctggccctgcctcgtgtgccgcgcttcagcagcctcagcagctgcaaccccccggcgatggccacgtccgcggagaagcgcagtctcgtgcttcagaattacacgcggcccgagggcggccagtcccgaaacttccactcgtccccctgtcctcccagcatcaccgagaacgtcaccctggagtccctgaccatggacgctgatgccaacctgaacgatgaggatttcctgccggacgacgtggtgcagtatttaaattcccagaaccaagcagggtacgagcagcacttccccagcgccctcccggacgacagcaaagtgccccacgggcccggtgactttgacgcgcccgggctgccagacagccacgctggccagcagttccatgccctcgagcagccctgccccgagggcagcaaaaccgacctgcccattcagtggaacgaagtcagctccggaagcgccgacctgtcctcctccaagctcaagtgtgggccgcggcccgctgtgccgcagactcgcgcctttgggttctgcaacggcatggtcgtccacccgcagaaccccttgaggagcgggcctgctgggggctatcagaccctcggggagaacagcaacccctacggtggcccagagcacttgatgctccacaacagccccggaagtggcaccagtggaaacgccttccatgaacagccctgtaaggccccgcagtatgggaactgtctcaacaggcagccagtggcccctggtgcactcgacggtgcctgtggtgccgggattcaagcctcaaagctgaagagcacccccatgcaagggagcgggggccagctgaatttcggcctgccggtagcgccaaatgagtcagctggcagcatggtgaatggcatgcagaaccaggacccagtgggacaggggtacctggctcaccagctcctcggcgacagcatgcagcacccgggggcaggccgccccggtcagcagatgcttgggcagattagtgctacctcacacatcaacatctaccaagggccagagagctgcctgccaggggctcacggcatgggcagccagccgtcaagcttggcagttgtcaggggctaccagccatgtgccagctttgggggcagcaggcgccaggctatgccgagggacagccttgctctgcagtcaggacagctcagtgacacaagtcagacctgcagggtgaatggtatcaagatggagatgaaagggcagccccatccgctgtgctctaatctgcagaattactctggtcagttctatgaccaaaccgtgggcttcagtcagcaagacacgaaagctggttcattctctatttcagacgccagctgcctgctacaggggaccagcgccaaaaactctgagttactttccccaggtgctaatcaggtgacaagcacagtggacagcctcgacagccatgacctggaaggggtacagattgacttcgatgccatcatagacgatggggaccactccagcctgatgtcgggggccctgagcccaagtatcattcagaacctttcccatagctcctcccgcctcaccacgcctcgggcgtccctcccattcccagcgctgtccatgagcaccaccaacatggctatcggggacatgagttctttgctgacctccctagcggaagaaagcaaattccttgcagttatgcaataggctttaggaaaaaaagactgcaaccaacggaaatcaataggagttgaagagattaaactgactttgttttggctgtttttttagttctgtatgtattttagcaatctcatctcacctaactgagatgtgtttcaattatattccttttatggaaaaggactctgaaaaaccctaaagtattctagggagaaactgtcttccatttcagttttgaatcagtattgttacactcaaaccaccctctttttaaaaaaaaa

SEQ ID NO: 446 - DNA, 1350 bp, Homo sapiens
  ref <308>: DATABASE ACCESSION NUMBER: NM_000169
  ref <309>: DATABASE ENTRY DATE: 2001-06-18
aggttaatcttaaaagcccaggttacccgcggaaatttatgctgtccggtcaccgtgacaatgcagctgaggaacccagaactacatctgggctgcgcgcttgcgcttcgcttcctggccctcgtttcctgggacatccctggggctagagcactggacaatggattggcaaggacgcctaccatgggctggctgcactgggagcgcttcatgtgcaaccttgactgccaggaagagccagattcctgcatcagtgagaagctcttcatggagatggcagagctcatggtctcagaaggctggaaggatgcaggttatgagtacctctgcattgatgactgttggatggctccccaaagagattcagaaggcagacttcaggcagaccctcagcgctttcctcatgggattcgccagctagctaattatgttcacagcaaaggactgaagctagggatttatgcagatgttggaaataaaacctgcgcaggcttccctgggagttttggatactacgacattgatgcccagacctttgctgactggggagtagatctgctaaaatttgatggttgttactgtgacagtttggaaaatttggcagatggttataagcacatgtccttggccctgaataggactggcagaagcattgtgtactcctgtgagtggcctctttatatgtggccctttcaaaagcccaattatacagaaatccgacagtactgcaatcactggcgaaattttgctgacattgatgattcctggaaaagtataaagagtatcttggactggacatcttttaaccaggagagaattgttgatgttgctggaccagggggttggaatgacccagatatgttagtgattggcaactttggcctcagctggaatcagcaagtaactcagatggccctctgggctatcatggctgctcctttattcatgtctaatgacctccgacacatcagccctcaagccaaagctctccttcaggataaggacgtaattgccatcaatcaggaccccttgggcaagcaagggtaccagcttagacagggagacaactttgaagtgtgggaacgacctctctcaggcttagcctgggctgtagctatgataaaccggcaggagattggtggacctcgctcttataccatcgcagttgcttccctgggtaaaggagtggcctgtaatcctgcctgcttcatcacacagctcctccctgtgaaaaggaagctagggttctatgaatggacttcaaggttaagaagtcacataaatcccacaggcactgttttgcttcagctagaaaatacaatgcagatgtcattaaaagacttactttaa

SEQ ID NO: 447 - DNA, 1987 bp, Homo sapiens
  ref <308>: DATABASE ACCESSION NUMBER: NM_000175
  ref <309>: DATABASE ENTRY DATE: 2001-06-18
ctcgagagctccgccatggccgctctcacccgggacccccagttccagaagctgcagcaatggtaccgcgagcaccgctccgagctgaacctgcgccgcctcttcgatgccaacaaggaccgcttcaaccacttcagcttgaccctcaacaccaaccatgggcatatcctggtggattactccaagaacctggtgacggaggacgtgatgcggatgctggtggacttggccaagtccaggggcgtggaggccgcccgggagcggatgttcaatggtgagaagatcaactacaccgagggtcgagccgtgctgcacgtggctctgcggaaccggtcaaacacacccatcctggtagacggcaaggatgtgatgccagaggtcaacaaggttctggacaagatgaagtctttctgccagcgtgtccggagcggtgactggaaggggtacacaggcaagaccatcacggacgtcatcaacattggcattgtcggctccgacctgggacccctcatggtgactgaagcccttaagccatactcttcaggaggtccccgcgtctggtatgtctccaacattgatggaactcacattgccaaaaccctggcccagctgaacccggagtcctccctgttcatcattgcctccaagacctttactacccaggagaccatcacgaatgcagagacggcgaaggagtggtttctccaggcggccaaggatccttctgcagtggcgaagcactttgttgccctgtctactaacacaaccaaagtgaaggagtttggaattgaccctcaaaacatgttcgagttctgggattgggtgggaggacgctactcgctgtggtcggccatcggactctccattgccctgcacgtgggttttgacaacttcgagcagctgctctcgggggctcactggatggaccagcacttccgcacgacgcccctggagaagaacgcccccgtcttgctggccctgctgggtatctggtacatcaactgctttgggtgtgagacacacgccatgctgccctatgaccagtacctgcaccgctttgctgcgtacttccagcagggcgacatggagtccaatgggaaatacatcaccaaatctggaacccgtgtggaccaccagacaggccccattgtgtggggggagccagggaccaatggccagcatgctttttaccagctcatccaccaaggcaccaagatgataccctgtgacttcctcatcccggtccagacccagcaccccatacggaagggtctgcatcacaagatcctcctggccaacttcttggcccagacagaggccctgatgaggggaaaatcgacggaggaggcccgaaaggagctccaggctgcgggcaagagtccagaggaccttgagaggctgctgccacataaggtctttgaaggaaatcgcccaaccaactctattgtgttcaccaagctcacaccattcatgcttggagccttggtcgccatgtatgagcacaagatcttcgttcagggcatcatctgggacatcaacagctttgaccagtggggagtggagctgggaaagcagctggctaagaaaatagagcctgagcttgatggcagtgctcaagtgacctctcacgacgcttctaccaatgggctcatcaacttcatcaagcagcagcgcgaggccagagtccaataaactcgtgctcatctgcagcctcctctgtgactcccctttctcttctcgtccctcctccccggagccggcactgcatgttcctggacaccacccagagcaccctctggttgtgggcttggaccacgagcccttagcagggaaggctggtctcccccagcctaacccccagcccctccatgtctatgctccctctgtgttagaattggctgaagtgtttttgtgcagctgacttttctgacccatgttcacgttgttcacatcccatgtagaaaaacaaagatgccacggaggaggt

SEQ ID NO: 448 - DNA, 1568 bp, Homo sapiens
  ref <308>: DATABASE ACCESSION NUMBER: NM_000191
  ref <309>: DATABASE ENTRY DATE: 2001-06-18
gaattccggccaagatggcagcaatgaggaaggcgcttccgcggcgactggtgggcttggcgtccctccgggctgtcagcacctcatctatgggcactttaccaaagcgggtgaaaattgtggaagttggtccccgagatggactacaaaatgaaaagaatatcgtatctactccagtgaaaatcaagctgatagacatgctttctgaagcaggactctctgttatagaaaccaccagctttgtgtctcctaagtgggttccccagatgggtgaccacactgaagtcttgaagggcattcagaagtttcctggcatcaactacccagtcctgaccccaaatttgaaaggcttcgaggcagcggttgctgctggagccaaggaagtagtcatctttggagctgcctcagagctcttcaccaagaagaacatcaattgttccatagaggagagttttcagaggtttgacgcaatcctgaaggcagcgcagtcagccaatatttctgtgcgggggtacgtctcctgtgctcttggctgcccttatgaagggaagatctccccagctaaagtagctgaggtcaccaagaagttctactcaatgggctgctacgagatctccctgggggacaccattggtgtgggcaccccagggatcatgaaagacatgctatctgctgtcatgcaggaagtgcctctggctgccctggctgtccactgccatgacacctatggtcaagccctgaccaacaccttgatggccctgcagatgggagtgagtgtcgtggactcttctgtggcaggacttggaggctgtccctacgcacagggggcatcaggaaacttggccacagaagacctggtctacatgctagagggcttgggcattcacacgggtgtgaatctccagaagcttctggaagctggaaactttatctgtcaagccctgaacagaaaaactagctccaaagtggctcaggctacctgtaaactctgagccccttgcccacctgaagccctggggatgatgtggaaataggggcacacacagatgattcatggatggggacatggaaatgagaataggttaaatggtgcaggtacctcatagccagctctacacagaggtctctcctggcagaaagcaggcgaagggcaggaggagctgcttggcagaaggacctcctgcccagacctgaggagtgagaggctttgagggctgaagtctccctttgttacggaccctggcccaggagttgaatgcctgaggacgtgtgggaaccccgttccctacttagcatgatccttgagtctcctctctggatggaatccgcgagctggccacctggccaccctctacacggctccaccctgccatggccgtggggcccttgctctctgacttctcaggacacaggtcatggaggttcttcccaagctggcagaggccatttgtggaaagtggagagctacgtggtggccgtctgccaactccagcatctctggaaaatctccacgctgaatgtgatttttgaaaacagcttatgtaattaaaggttgaatggcacatcat

SEQ ID NO: 449 - DNA, 1873 bp, Homo sapiens
  ref <308>: DATABASE ACCESSION NUMBER: NM_000196
  ref <309>: DATABASE ENTRY DATE: 2001-06-18
cgcgccccaggccggtgtacccccgcactccgcgccccggcctagaagctctctctccccgctccccggcccggcccccgccccgccccgccccagcccgctgggccgccatggagcgctggccttggccgtcgggcggcgcctggctgctcgtggctgcccgcgcgctgctgcagctgctgcgctcagacctgcgtctgggccgcccgctgctggcggcgctggcgctgctggccgcgctcgactggctgtgccagcgcctgctgcccccgccggccgcactcgccgtgctggccgccgccggctggatcgcgttgtcccgcctggcgcgcccgcagcgcctgccggtggccactcgcgcggtgctcatcaccggctgtgactctggttttggcaaggagacggccaagaaactggactccatgggcttcacggtgctggccaccgtattggagttgaacagccccggtgccatcgagctgcgtacctgctgctcccctcgcctaaggctgctgcagatggacctgaccaaaccaggagacattagccgcttgctagagttcaccaaggcccacaccaccagcaccggcctgtggggcctcgtcaacaacgcaggccacaatgaagtagttgctgatgcggagctgtctccagtggccactttccgtagctgcatggaggtgaatttctttggcgcgctcgagctgaccaagggcctcctgcccctgctgcgcagctcaaggggccgcatcgtgactgtggggagcccagcgggggacatgccatatccgtgcttgggggcctatggaacctccaaagcggccgtggcgctactcatggacacattcagctgtgaactccttccctggggggtcaaggtcagcatcatccagcctggctgcttcaagacagagtcagtgagaaacgtgggtcagtgggaaaagcgcaagcaattgctgctggccaacctgcctcaagagctgctgcaggcctacggcaaggactacatcgagcacttgcatgggcagttcctgcactcgctacgcctggccatgtccgacctcaccccagttgtagatgccatcacagatgcgctgctggcagctcggccccgccgccgctattaccccggccagggcctggggctcatgtacttcatccactactacctgcctgaaggcctgcggcgccgcttcctgcaggccttcttcatcagtcactgtctgcctcgagcactgcagcctggccagcctggcactaccccaccacaggacgcagcccaggacccaaacctgagccccggcccttccccagcagtggctcggtgagccatgtgcacctatggcccagccactgcagcacaggaggctccgtgagccttggttcctccccgaaaacccccagcattacgatcccccaagtgtcctggaccctggcctaaagaatcccacccccacttcatgcccactgccgatgcccaatccaggcccggtgaggccaaggtttcccagtgagcctctgcgcctctccactgtttcatgagcccaaacaccctcctggcacaacgctctaccctgcagcttggagaactccgctggatgggagtctcatgcaagacttcactgcagcctttcacaggactctgcagatagtgcctctgcaaactaaggagtgactaggtgggttggggaccccctcaggattgtttctcggcaccagtgcctcagtgctgcaattgagggctaaatcccaagtgtctcttgactggctcaagaattagggccccaactacacacccccaagccacagggaagcatgtactgtacttcccaattgccacattttaaataaagacaaatttttatttcttcta

SEQ ID NO: 450 - DNA, 2986 bp, Homo sapiens
  ref <308>: DATABASE ACCESSION NUMBER: NM_000201
  ref <309>: DATABASE ENTRY DATE: 2001-06-18
gcgccccagtcgacgctgagctcctctgctactcagagttgcaacctcagcctcgctatggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcgaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggcccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtccatgtcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttcacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactattgcagctccagtttcctgcagtgatcagggtcctgcaagcagtggggaagggggccaaggtattggaggactccctcccagctttggaagggtcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgattttttttttttttttcagagacggggtctcgcaacattgcccagacttcctttgtgttagttaataaagctttctcaactgcc

SEQ ID NO: 451 - DNA, 2776 bp, Homo sapiens
  ref <308>: DATABASE ACCESSION NUMBER: NM_000211
  ref <309>: DATABASE ENTRY DATE: 2001-06-18
cagggcagactggtagcaaagcccccacgcccagccaggagcaccgccgcggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacggaaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccatctcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggttcttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttggccacagctcttgaggatgtcaccaattaaccagaaatccagttattttccgccctcaaaatgacagccatggccggccggtgcttctgggggctcgtcggggggacagctccactctgactggcacagtctttgcatggagacttgaggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaaataaaacttcaat

SEQ ID NO: 452 - DNA, 5645 bp, Homo sapiens
  ref <308>: DATABASE ACCESSION NUMBER: NM_000213
  ref <309>: DATABASE ENTRY DATE: 2001-06-18
cgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggccgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccatgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactg

SEQ ID NO: 453 - DNA, 1412 bp, Homo sapiens
  ref <308>: DATABASE ACCESSION NUMBER: NM_000224
  ref <309>: DATABASE ENTRY DATE: 2001-06-18
cggggtcgtccgcaaagcctgagtcctgtcctttctctctccccggacagcatgagcttcaccactcgctccaccttctccaccaactaccggtccctgggctctgtccaggcgcccagctacggcgcccggccggtcagcagcgcggccagcgtctatgcaggcgctgggggctctggttcccggatctccgtgtcccgctccaccagcttcaggggcggcatggggtccgggggcctggccaccgggatagccgggggtctggcaggaatgggaggcatccagaacgagaaggagaccatgcaaagcctgaacgaccgcctggcctcttacctggacagagtgaggagcctggagaccgagaaccggaggctggagagcaaaatccgggagcacttggagaagaagggaccccaggtcagagactggagccattacttcaagatcatcgaggacctgagggctcagatcttcgcaaatactgtggacaatgcccgcatcgttctgcagattgacaatgcccgtcttgctgctgatgactttagagtcaagtatgagacagagctggccatgcgccagtctgtggagaacgacatccatgggctccgcaaggtcattgatgacaccaatatcacacgactgcagctggagacagagatcgaggctctcaaggaggagctgctcttcatgaagaagaaccacgaagaggaagtaaaaggcctacaagcccagattgccagctctgggttgaccgtggaggtagatgcccccaaatctcaggacctcgccaagatcatggcagacatccgggcccaatatgacgagctggctcggaagaaccgagaggagctagacaagtactggtctcagcagattgaggagagcaccacagtggtcaccacacagtctgctgaggttggagctgctgagacgacgctcacagagctgagacgtacagtccagtccttggagatcgacctggactccatgagaaatctgaaggccagcttggagaacagcctgagggaggtggaggcccgctacgccctacagatggagcagctcaacgggatcctgctgcaccttgagtcagagctggcacagacccgggcagagggacagcgccaggcccaggagtatgaggccctgctgaacatcaaggtcaagctggaggctgagatcgccacctaccgccgcctgctggaagatggcgaggactttaatcttggtgatgccttggacagcagcaactccatgcaaaccatccaaaagaccaccacccgccggatagtggatggcaaagtggtgtctgagaccaatgacaccaaagttctgaggcattaagccagcagaagcagggtaccctttggggagcaggaggccaataaaaagttcagagttcattggatgtc

SEQ ID NO: 454 - DNA, 1487 bp, Homo sapiens
  ref <308>: DATABASE ACCESSION NUMBER: NM_000239
  ref <309>: DATABASE ENTRY DATE: 2001-06-18
ctagcactctgacctagcagtcaacatgaaggctctcattgttctggggcttgtcctcctttctgttacggtccagggcaaggtctttgaaaggtgtgagttggccagaactctgaaaagattgggaatggatggctacaggggaatcagcctagcaaactggatgtgtttggccaaatgggagagtggttacaacacacgagctacaaactacaatgctggagacagaagcactgattatgggatatttcagatcaatagccgctactggtgtaatgatggcaaaaccccaggagcagttaatgcctgtcatttatcctgcagtgctttgctgcaagataacatcgctgatgctgtagcttgtgcaaagagggttgtccgtgatccacaaggcattagagcatgggtggcatggagaaatcgttgtcaaaacagagatgtccgtcagtatgttcaaggttgtggagtgtaactccagaattttccttcttcagctcattttgtctctctcacattaagggagtaggaattaagtgaaaggtcacactaccattatttccccttcaaacaaataatatttttacagaagcaggagcaaaatatggcctttcttctaagagatataatgttcactaatgtggttattttacattaagcctacaacatttttcagtttgcaaatagaactaatactggtgaaaatttacctaaaaccttggttatcaaatacatctccagtacattccgttcttttttttttttgagacagtctcgctctgtcgcccaggctggagtgcagtggcgcaatctcggctcactgcaacctccacctcccgggttcacgccattctcctgcctcagcctcccgagtagctgggattacgggcgcccgccaccacgcccggctaattttttgtatttttagtagagacagggtttcaccgtgttagccaggatggtctcgatctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgatttcttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacac

SEQ ID NO: 455 - DNA, 3145 bp, Homo sapiens
  ref <308>: DATABASE ACCESSION NUMBER: NM_000251
  ref <309>: DATABASE ENTRY DATE: 2001-06-18
ggcgggaaacagcttagtgggtgtggggtcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctatacggcgcacggcgaggacgcgctgctggccgcccgggaggtgttcaagacccagggggtgatcaagtacatggggccggcaggagcaaagaatctgcagagtgttgtgcttagtaaaatgaattttgaatcttttgtaaaagatcttcttctggttcgtcagtatagagttgaagtttataagaatagagctggaaataaggcatccaaggagaatgattggtatttggcatataaggcttctcctggcaatctctctcagtttgaagacattctctttggtaacaatgatatgtcagcttccattggtgttgtgggtgttaaaatgtccgcagttgatggccagagacaggttggagttgggtatgtggattccatacagaggaaactaggactgtgtgaattccctgataatgatcagttctccaatcttgaggctctcctcatccagattggaccaaaggaatgtgttttacccggaggagagactgctggagacatggggaaactgagacagataattcaaagaggaggaattctgatcacagaaagaaaaaaagctgacttttccacaaaagacatttatcaggacctcaaccggttgttgaaaggcaaaaagggagagcagatgaatagtgctgtattgccagaaatggagaatcaggttgcagtttcatcactgtctgcggtaatcaagtttttagaactcttatcagatgattccaactttggacagtttgaactgactacttttgacttcagccagtatatgaaattggatattgcagcagtcagagcccttaacctttttcagggttctgttgaagataccactggctctcagtctctggctgccttgctgaataagtgtaaaacccctcaaggacaaagacttgttaaccagtggattaagcagcctctcatggataagaacagaatagaggagagattgaatttagtggaagcttttgtagaagatgcagaattgaggcagactttacaagaagatttacttcgtcgattcccagatcttaaccgacttgccaagaagtttcaaagacaagcagcaaacttacaagattgttaccgactctatcagggtataaatcaactacctaatgttatacaggctctggaaaaacatgaaggaaaacaccagaaattattgttggcagtttttgtgactcctcttactgatcttcgttctgacttctccaagtttcaggaaatgatagaaacaactttagatatggatcaggtggaaaaccatgaattccttgtaaaaccttcatttgatcctaatctcagtgaattaagagaaataatgaatgacttggaaaagaagatgcagtcaacattaataagtgcagccagagatcttggcttggaccctggcaaacagattaaactggattccagtgcacagtttggatattactttcgtgtaacctgtaaggaagaaaaagtccttcgtaacaataaaaactttagtactgtagatatccagaagaatggtgttaaatttaccaacagcaaattgacttctttaaatgaagagtataccaaaaataaaacagaatatgaagaagcccaggatgccattgttaaagaaattgtcaatatttcttcaggctatgtagaaccaatgcagacactcaatgatgtgttagctcagctagatgctgttgtcagctttgctcacgtgtcaaatggagcacctgttccatatgtacgaccagccattttggagaaaggacaaggaagaattatattaaaagcatccaggcatgcttgtgttgaagttcaagatgaaattgcatttattcctaatgacgtatactttgaaaaagataaacagatgttccacatcattactggccccaatatgggaggtaaatcaacatatattcgacaaactggggtgatagtactcatggcccaaattgggtgttttgtgccatgtgagtcagcagaagtgtccattgtggactgcatcttagcccgagtaggggctggtgacagtcaattgaaaggagtctccacgttcatggctgaaatgttggaaactgcttctatcctcaggtctgcaaccaaagattcattaataatcatagatgaattgggaagaggaacttctacctacgatggatttgggttagcatgggctatatcagaatacattgcaacaaagattggtgctttttgcatgtttgcaacccattttcatgaacttactgccttggccaatcagataccaactgttaataatctacatgtcacagcactcaccactgaagagaccttaactatgctttatcaggtgaagaaaggtgtctgtgatcaaagttttgggattcatgttgcagagcttgctaatttccctaagcatgtaatagagtgtgctaaacagaaagccctggaacttgaggagtttcagtatattggagaatcgcaaggatatgatatcatggaaccagcagcaaagaagtgctatctggaaagagagcaaggtgaaaaaattattcaggagttcctgtccaaggtgaaacaaatgccctttactgaaatgtcagaagaaaacatcacaataaagttaaaacagctaaaagctgaagtaatagcaaagaataatagctttgtaaatgaaatcatttcacgaataaaagttactacgtgaaaaatcccagtaatggaatgaaggtaatattgataagctattgtctgtaatagttttatattgttttatattaaccctttttccatagtgttaactgtcagtgcccatgggctatcaacttaataagatatttagtaatattttactttgaggacattttcaaagatttttattttgaaaaatgagagctgtaactgaggactgtttgcaattgacataggcaataataagtgatgtgctgaattttataaataaaatcatgtagtttgtgg

SEQ ID NO: 456 - DNA, 2257 bp, Homo sapiens
  ref <308>: DATABASE ACCESSION NUMBER: NM_000268
  ref <309>: DATABASE ENTRY DATE: 2001-06-18
acggcagccgtcagggaccgtcccccaactcccctttccgctcaggcagggtcctcgcggcccatgctggccgctggggacccgcgcagcccagaccgttcccgggccggccagccggcaccatggtggccctgaggcctgtgcagcaactccaggggggctaaagggctcagagtgcaggccgtggggcgcgagggtcccgggcctgagccccgcgccatggccggggccatcgcttcccgcatgagcttcagctctctcaagaggaagcaacccaagacgttcaccgtgaggatcgtcaccatggacgccgagatggagttcaattgcgagatgaagtggaaagggaaggacctctttgatttggtgtgccggactctggggctccgagaaacctggttctttggactgcagtacacaatcaaggacacagtggcctggctcaaaatggacaagaaggtactggatcatgatgtttcaaaggaagaaccagtcacctttcacttcttggccaaattttatcctgagaatgctgaagaggagctggttcaggagatcacacaacatttattcttcttacaggtaaagaagcagattttagatgaaaagatctactgccctcctgaggcttctgtgctcctggcttcttacgccgtccaggccaagtatggtgactacgaccccagtgttcacaagcggggatttttggcccaagaggaattgcttccaaaaagggtaataaatctgtatcagatgactccggaaatgtgggaggagagaattactgcttggtacgcagagcaccgaggccgagccagggatgaagctgaaatggaatatctgaagatagctcaggacctggagatgtacggtgtgaactactttgcaatccggaataaaaagggcacagagctgctgcttggagtggatgccctggggcttcacatttatgaccctgagaacagactgacccccaagatctccttcccgtggaatgaaatccgaaacatctcgtacagtgacaaggagtttactattaaaccactggataagaaaattgatgtcttcaagtttaactcctcaaagcttcgtgttaataagctgattctccagctatgtatcgggaaccatgatctatttatgaggagaaggaaagccgattctttggaagttcagcagatgaaagcccaggccagggaggagaaggctagaaagcagatggagcggcagcgcctcgctcgagagaagcagatgagggaggaggctgaacgcacgagggatgagttggagaggaggctgctgcagatgaaagaagaagcaacaatggccaacgaagcactgatgcggtctgaggagacagctgacctgttggctgaaaaggcccagatcaccgaggaggaggcaaaacttctggcccagaaggccgcagaggctgagcaggaaatgcagcgcatcaaggccacagcgattcgcacggaggaggagaagcgcctgatggagcagaaggtgctggaagccgaggtgctggcactgaagatggctgaggagtcagagaggagggccaaagaggcagatcagctgaagcaggacctgcaggaagcacgcgaggcggagcgaagagccaagcagaagctcctggagattgccaccaagcccacgtacccgcccatgaacccaattccagcaccgttgcctcctgacataccaagcttcaacctcattggtgacagcctgtctttcgacttcaaagatactgacatgaagcggctttccatggagatagagaaagaaaaagtggaatacatggaaaagagcaagcatctgcaggagcagctcaatgaactcaagacagaaatcgaggccttgaaactgaaagagagggagacagctctggatattctgcacaatgagaactccgacaggggtggcagcagcaagcacaataccattaaaaagctcaccttgcagagcgccaagtcccgagtggccttctttgaagagctctagcaggtgacccagccaccccaggacctgccacttctcctgctaccgggaccgcgggatggaccagatatcaagagagccatccatagggagctggctgggggtttccgtgggagctccagaactttccccagctgagtgaagagcccagcccctcttatgtgcaattgccttgaactacgaccctgtagagatttctctcatggcgttctagttctctgacctgagtctttgttttaagaagtatttgtct

SEQ ID NO: 457 - DNA, 732 bp, Homo sapiens
  ref <308>: DATABASE ACCESSION NUMBER: NM_000269
  ref <309>: DATABASE ENTRY DATE: 2001-06-18
tgctgcgaaccacgtgggtcccgggcgcgtttcgggtgctggcggctgcagccggagttcaaacctaagcagctggaaggaaccatggccaactgtgagcgtaccttcattgcgatcaaaccagatggggtccagcggggtcttgtgggagagattatcaagcgttttgagcagaaaggattccgccttgttggtctgaaattcatgcaagcttccgaagatcttctcaaggaacactacgttgacctgaaggaccgtccattctttgccggcctggtgaaatacatgcactcagggccggtagttgccatggtctgggaggggctgaatgtggtgaagacgggccgagtcatgctcggggagaccaaccctgcagactccaagcctgggaccatccgtggagacttctgcatacaagttggcaggaacattatacatggcagtgattctgtggagagtgcagagaaggagatcggcttgtggtttcaccctgaggaactggtagattacacgagctgtgctcagaactggatctatgaatgacaggagggcagaccacattgcttttcacatccatttcccctccttcccatgggcagaggaccaggctgtaggaaatctagttatttacaggaacttcatcataatttggagggaagctcttggagctgtgagttctccctgtacagtgttaccatccccgaccatctgattaaaatgcttcctcccagc

SEQ ID NO: 458 - DNA, 1418 bp, Homo sapiens
  ref <308>: DATABASE ACCESSION NUMBER: NM_000270
  ref <309>: DATABASE ENTRY DATE: 2001-06-18
aactgtgcgaaccagacccggcagccttgctcagttcagcatagcggagcggatccgatcggatcggagcacaccggagcaggctcatcgagaaggcgtctgcgagaccatggagaacggatacacctatgaagattataagaacactgcagaatggcttctgtctcatactaagcaccgacctcaagttgcaataatctgtggttctggattaggaggtctgactgataaattaactcaggcccagatctttgactacagtgaaatccccaactttcctcgaagtacagtgccaggtcatgctggccgactggtgtttgggttcctgaatggcagggcctgtgtgatgatgcagggcaggttccacatgtatgaagggtacccactctggaaggtgacattcccagtgagggttttccaccttctgggtgtggacaccctggtagtcaccaatgcagcaggagggctgaaccccaagtttgaggttggagatatcatgctgatccgtgaccatatcaacctacctggtttcagtggtcagaaccctctcagagggcccaatgatgaaaggtttggagatcgtttccctgccatgtctgatgcctacgaccggactatgaggcagagggctctcagtacctggaaacaaatgggggagcaacgtgagctacaggaaggcacctatgtgatggtggcaggccccagctttgagactgtggcagaatgtcgtgtgctgcagaagctgggagcagacgctgttggcatgagtacagtaccagaagttatcgttgcacggcactgtggacttcgagtctttggcttctcactcatcactaacaaggtcatcatggattatgaaagcctggagaaggccaaccatgaagaagtcttagcagctggcaaacaagctgcacagaaattggaacagtttgtctccattcttatggccagcattccactccctgacaaagccagttgacctgccttggagtcgtctggcatctcccacacaagacccaagtagctgctaccttctttggccccttgctggagtcatgtgcctctgtccttaggttgtagcagaaaggaaaagattcctgtccttcacctttcccactttcttctaccagacccttctggtgccagatcctcttctcaaagctgggattacaggtgtgagcatagtgagaccttggcgctacaaaataaagctgttctcattcctgttctttcttacacaagagctggagcccgtgccctaccacacatctgtggagatgcccaggatttgactcgggccttagaactttgcatagcagctgctactagctctttgagataatacattccgaggggctcagttctgccttatctaaatcaccagagaccaaacaaggactaatccaatacctcttgga

SEQ ID NO: 459 - DNA, 4673 bp, Homo sapiens
  ref <308>: DATABASE ACCESSION NUMBER: NM_000271
  ref <309>: DATABASE ENTRY DATE: 2001-06-18
tttgctcctgctcctccgctcctcctgcgcggggtgctgaaacagcccggggaagtagagccgcctccggggagcccaaccagccgaacgccgccggcgtcagcagccttgcgcggccacagcatgaccgctcgcggcctggcccttggcctcctcctgctgctactgtgtccagcgcaggtgttttcacagtcctgtgtttggtatggagagtgtggaattgcatatggggacaagaggtacaattgcgaatattctggcccaccaaaaccattgccaaaggatggatatgacttagtgcaggaactctgtccaggattcttctttggcaatgtcagtctctgttgtgatgttcggcagcttcagacactaaaagacaacctgcagctgcctctacagtttctgtccagatgtccatcctgtttttataacctactgaacctgttttgtgagctgacatgtagccctcgacagagtcagtttttgaatgttacagctactgaagattatgttgatcctgttacaaaccagacgaaaacaaatgtgaaagagttacaatactacgtcggacagagttttgccaatgcaatgtacaatgcctgccgggatgtggaggccccctcaagtaatgacaaggccctgggactcctgtgtgggaaggacgctgacgcctgtaatgccaccaactggattgaatacatgttcaataaggacaatggacaggcaccttttaccatcactcctgtgttttcagattttccagtccatgggatggagcccatgaacaatgccaccaaaggctgtgacgagtctgtggatgaggtcacagcaccatgtagctgccaagactgctctattgtctgtggccccaagccccagcccccacctcctcctgctccctggacgatccttggcttggacgccatgtatgtcatcatgtggatcacctacatggcgtttttgcttgtgttttttggagcattttttgcagtgtggtgctacagaaaacggtattttgtctccgagtacactcccatcgatagcaatatagctttttctgttaatgcaagtgacaaaggagaggcgtcctgctgtgaccctgtcagcgcagcatttgagggctgcttgaggcggctgttcacacgctgggggtctttctgcgtccgaaaccctggctgtgtcattttcttctcgctggtcttcattactgcgtgttcgtcaggcctggtgtttgtccgggtcacaaccaatccagttgacctctggtcagcccccagcagccaggctcgcctggaaaaagagtactttgaccagcactttgggcctttcttccggacggagcagctcatcatccgggcccctctcactgacaaacacatttaccagccatacccttcgggagctgatgtaccctttggacctccgcttgacatacagatactgcaccaggttcttgacttacaaatagccatcgaaaacattactgcctcttatgacaatgagactgtgacacttcaagacatctgcttggcccctctttcaccgtataacacgaactgcaccattttgagtgtgttaaattacttccagaacagccattccgtgctggaccacaagaaaggggacgacttctttgtgtatgccgattaccacacgcactttctgtactgcgtacgggctcctgcctctctgaatgatacaagtttgctccatgacccttgtctgggtacgtttggtggaccagtgttcccgtggcttgtgttgggaggctatgatgatcaaaactacaataacgccactgcccttgtgattaccttccctgtcaataattactataatgatacagagaagctccagagggcccaggcctgggaaaaagagtttattaattttgtgaaaaactacaagaatcccaatctgaccatttccttcactgctgaacgaagtattgaagatgaactaaatcgtgaaagtgacagtgatgtcttcaccgttgtaattagctatgccatcatgtttctatatatttccctagccttggggcacatcaaaagctgtcgcaggcttctggtggattcgaaggtctcactaggcatcgcgggcatcttgatcgtgctgagctcggtggcttgctccttgggtgtcttcagctacattgggttgcccttgaccctcattgtgattgaagtcatcccgttcctggtgctggctgttggagtggacaacatcttcattctggtgcaggcctaccagagagatgaacgtcttcaaggggaaaccctggatcagcagctgggcagggtcctaggagaagtggctcccagtatgttcctgtcatccttttctgagactgtagcatttttcttaggagcattgtccgtgatgccagccgtgcacaccttctctctctttgcgggattggcagtcttcattgactttcttctgcagattacctgtttcgtgagtctcttggggttagacattaaacgtcaagagaaaaatcggctagacatcttttgctgtgtcagaggtgctgaagatggaacaagcgtccaggcctcagagagctgtttgtttcgcttcttcaaaaactcctattctccacttctgctaaaggactggatgagaccaattgtgatagcaatatttgtgggtgttctgtcattcagcatcgcagtcctgaacaaagtagatattggattggatcagtctctttcgatgccagatgactcctacatggtggattatttcaaatccatcagtcagtacctgcatgcgggtccgcctgtgtactttgtcctggaggaagggcacgactacacttcttccaaggggcagaacatggtgtgcggcggcatgggctgcaacaatgattccctggtgcagcagatatttaacgcggcgcagctggacaactatacccgaataggcttcgccccctcgtcctggatcgacgattatttcgactgggtgaagccacagtcgtcttgctgtcgagtggacaatatcactgaccagttctgcaatgcttcagtggttgaccctgcctgcgttcgctgcaggcctctgactccggaaggcaaacagaggcctcaggggggagacttcatgagattcctgcccatgttcctttcggataaccctaaccccaagtgtggcaaagggggacatgctgcctatagttctgcagttaacatcctccttggccatggcaccagggtcggagccacgtacttcatgacctaccacaccgtgctgcagacctctgctgactttattgacgctctgaagaaagcccgacttatagccagtaatgtcaccgaaaccatgggcattaacggcagtgcctaccgagtatttccttacagtgtgttttatgtcttctacgaacagtacctgaccatcattgacgacactatcttcaacctcggtgtgtccctgggcgcgatatttctggtgaccatggtcctcctgggctgtgagctctggtctgcagtcatcatgtgtgccaccatcgccatggtcttggtcaacatgtttggagttatgtggctctggggcatcagtctgaacgctgtatccttggtcaacctggtgatgagctgtggcatctccgtggagttctgcagccacataaccagagcgttcacggtgagcatgaaaggcagccgcgtggagcgcgcggaagaggcacttgcccacatgggcagctccgtgttcagtggaatcacacttacaaaatttggagggattgtggtgttggcttttgccaaatctcaaattttccagatattctacttcaggatgtatttggccatggtcttactgggagccactcacggattaatatttctccctgtcttactcagttacatagggccatcagtaaataaagccaaaagttgtgccactgaagagcgatacaaaggaacagagcgcgaacggcttctaaatttctagccctctcgcagggcatcctgactgaactgtgtctaagggtcggtcggtttaccactggacgggtgctgcatcggcaaggccaagttgaacaccggatggtgccaaccatcggttgtttggcagcagctttgaacgtagcgcctgtgaactcaggaatgcacagttgacttgggaagcagtattactagatctggaggcaaccacaggacactaaacttctcccagcctcttcaggaaagaaacctcattctttggcaagcaggaggtgacactagatggctgtgaatgtgatccgctcactgacactctgtaaaggccaatcaatgcactgtctgtcctctcctttttaggagtaagccatcccacaagttctataccatatttttagtgacagttgaggttgtagatacactttataacattttatagtttaaagagctttattaatgcaataaattaactttgtacacatttttatataaaaaaacagcaagtgatttcagaatgttgtaggcctcattagagcttggtctccaaaaatctgtttgaaaaaagcaacatgttcttcacagtgttcccctagaaaggaagagatttaattgccagttagatgtggcatgaaatgagggacaaagaaagcatctcgtaggtgtgtctactgggttttaacttatttttctttaataaaatacattgttttcctaaaaaaaaaa

SEQ ID NO: 460 - DNA, 3231 bp, Homo sapiens
  ref <308>: DATABASE ACCESSION NUMBER: NM_000283
  ref <309>: DATABASE ENTRY DATE: 2001-06-18
ctccagggacaggcagccaccatgagcctcagtgaggagcaggcccggagctttctggaccagaaccccgattttgcccgccagtactttgggaagaaactgagccctgagaatgttggccgcggctgcgaggacgggtgcccgccggactgcgacagcctccgggacctctgccaggtggaggagagcacggcgctgctggagctggtgcaggatatgcaggagagcatcaacatggagcgcgtggtcttcaaggtcctgcggcgcctctgcaccctcctgcaggccgaccgctgcagcctcttcatgtaccgccagcgcaacggcgtggccgagctggccaccaggcttttcagcgtgcagccggacagcgtcctggaggactgcctggtgccccccgactccgagatcgtcttcccactggacatcggggtcgtgggccacgtggctcagaccaaaaagatggtgaacgtcgaggacgtggccgagtgccctcacttcagctcatttgctgacgagctcactgactacaagacaaagaatatgctggccacacccatcatgaatggcaaagacgtcgtggcggtgatcatggcagtgaacaagctcaacggcccattcttcaccagcgaagacgaagatgtgttcttgaagtacctgaattttgccacgttgtacctgaagatctatcacctgagctacctccacaactgcgagacgcgccgcggccaggtgctgctgtggtcggccaacaaggtgtttgaggagctgacggacatcgagaggcagttccacaaggccttctacacggtgcgggcctacctcaactgcgagcggtactccgtgggcctcctggacatgaccaaggagaaggaattttttgacgtgtggtctgtgctgatgggagagtcccagccgtactcgggcccacgcacgcctgatggccgggaaattgtcttctacaaagtgatcgactacatcctccacggcaaggaggagatcaaggtcattcccacaccctcagccgatcactgggccctggccagcggccttccaagctacgtggcagaaagcggctttatttgtaacatcatgaatgcttccgctgacgaaatgttcaaatttcaggaaggggccctggacgactccgggtggctcatcaagaatgtgctgtccatgcccatcgtcaacaagaaggaggagattgtgggagtcgccacattttacaacaggaaagacgggaagccctttgacgaacaggacgaggttctcatggagtccctgacacagttcctgggctggtcagtgatgaacaccgacacctacgacaagatgaacaagctggagaaccgcaaggacatcgcacaggacatggtcctttaccacgtgaagtgcgacagggacgagatccagctcatcctgccaaccagagcgcgcctggggaaggagcctgctgactgcgatgaggacgagctgggcgaaatcctgaaggaggagctgccagggcccaccacatttgacatctacgaattccacttctctgacctggagtgcaccgaactggacctggtcaaatgtggcatccagatgtactacgagctgggcgtggtccgaaagttccagatcccccaggaggtcctggtgcggttcctgttctccatcagcaaagggtaccggagaatcacctaccacaactggcgccacggcttcaacgtggcccagacgatgttcacgctgctcatgaccggcaaactgaagagctactacacggacctggaggccttcgccatggtgacagccggcctgtgccatgacatcgaccaccgcggcaccaacaacctgtaccagatgaagtcccagaaccccttggctaagctccacggctcctcgattttggagcggcaccacctggagtttgggaagttcctgctctcggaggagaccctgaacatctaccagaacctgaaccggcggcagcacgagcacgtgatccacctgatggacatcgccatcatcgccacggacctggccctgtacttcaagaagagagcgatgtttcagaagatcgtggatgagtccaagaactaccaggacaagaagagctgggtggagtacctgtccctggagacgacccggaaggagatcgtcatggccatgatgatgacagcctgcgacctgtctgccatcaccaagccctgggaagtccagagcaaggtcgcacttctcgtggctgctgagttctgggagcaaggtgacttggaaaggacagtcttggatcagcagcccattcctatgatggaccggaacaaggcggccgagctccccaagctgcaagtgggcttcatcgacttcgtgtgcacattcgtgtacaaggagttctctcgtttccacgaagagatcctgcccatgttcgaccgactgcagaacaataggaaagagtggaaggcgctggctgatgagtatgaggccaaagtgaaggctctggaggagaaggaggaggaggagagggtggcagccaagaaagtaggcacagaaatttgcaatggcggcccagcacccaagtcttcaacctgctgtatcctgtgagcactggtcccgtggggaccctatggctccctcaatcttcacccactaggatttgggttctgcctgtggctatttgctacaagaggttaggaagcccaagaaaatgactgaagatcattctggatattttaattttttttttttttttttttttgagatggagtcttgctctgtcacccaggctggagtgccgtggcacgatctcagctcactgcaacctccacctcccaggttcaagcgattctcgtgcctcagcctcctgagtagctgggactacaggcgcccaccaccacacatgctaatttttgtattttcagtacagatggggtttcaccatattgggcaggctggtctcgaactcctgacctcaggtgatcaccgcctcagcttcctgaagtgctgggattacaggcatgagccaccacgcccagcctgtttttataaactgaagccaactgtgaataaactgtagcctacattactcatccatttttggatagttaccactgggagacctttgaaaagggtccatgaactctgaaatcactgagaacatttgcagccacacatgtacatatgtgtacacaggtagacagatggacacaggccgtttctcatccagtttaggaaaacacacatgctcag

SEQ ID NO: 461 - DNA, 1472 bp, Homo sapiens
  ref <308>: DATABASE ACCESSION NUMBER: NM_000284
  ref <309>: DATABASE ENTRY DATE: 2001-06-18
actgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccggcaagcagagtgctggtagcatcccgtaattttgcaaatgatgctacatttgaaattaagaaatgtgaccttcaccggctggaagaaggccctcctgtcacaacagtgctcaccagggaggatgggctcaaatactacaggatgatgcagactgtacgccgaatggagttgaaagcagatcagctgtataaacagaaaattattcgtggtttctgtcacttgtgtgatggtcaggaagcttgctgtgtgggcctggaggccggcatcaaccccacagaccatctcatcacagcctaccgggctcacggctttactttcacccggggcctttccgtccgagaaattctcgcagagcttacaggacgaaaaggaggttgtgctaaagggaaaggaggatcgatgcacatgtatgccaagaacttctacgggggcaatggcatcgtgggagcgcaggtgcccctgggcgctgggattgctctagcctgtaagtataatggaaaagatgaggtctgcctgactttatatggcgatggtgctgctaaccagggccagatattcgaagcttacaacatggcagctttgtggaaattaccttgtattttcatctgtgagaataatcgctatggaatgggaacgtctgttgagagagcggcagccagcactgattactacaagagaggcgatttcattcctgggctgagagtggatggaatggatatcctgtgcgtccgagaggcaacaaggtttgctgctgcctattgtagatctgggaaggggcccatcctgatggagctgcagacttaccgttaccacggacacagtatgagtgaccctggagtcagttaccgtacacgagaagaaattcaggaagtaagaagtaagagtgaccctattatgcttctcaaggacaggatggtgaacagcaatcttgccagtgtggaagaactaaaggaaattgatgtggaagtgaggaaggagattgaggatgctgcccagtttgccacggccgatcctgagccacctttggaagagctgggctaccacatctactccagcgacccaccttttgaagttcgtggtgccaatcagtggatcaagtttaagtcagtcagttaaggggaggagaaggagaggttataccttcagggggctaccagacagtgttctcaacttggttaaggaggaagaaaacccagtcaatgaaattcaatgaaattcttggaaacttccattaagtgtgtagattgagcaggtagtaattgcatgcagtttgtacattagtgcattaaaagatgaattattgagtgctt

SEQ ID NO: 462 - DNA, 2609 bp, Homo sapiens
  ref <308>: DATABASE ACCESSION NUMBER: NM_000286
  ref <309>: DATABASE ENTRY DATE: 2001-06-18
cgcccgggcaggtctcccttcaaacgtggcgtcgtgggttgtttgcgcctcgcctggggtcagcgagcaaggacgggcgcgggcggggatactcaaagccaacagctggagtcagccctcgtgtcccgggctcacagtggcacgactgaatcctcagagtcggctggcttttgagctctcacgattggggaggagggggcgtttctggttcgcagctccagaggattgcgttccttcccccatacctgtcccccacagtcacgctctgccctgacgtgcagcatttgacaagttaccccctcgccacatactacttccacccacgtccgagttaactttgttcttaaccttcttgagactaccctcggcctccaggtctttttttcccagttcatttttgcccataagattgagtttcgagtttcagatatcatgcagaaagtttacctttaagactgagcacccatctgatactcttcctcccgaaaaagttcatgctcacgagagagtttgtgggaaaagtgaaagccagtacacgcaggaaactatggctgagcacggggctcacttcacagctgcttctgtggccgatgaccagccatccatctttgaggtggtagcacaggacagtttaatgacagcagtgagacccgctcttcagcatgtggtcaaggttcttgcagaatcaaatcccacccactatggcttcttgtggaggtggtttgatgaaatctttactctgctagatcttctgctccagcaacattatctgtctagaaccagtgcctcattttctgaaaacttttacggcttaaagagaattgtaatgggggacactcacaagtctcagagattggctagtgctggtctcccaaagcagcagctttggaaatctattatgttcctggttcttcttccctatctgaaagtgaagctggagaagctggtttctagcctgagagaagaggatgaatattctattcatcccccttcttcccgctggaaacgattttacagagctttcctggcagcctacccatttgtgaacatggcctgggaaggatggtttcttgtacaacaacttcgatacatcctaggaaaagctcagcatcactcaccactgctgaggctggctggagttcagctaggtcgactgacagttcaggatatacaagctctggagcacaaaccagctaaggccagcatgatgcagcaaccagccaggagtgttagtgagaagataaactcagctctgaagaaagctgttgggggtgttgccttatccctgtctactggcctttctgtgggtgtattcttcttgcagttccttgactggtggtactcatctgaaaatcaagaaaccatcaagtcattgactgccctgcctactccaccaccacctgtacacctagactataactctgattctcccctcttacccaaaatgaagactgtgtgcccactgtgtcgtaaaacccgggtgaatgatactgttcttgccacctctggctatgtgttttgttaccgctgtgtgtttcattatgtgaggagtcaccaagcttgtcccatcacaggttatccaacagaagtacaacatctgattaaactctactcccctgagaactgaaagggaatcatgtcttatcctcacaacaaaagtattgcgctgtaatgtcacagagctggtttcagcatggtattgagttgacacttctcagcctcaattcataactatatgaactttaaatgattatatggatttctttaaaaggatatgcccatttgatcctaaccttttagcctgctctctagaaccctacttacagttgaccaagctgcttaaagtagaaggatcaggactggcaggggatatgagggccagtgtagagattaaacagaataatgagtacacaagtttttgcctatccctttccttaaaatataagaaataaaggagctcttacgaaaaacccaggttagaccgcataaaaaataaagtgaacagtgaggtggtagcaagacttctttttagaaaagaaagcatttacctgcctgtctgtaaggtggaaatttcatcagtttgcaaacgataagaaatgcagacttgctcttgatagaaatgcttagaaacactctgggggggaaaaaagctccttccatatactgtgagacatttgttaagtgacatctattgtttatcagcttttaaggataaaaaaggtattttaaaagttggatatttaggatatttgaggatattcctttatgagctctccatatccttcttgagaaactggttaaaaaaggaataggggtagagtgttacagagagtagtctgaagattcctgtgtaaaagcaaagctaacaagcaatgaagacatgaagcaaaatactaatctaattgtgtaaagaaaggatattttaataagttctttctgcttgctgctaagagtttgctaaagtgtcatgaattattctggttattactaaagtttctatgaaacaagtagattttaagaataaatgtttctggaaaaggactatgttatgattttgtagaaatgtaaagattacttgaggtgtttaaaataaatttttcattcagact

SEQ ID NO: 463 - DNA, 1767 bp, Homo sapiens
  ref <308>: DATABASE ACCESSION NUMBER: NM_000291
  ref <309>: DATABASE ENTRY DATE: 2001-06-18
aagcctccggagcgcacgtcggcagtcggctccctcgttgaccgaatcaccgacctctctccccagctgtatttccaaaatgtcgctttctaacaagctgacgctggacaagctggacgttaaagggaagcgggtcgttatgagagtcgacttcaatgttcctatgaagaacaaccagataacaaacaaccagaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaaggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggttaaagccgagccagccaaaatagaagctttccgagcttcactttccaagctaggggatgtctatgtcaatgatgcttttggcactgctcacagagcccacagctccatggtaggagtcaatctgccacagaaggctggtgggtttttgatgaagaaggagctgaactactttgcaaaggccttggagagcccagagcgacccttcctggccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaaggtaaagtccttcctggggtggatgctctcagcaatatttagtactttcctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgttaaaaagaaagtgagcagtgttagcttagttctcttttgatgtaggttattatgattagctttgtcactgtttcactactcagcatggaaacaagatgaaattccatttgtaggtagtgagacaaaattgatgatccattaagtaaacaataaaagtgtccattg

SEQ ID NO: 464 - DNA, 2680 bp, Homo sapiens
  ref <308>: DATABASE ACCESSION NUMBER: NM_000299
  ref <309>: DATABASE ENTRY DATE: 2001-06-18
ggggtggtgcagggcaggggtggtatatcctgtctgacggagggcgggcctcgccagtgccagagagggacgaaccagggtggaagcgccaggagcagctgcagggagccctcacgcggacctcgcactctatggccgtagggagccgctgagagcgagaagagcacgctcctgcccgcccgctgcaccgcacctcgcctcgcctctctgctctcctaggccccggccgcgcgccacccgcctcccgccaccatgaaccactcgccgctcaagaccgccttggcgtacgaatgcttccaggaccaggacaactccacgttggctttgccgtcggaccaaaagatgaaaacaggcacgtctggcaggcagcgcgtgcaggagcaggtgatgatgaccgtcaagcggcagaagtccaagtcttcccagtcgtccaccctgagccactccaatcgaggttccatgtatgatggcttggctgacaattacaactatgggaccaccagcaggagcagctactactccaagttccaggcagggaatggctcatggggatatccgatctacaatggaaccctcaagcgggagcctgacaacaggcgcttcagctcctacagccagatggagaactggagccggcactacccccggggcagctgtaacaccaccggcgcaggcagcgacatctgcttcatgcagaaaatcaaggcgagccgcagtgagcccgacctctactgtgacccacggggcaccctgcgcaagggcacgctgggcagcaagggccagaagaccacccagaaccgctacagcttttacagcacctgcagtggtcagaaggccataaagaagtgccctgtgcgcccgccctcttgtgcctccaagcaggaccctgtgtatatcccgcccatctcctgcaacaaggacctgtcctttggccactctagggccagctccaagatctgcagtgaggacatcgagtgcagtgggctgaccatccccaaggctgtgcagtacctgagctcccaggatgagaagtaccaggccattggggcctattacatccagcatacctgcttccaggatgaatctgccaagcaacaggtctatcagctgggaggcatctgcaagctggtggacctcctccgcagccccaaccagaacgtccagcaggccgcggcaggggccctgcgcaacctggtgttcaggagcaccaccaacaagctggagacccggaggcagaatgggatccgcgaggcagtcagcctcctgaggagaaccgggaacgccgagatccagaagcagctgactgggctgctctggaacctgtcttccactgacgagctgaaggaggaactcattgccgacgccctgcctgttctggccgaccgcgtcatcattcccttctctggctggtgcgatggcaatagcaacatgtcccgggaagtggtggaccctgaggtcttcttcaatgccacaggctgcttgaggaacctgagctcggccgatgcaggccgccagaccatgcgtaactactcagggctcattgattccctcatggcctatgtccagaactgtgtagcggccagccgctgtgacgacaagtctgtggaaaactgcatgtgtgttctgcacaacctctcctaccgcctggacgccgaggtgcccacccgctaccgccagctggagtataacgcccgcaacgcctacaccgagaagtcctccactggctgcttcagcaacaagagcgacaagatgatgaacaacaactatgactgccccctgcctgaggaagagaccaaccccaagggcagcggctggttgtaccattcagatgccatccgcacctacctgaacctcatgggcaagagcaagaaagatgctaccctggaggcctgtgctggtgccctgcagaacctgacagccagcaaggggctgatgtccagtggcatgagccagttgattgggctgaaggaaaagggcctgccacaaattgcccgcctcctgcaatctggcaactctgatgtggtgcggtccggagcctccctcctgagcaacatgtcccgccaccctctgctgcacagagtgatggggaaccaggtgttcccggaggtgaccaggctcctcaccagccacactggcaataccagcaactccgaagacatcttgtcctcggcctgctacactgtgaggaacctgatggcctcgcagccacaactggccaagcagtacttctccagcagcatgctcaacaacatcatcaacctgtgccgaagcagtgcctcacccaaggccgcagaagctgcccggcttctcctgtctgacatgtggtccagcaaggaactgcagggtgtcctcagacagcaaggtttcgataggaacatgctgggaaccttagctggggccaacagcctcaggaacttcacctcccgattctaagaagagactgtccaagcaagttaggcttgcaggaagatatgacccagctgagaagccctcaggcctcgctggatggggttttctgtccatcctgtgcagtatttgggaaagttcacaagaaactgagaagaaacctaaaaactgtggatagtggaaagatttttagattttttttttccttggggaaactggcaggcaatgggggttagggaggttggggcggggggggctttcttgagttaaaggg

SEQ ID NO: 465 - DNA, 854 bp, Homo sapiens
  ref <308>: DATABASE ACCESSION NUMBER: NM_000300
  ref <309>: DATABASE ENTRY DATE: 2001-06-18
gaattcccaactctggagtcctctgagagagccaccaaggaggagcaggggagcgacggccggggcagaagttgagaccacccagcagaggagctaggccagtccatctgcatttgtcacccaagaactcttaccatgaagaccctcctactgttggcagtgatcatgatctttggcctactgcaggcccatgggaatttggtgaatttccacagaatgatcaagttgacgacaggaaaggaagccgcactcagttatggcttctacggctgccactgtggcgtgggtggcagaggatcccccaaggatgcaacggatcgctgctgtgtcactcatgactgttgctacaaacgtctggagaaacgtggatgtggcaccaaatttctgagctacaagtttagcaactcggggagcagaatcacctgtgcaaaacaggactcctgcagaagtcaactgtgtgagtgtgataaggctgctgccacctgttttgctagaaacaagacgacctacaataaaaagtaccagtactattccaataaacactgcagagggagcacccctcgttgctgagtcccctcttccctggaaaccttccacccagtgctgaatttccctctctcataccctccctccctaccctaaccaagttccttggccatgcagaaagcatccctcacccatcctagaggccaggcaggagcccttctatacccacccagaatgagacatccagcagatttccagccttctactgctctcctccacctcaactccgtgcttaaccaaagaagctgtactccggggggtctcttctgaataaagcaattagcaaatcaaaaaaaaaaaaggaattc

SEQ ID NO: 466 - DNA, 2279 bp, Homo sapiens
  ref <308>: DATABASE ACCESSION NUMBER: NM_000310
  ref <309>: DATABASE ENTRY DATE: 2001-06-18
ggcacgagcgaagatggcgtcgcccggctgcctgtggctcttggctgtggctctcctgccatggacctgcgcttctcgggcgctgcagcatctggacccgccggcgccgctgccgttggtgatctggcatgggatgggagacagctgttgcaatcccttaagcatgggtgctattaaaaaaatggtggagaagaaaatacctggaatttacgtcttatctttagagattgggaagaccctgatggaggacgtggagaacagcttcttcttgaatgtcaattcccaagtaacaacagtgtgtcaggcacttgctaaggatcctaaattgcagcaaggctacaatgctatgggattctcccagggaggccaatttctgagggcagtggctcagagatgcccttcacctcccatgatcaatctgatctcggttgggggacaacatcaaggtgtttttggactccctcgatgcccaggagagagctctcacatctgtgacttcatccgaaaaacactgaatgctggggcgtactccaaagttgttcaggaacgcctcgtgcaagccgaatactggcatgaccccataaaggaggatgtgtatcgcaaccacagcatcttcttggcagatataaatcaggagcggggtatcaatgagtcctacaagaaaaacctgatggccctgaagaagtttgtgatggtgaaattcctcaatgattccattgtggaccctgtagattcggagtggtttggattttacagaagtggccaagccaaggaaaccattcccttacaggagacctccctgtacacacaggaccgcctggggctaaaggaaatggacaatgcaggacagctagtgtttctggctacagaaggggaccatcttcagttgtctgaagaatggttttatgcccacatcataccattccttggatgaaacccgtatagttcacaatagagctcagggagcccctaactcttccaaaccacatgggagacagtttccttcatgcccaagcctgagctcagatccagcttgcaactaatccttctatcatctaacatgcactacttggaaagatctaagatctgaatcttatcctttgccatcttctgttaccatatggtgttgaatgcaagtttaattaccatggagattgttttacaaacttttgatgtggtcaagttcagttttagaaaagggagtctgttccagatcagggccagaactgtgcccaggcccaaaggagacaactaactaaagtagtgagatagattctaagggcaaacatttttccaagtcttgccatatttcaagcaaagaggtgcccaggcctgaggtactcacataaatgctttgttttgctggtgatttaaccagtgcttggaaaaatcttgcttggctatttctgcatcatttcttaaggctgccttcctctctgagtacgttgccctctgtgctatcaatcatcttatcatcaattattagacaaatcccactggcctacagtcttgcttctgcagcacccactttgtctcctcaggtagtgatgaattagttgctgtcacaaaaggagggaagtagcacccaaattaaattgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctatgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaatctcgtgcc

SEQ ID NO: 467 - DNA, 2415 bp, Homo sapiens
  ref <308>: DATABASE ACCESSION NUMBER: NM_000311
  ref <309>: DATABASE ENTRY DATE: 2001-06-18
cggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtatctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcacc

SEQ ID NO: 468 - DNA, 921 bp, Homo sapiens
  ref <308>: DATABASE ACCESSION NUMBER: NM_000317
  ref <309>: DATABASE ENTRY DATE: 2001-06-18
gtgggaggaggcaccggccgcgcggcgggaggaggtgccggccgagcaccgcagacagcgccgggaagatgagcacggaaggtggtggccgtcgctgccaggcacaagtgtcccgccgcatctccttcagcgcgagccaccgattgtacagtaaatttctaagtgatgaagaaaacttgaaactgtttgggaaatgcaacaatccaaatggccatgggcacaattataaagttgtggtgacagtacatggagagattgaccctgctacgggaatggttatgaatctggctgatctcaaaaaatatatggaggaggcgattatgcagccccttgatcataagaatctggatatggatgtgccatactttgcagatgtggtgagcacgactgaaaatgtagctgtttatatctgggacaacctccagaaagttcttcctgtaggagttctttataaagtaaaagtatacgaaactgacaataatattgtggtttataaaggagaatagctattggggttagcattgcacaaagcccagtttctttctgtgtttgaaaaagattttgatccccttggaatattaagaggtcaacacgtgattgttgtacgtacacattgtgctctggagtgcctatttattgaaatcattgtaagacctgttataaatttaagtctatttaaaactaaacttgtaatatacatcctgaaaatcatttagagagtcttttatttataaattaaaaatcacttcattttcacaaaatgttttggtgtgggattatttgaaagcaaaagaaatctaattttgttttctccattacctcattttagtattaatttttacttggtataatatacatggttaaaatgcttatgtgacttcgagtaggtgaatcttaaagaaataaaattcaagtgaccac

SEQ ID NO: 469 - DNA, 1550 bp, Homo sapiens
  ref <308>: DATABASE ACCESSION NUMBER: NM_000320
  ref <309>: DATABASE ENTRY DATE: 2001-06-18
gtggcctaccatggtttcaacgggtaacggggaataagggttcgattcggagctgcgggagccgggctggcaggagcaggatggcggcggcggcggctgcaggcgaggcgcgccgggtgctggtgtacggcggcaggggcgctctgggttctcgatgcgtgcaggcttttcgggcccgcaactggtgggttgccagcgttgatgtggtggagaatgaagaggccagcgctacgatcattgttaaaatgacagactcgttcactgagcaggctgaccaggtgactgctgaggttggaaagctcttgggtgaagagaaggtggatgcaattctttgcgttgctggaggatgggccgggggcaatgccaaatccaagtctctctttaagaactgtgacctgatgtggaagcagagcatatggacatcgaccatctccagccatctggctaccaagcatctcaaggaaggaggcctcctgaccttggctggcgcaaaggctgccctggatgggactcctggtatgatcgggtacggcatggccaagggtgctgttcaccagctctgccagagcctggctgggaagaacagcggcatgccgcccggggcagccgccatcgctgtgctcccggttaccctggataccccgatgaacaggaaatcaatgcctgaggctgacttcagctcctggacacccttagaattcctagttgaaactttccatgactggatcacagggaaaaaccgaccgagctcaggaagcctaatccaggtggtaaccacagaaggaaggacggaactcaccccagcatatttttaggcctcatctcagtgcctatgaggggcctgccagaaaagtcactaacctgtctcagtgtggccttgtccagccttgtgttttctgtaacccctgtttgtggtacgagataatgagtcctatttttctctcacataatatgcatttgctctcctagggacaagtgtaatacatttatgtgaagtaagacaatgcgagactggtggccgtcaaatagcatccgtcaatctgtgttaactgcataggaggctctcgatagcacctgctatagcggtgtcatgttggatcgctttgtgactgttcatctgtccttgacagtggctgtcatcttgactactttgttgatttgttggtattggggacattttaaaggctgagttatttttgaatgtcatgtttatgtcatagacgtagaaaacgcatccttgaattaaactgccttaactccttttgtggtataagcaaactacatggactctgtccctggtatccttttcctgtgtggttgcccctgtgcctgtggtctggcctaggttaagtgtgcaagataactactcgtgagttattcagaatgttgttcctaataaatgcacttgttgtctgtcttctttaatcaaatcacatcttatatacagcagtcagagatgagtatactagaatcatggattgctggaggtcttttaatctgatgttctcagaagggggtggatttaaatcctgaaataaatatttcaacac

SEQ ID NO: 470 - DNA, 3637 bp, Homo sapiens
  ref <308>: DATABASE ACCESSION NUMBER: NM_000342
  ref <309>: DATABASE ENTRY DATE: 2001-06-18
cagcggctgcaggacttcaccaagggaccctgaggctcgtgagcagggacccgcggtgcgggttatgctgggggctcagatcaccgtagacaactggacactcaggaccacgccatggaggagctgcaggatgattatgaagacatgatggaggagaatctggagcaggaggaatatgaagacccagacatccccgagtcccagatggaggagccggcagctcacgacaccgaggcaacagccacagactaccacaccacatcacacccgggtacccacaaggtctatgtggagctgcaggagctggtgatggacgaaaagaaccaggagctgagatggatggaggcggcgcgctgggtgcaactggaggagaacctgggggagaatggggcctggggccgcccgcacctctctcacctcaccttctggagcctcctagagctgcgtagagtcttcaccaagggtactgttctcctagacctgcaagagacctccctggctggagtggccaaccaactgctagacaggtttatctttgaagaccagatccggcctcaggaccgagaggagctgctccgggccctgctgcttaaacacagccacgctggagagctggaggccctggggggtgtgaagcctgcagtcctgacacgctctggggatccttcacagcctctgctcccccaacactcctcactggagacacagctcttctgtgagcagggagatgggggcacagaagggcactcaccatctggaattctggaaaagattcccccggattcagaggccacgttggtgctagtgggccgcgccgacttcctggagcagccggtgctgggcttcgtgaggctgcaggaggcagcggagctggaggcggtggagctgccggtgcctatacgcttcctctttgtgttgctgggacctgaggccccccacatcgattacacccagcttggccgggctgctgccaccctcatgtcagagagggtgttccgcatagatgcctacatggctcagagccgaggggagctgctgcactccctagagggcttcctggactgcagcctagtgctgcctcccaccgatgccccctccgagcaggcactgctcagtctggtgcctgtgcagagggagctacttcgaaggcgctatcagtccagccctgccaagccagactccagcttctacaagggcctagacttaaatgggggcccagatgaccctctgcagcagacaggccagctcttcgggggcctggtgcgtgatatccggcgccgctacccctattacctgagtgacatcacagatgcattcagcccccaggtcctggctgccgtcatcttcatctactttgctgcactgtcacccgccatcaccttcggcggcctcctgggagaaaagacccggaaccagatgggagtgtcggagctgctgatctccactgcagtgcagggcattctcttcgccctgctgggggctcagcccctgcttgtggtcggcttctcaggacccctgctggtgtttgaggaagccttcttctcgttctgcgagaccaacggtctagagtacatcgtgggccgcgtgtggatcggcttctggctcatcctgctggtggtgttggtggtggccttcgagggtagcttcctggtccgcttcatctcccgctatacccaggagatcttctccttcctcatttccctcatcttcatctatgagactttctccaagctgatcaagatcttccaggaccacccactacagaagacttataactacaacgtgttgatggtgcccaaacctcagggccccctgcccaacacagccctcctctcccttgtgctcatggccggtaccttcttctttgccatgatgctgcgcaagttcaagaacagctcctatttccctggcaagctgcgtcgggtcatcggggacttcggggtccccatctccatcctgatcatggtcctggtggatttcttcattcaggatacctacacccagaaactctcggtgcctgatggcttcaaggtgtccaactcctcagcccggggctgggtcatccacccactgggcttgcgttccgagtttcccatctggatgatgtttgcctccgccctgcctgctctgctggtcttcatcctcatattcctggagtctcagatcaccacgctgattgtcagcaaacctgagcgcaagatggtcaagggctccggcttccacctggacctgctgctggtagtaggcatgggtggggtggccgccctctttgggatgccctggctcagtgccaccaccgtgcgttccgtcacccatgccaacgccctcactgtcatgggcaaagccagcaccccaggggctgcagcccagatccaggaggtcaaagagcagcggatcagtggactcctggtcgctgtgcttgtgggcctgtccatcctcatggagcccatcctgtcccgcatccccctggctgtactgtttggcatcttcctctacatgggggtcacgtcgctcagcggcatccagctctttgaccgcatcttgcttctgttcaagccacccaagtatcacccagatgtgccctacgtcaagcgggtgaagacctggcgcatgcacttattcacgggcatccagatcatctgcctggcagtgctgtgggtggtgaagtccacgccggcctccctggccctgcccttcgtcctcatcctcactgtgccgctgcggcgcgtcctgctgccgctcatcttcaggaacgtggagcttcagtgtctggatgctgatgatgccaaggcaacctttgatgaggaggaaggtcgggatgaatacgacgaagtggccatgcctgtgtgaggggcgggcccaggccctagaccctcccccaccattccacatccccaccttccaaggaaaagcagaagttcatgggcacctcatggactcaggatcctcctggagcagcagctgaggccccagggctgtgggtggggaaggaaggcgtgtccaggagaccttccacaaagggtagcctggcttttctggctggggatggccgatggggcccacattagggggtttgttgcacagtccctcctgttgccacactttcactggggatcccgtgctggaagacttagatctgagccctccctcttcccagcacaggcaggggtagaagcaaaggcaggaggtgggtgagcgggtggggtgcttgctgtgtgaccttgggtaagtcccttgacctttccaggcctatatttcctcttctgtaaaatgggtatattgatgataatacccacattacaggatggttactgaggaccaaagatacatgtaaaatagggctttgtaaactccacagggactgttctatagcagtcatcatttgtctttgaacgtacccaaggtcacatagctgggatttgaactgagccgtgcagctgggatttgaaccaggccttctgatttcaaggtccgagctctgtcctctgtcagtcatgcgtccactttcccttcccctgtgactcctcccttccccactctgctcccagcccctaccttgagaccctcttctctgggcccagagagaggcgtcctgggtgaaggaaggtacaggcaggatgatccagggattgggctg

SEQ ID NO: 471 - DNA, 3936 bp, Homo sapiens
  ref <308>: DATABASE ACCESSION NUMBER: NM_000346
  ref <309>: DATABASE ENTRY DATE: 2001-06-18
ggagagccgaaagcggagctcgaaactgactggaaacttcagtggcgcggagactcgccagtttcaaccccggaaacttttctttgcaggaggagaagagaaggggtgcaagcgcccccacttttgctctttttcctcccctcctcctcctctccaattcgcctccccccacttggagcgggcagctgtgaactggccaccccgcgccttcctaagtgctcgccgcggtagccggccgacgcgccagcttccccgggagccgcttgctccgcatccgggcagccgaggggagaggagcccgcgcctcgagtccccgagccgccgcggcttctcgcctttcccggccaccagccccctgccccgggcccgcgtatgaatctcctggaccccttcatgaagatgaccgacgagcaggagaagggcctgtccggcgcccccagccccaccatgtccgaggactccgcgggctcgccctgcccgtcgggctccggctcggacaccgagaacacgcggccccaggagaacacgttccccaagggcgagcccgatctgaagaaggagagcgaggaggacaagttccccgtgtgcatccgcgaggcggtcagccaggtgctcaaaggctacgactggacgctggtgcccatgccggtgcgcgtcaacggctccagcaagaacaagccgcacgtcaagcggcccatgaacgccttcatggtgtgggcgcaggcggcgcgcaggaagctcgcggaccagtacccgcacttgcacaacgccgagctcagcaagacgctgggcaagctctggagacttctgaacgagagcgagaagcggcccttcgtggaggaggcggagcggctgcgcgtgcagcacaagaaggaccacccggattacaagtaccagccgcggcggaggaagtcggtgaagaacgggcaggcggaggcagaggaggccacggagcagacgcacatctcccccaacgccatcttcaaggcgctgcaggccgactcgccacactcctcctccggcatgagcgaggtgcactcccccggcgagcactcggggcaatcccagggcccaccgaccccacccaccacccccaaaaccgacgtgcagccgggcaaggctgacctgaagcgagaggggcgccccttgccagaggggggcagacagccccctatcgacttccgcgacgtggacatcggcgagctgagcagcgacgtcatctccaacatcgagaccttcgatgtcaacgagtttgaccagtacctgccgcccaacggccacccgggggtgccggccacgcacggccaggtcacctacacgggcagctacggcatcagcagcaccgcggccaccccggcgagcgcgggccacgtgtggatgtccaagcagcaggcgccgccgccacccccgcagcagcccccacaggccccgccggccccgcaggcgcccccgcagccgcaggcggcgcccccacagcagccggcggcacccccgcagcagccacaggcgcacacgctgaccacgctgagcagcgagccgggccagtcccagcgaacgcacatcaagacggagcagctgagccccagccactacagcgagcagcagcagcactcgccccaacagatcgcctacagccccttcaacctcccacactacagcccctcctacccgcccatcacccgctcacagtacgactacaccgaccaccagaactccagctcctactacagccacgcggcaggccagggcaccggcctctactccaccttcacctacatgaaccccgctcagcgccccatgtacacccccatcgccgacacctctggggtcccttccatcccgcagacccacagcccccagcactgggaacaacccgtctacacacagctcactcgaccttgaggaggcctcccacgaagggcgacgatggccgagatgatcctaaaaataaccgaagaaagagaggaccaaccagaattccctttggacatttgtgtttttttgtttttttattttgttttgttttttcttcttcttcttcttccttaaagacatttaagctaaaggcaactcgtacccaaatttccaagacacaaacatgacctatccaagcgcattacccacttgtggccaatcagtggccaggccaaccttggctaaatggagcagcgaaatcaacgagaaactggactttttaaaccctcttcagagcaagcgtggaggatgatggagaatcgtgtgatcagtgtgctaaatctctctgcctgtttggactttgtaattatttttttagcagtaattaaagaaaaaagtcctctgtgaggaatattctctattttaaatatttttagtatgtactgtgtatgattcattaccattttgaggggatttatacatatttttagataaaattaaatgctcttatttttccaacagctaaactactcttagttgaacagtgtgccctagcttttcttgcaaccagagtatttttgtacagatttgctttctcttacaaaaagaaaaaaaaaatcctgttgtattaacatttaaaaacagaattgtgttatgtgatcagttttgggggttaactttgcttaattcctcaggctttgcgatttaaggaggagctgccttaaaaaaaaataaaggccttattttgcaattatgggagtaaacaatagtctagagaagcatttggtaagctttatgatatatatattttttaaagaagagaaaaacaccttgagccttaaaacggtgctgctgggaaacatttgcactcttttagtgcatttcctcctgcctttgcttgttcactgcagtcttaagaaagaggtaaaaggcaagcaaaggagatgaaatctgttctgggaatgtttcagcagccaataagtgcccgagcacactgcccccggttgcctgcctgggccccatgtggaaggcagatgcctgctcgctctgtcacctgtgcctctcagaacaccagcagttaaccttcaagacattccacttgctaaaattatttattttgtaaggagaggttttaattaaaacaaaaaaaaattcttttttttttttttttttccaattttaccttctttaaaataggttgttggagctttcctcaaagggtatggtcatctgttgttaaattatgttcttaactgtaaccagtttttttttatttatctctttaatcttttttattattaaaagcaagtttctttgtattcctcaccctagatttgtataaatgcctttttgtccatcccttttttctttgttgtttttgttgaaaacaaactggaaacttgtttctttttttgtataaatgagagattgcaaatgtagtgtatcactgagtcatttgcagtgttttctgccacagacctttgggctgccttatattgtgtgtgtgtgtgggtgtgtgtgtgttttgacacaaaaacaatgcaagcatgtgtcatccatatttctctacatcttctcttggagtgagggaggctacctggaggggatcagcccactgacagaccttaatcttaattactgctgtggctagagagtttgaggattgctttttaaaaaagacagcaaacttttttttttatttaaaaaaagatatattaacagttttagaagtcagtagaataaaatcttaaagcactcataatatggcatccttcaatttctgtataaaagcagatctttttaaaaaagatacttctgtaacttaagaaacctggcatttaaatcatattttgtctttaggtaaaagctttggtttgtgttcgtgttttgtttgtttcacttgtttccctcccagccccaaaccttttgttctctccgtgaaacttacctttccctttttctttctctttttttttttgtatattattgtttacaataaatatacattgcattaaaaagaaa

SEQ ID NO: 472 - DNA, 4977 bp, Homo sapiens
  ref <308>: DATABASE ACCESSION NUMBER: NM_000352
  ref <309>: DATABASE ENTRY DATE: 2001-06-18
cggggcccggggggcgggggcctgacggccgggccgggcggcggagctgcaagggacagaggcgcggcaggcgcgcggagccagcggagccagctgagcccgagcccagcccgcgcccgcgccgccatgcccctggccttctgcggcagcgagaaccactcggccgcctaccgggtggaccagggggtcctcaacaacggctgctttgtggacgcgctcaacgtggtgccgcacgtcttcctactcttcatcaccttccccatcctcttcattggatggggaagtcagagctccaaggtgcacatccaccacagcacatggcttcatttccccgggcacaacctgcggtggatcctgaccttcatgctgctcttcgtcctggtgtgtgagattgcagagggcatcctgtctgatggggtgaccgaatcccaccatctgcacctgtacatgccagccgggatggcgttcatggctgctgtcacctccgtggtctactatcacaacatcgagacttccaacttccccaagctgctaattgccctgctggtgtattggaccctggccttcatcaccaagaccatcaagtttgtcaagctcttggaccacgccatcggcttctcgcagctacgcttctgcctcacagggctgctggtgatcctctatgggatgctgctcctcgtggaggtcaatgtcatcagggtgaggagatacatcttcttcaagacaccgagggaggtgaagcctcccgaggacctgcaagacctgggggtacgcttcctgcagcccttcgtgaatctgccgtccaaaggcacctactggtggatgaacgccttcatcaagactgcccacaagaagcccatcgacttgcgagccatcgggaagctgcccatcgttatgagggccctcaccaactaccaacggctctgcgaggcctttgacgcccaggtgcggaaggacattcagggcactcaaggtgcccgggccatctggcaggcactcagccatgccttcgggaggcgcctggtcctcagcagcactttccgcatcttggccgacctgctgggcttcgccgggccactgtgcatctttgggatcgtggaccaccttgggaaggagaacgacgtcttccagcccaagacacaatttctcggggtttactttgtctcatcccaagagttccttgccaatgcctacgtcttagctgtgcttctgttccttgccctcctactgcaaaggacatttctgcaagcatcctactatgtggccattgaaactggaattaacttgagaggagcaatacagaccaagatttacaataaaattatgcacctgtccacctccaacctgtccatgggagaaatgactgctggacagatctgtaatctggttgccatcgacaccaatcagctcatgtggtttttcttcttgtgcccaaacctctgggctatgccagtacagatcattgtgggtgtgattctcctctactacatactcggagtcagtgccttaattggagcagctgtcatcattctactggctcctgtccagtacttcgtggccaccaagctgtctcaggcccagcggagcacactggagtattccaatgagcggctgaagcagaccaacgagatgctccgcggcatcaagctgctgaagctgtacgcctgggagaacatcttccgcacgcgggtggagacgacccgcaggaaggagatgaccagcctcagggcctttgccatctatacctccatctccattttcatgaacacggccatccccattgcagctgtcctcataactttcgtgggccatgtcagcttcttcaaagaggccgacttctcgccctccgtggcctttgcctccctctccctcttccatatcttggtcacaccgctgttcctgctgtccagtgtggtccgatctaccgtcaaagctctagtgagcgtgcaaaagctaagcgagttcctgtccagtgcagagatccgtgaggagcagtgtgccccccatgagcccacacctcagggcccagccagcaagtaccaggcggtgcccctcagggttgtgaaccgcaagcgtccagcccgggaggattgtcggggcctcaccggcccactgcagagcctggtccccagtgcagatggcgatgctgacaactgctgtgtccagatcatgggaggctacttcacgtggaccccagatggaatccccacactgtccaacatcaccattcgtatcccccgaggccagctgactatgatcgtggggcaggtgggctgcggcaagtcctcgctccttctagccgcactgggggagatgcagaaggtctcaggggctgtcttctggagcagccttcctgacagcgagataggagaggaccccagcccagagcgggagacagcgaccgacttggatatcaggaagagaggccccgtggcctatgcttcgcagaaaccatggctgctaaatgccactgtggaggagaacatcatctttgagagtcccttcaacaaacaacggtacaagatggtcattgaagcctgctctctgcagccagacatcgacatcctgccccatggagaccagacccagattggggaacggggcatcaacctgtctggtggtcaacgccagcgaatcagtgtggcccgagccctctaccagcacgccaacgttgtcttcttggatgaccccttctcagctctggatatccatctgagtgaccacttaatgcaggccggcatccttgagctgctccgggacgacaagaggacagtggtcttagtgacccacaagctacagtacctgccccatgcagactggatcattgccatgaaggatgggaccatccagagggagggtaccctcaaggacttccagaggtctgaatgccagctctttgagcactggaagaccctcatgaaccgacaggaccaagagctggagaaggagactgtcacagagagaaaagccacagagccaccccagggcctatctcgtgccatgtcctcgagggatggccttctgcaggatgaggaagaggaggaagaggaggcagctgagagcgaggaggatgacaacctgtcgtccatgctgcaccagcgtgctgagatcccatggcgagcctgcgccaagtacctgtcctccgccggcatcctgctcctgtcgttgctggtcttctcacagctgctcaagcacatggtcctggtggccatcgactactggctggccaagtggaccgacagcgccctgaccctgacccctgcagccaggaactgctccctcagccaggagtgcaccctcgaccagactgtctatgccatggtgttcacggtgctctgcagcctgggcattgtgctgtgcctcgtcacgtctgtcactgtggagtggacagggctgaaggtggccaagagactgcaccgcagcctgctaaaccggatcatcctagcccccatgaggttttttgagaccacgccccttgggagcatcctgaacagattttcatctgactgtaacaccatcgaccagcacatcccatccacgctggagtgcctgagccgctccaccctgctctgtgtctcagccctggccgtcatctcctatgtcacacctgtgttcctcgtggccctcttgcccctcgcagtcgtgtgctacttcatccagaagtacttccgggtggcgtccagggacctgcagcagctggatgacaccacccagcttccacttctctcacactttgccgaaaccgtagaaggactcaccaccatccgggccttcaggtatgaggcccggttccagcagaagcttctcgaatacacagactccaacaacattgcttccctcttcctcacagctgccaacagatggctggaagtccgaatggagtacatcggtgcatgtgtggtgctcatcgcagcggtgacctccatctccaactccctgcacagggagctctctgctggcctggtgggcctgggccttacctacgccctaatggtctccaactacctcaactggatggtgaggaacctggcagacatggagctccagctgggggctgtgaagcgcatccatgggctcctgaaaaccgaggcagagagctacgaggggctcctggcaccatcgctgatcccaaagaactggccagaccaagggaagatccagatccagaacctgagcgtgcgctacgacagctccctgaagccggtgctgaagcacgtcaatgccctcatctcccctggacagaagatcgggatctgcggccgcaccggcagtgggaagtcctccttctctcttgccttcttccgcatggtggacacgttcgaagggcacatcatcattgatggcattgacatccgcaaactgccgctgcacaccctgccgtcacgcctctccatcatcctgcaggaccccgtcctcttcagcggcaccatccgatttaacctggaccctgagaggaagtgctcagatagcacactgtgggaggccctggaaatcgcccagctgaagctggtggtgaaggcactgccaggaggcctcgatgccatcatcacagaaggcggggagaatttcagccagggacagaggcagctgttctgcctggcccgggccttcgtgaggaagaccagcatcttcatcatggacgaggccacggcttccattgacatggccacggaaaacatcctccaaaaggtggtgatgacagccttcgcagaccgcactgtggtcaccatcgcgcatcgagtgcacaccatcctgagtgcagacctggtgatcgtcctgaagcggggtgccatccttgagttcgataagccagagaagctgctcagccggaaggacagcgtcttcgcctccttcgtccgtgcagacaagtgacctgccagagcccaagtgccatcccacattcggaccctgcccatacccctgcctgggttttctaactgtaaatcacttgtaaataaatagatttgattatttcct

SEQ ID NO: 473 - DNA, 1866 bp, Homo sapiens
  ref <308>: DATABASE ACCESSION NUMBER: NM_000355
  ref <309>: DATABASE ENTRY DATE: 2001-06-18
ccgattcttgctcactgctcacccacctgctgctgccatgaggcaccttggggccttcctcttccttctgggggtcctgggggccctcactgagatgtgtgaaataccagagatggacagccatctggtagagaagttgggccagcacctcttaccttggatggaccggctttccctggagcacttgaaccccagcatctatgtgggcctacgcctctccagtctgcaggctgggaccaaggaagacctctacctgcacagcctcaagcttggttaccagcagtgcctcctagggtctgccttcagcgaggatgacggtgactgccagggcaagccttccatgggccagctggccctctacctgctcgctctcagagccaactgtgagtttgtcaggggccacaagggggacaggctggtctcacagctcaaatggttcctggaggatgagaagagagccattgggcatgatcacaagggccacccccacactagctactaccagtatggcctgggcattctggccctgtgtctccaccagaagcgggtccatgacagcgtggtggacaaacttctgtatgctgtggaacctttccaccagggccaccattctgtggacacagcagccatggcaggcttggcattcacctgtctgaagcgctcaaacttcaaccctggtcggagacaacggatcaccatggccatcagaacagtgcgagaggagatcttgaaggcccagacccccgagggccactttgggaatgtctacagcaccccattggcattacagttcctcatgacttcccccatgcctggggcagaactgggaacagcatgtctcaaggcgagggttgctttgctggccagtctgcaggatggagccttccagaatgctctcatgatttcccagctgctgcccgttctgaaccacaagacctacattgatctgatcttcccagactgtctggcaccacgagtcatgttggaaccagctgctgagaccattcctcagacccaagagatcatcagtgtcacgctgcaggtgcttagtctcttgccgccgtacagacagtccatctctgttctggccgggtccaccgtggaagatgtcctgaagaaggcccatgagttaggaggattcacatatgaaacacaggcctcctcgtcaggcccctacttaacctccgtgatggggaaagcggccggagaaagggagttctggcagcttctccgagaccccaacaccccactgttgcaaggtattgctgactacagacccaaggatggagaaaccattgagctgaggctggttagctggtagcccctgagctccctcatcccagcagcctcgcacactccctaggcttctaccctccctcctgatgtccctggaacaggaactcgcctgaccctgctgccacctcctgtgcactttgagcaatgccccctgggatcaccccagccacaagcccttcgagggccctataccatggcccaccttggagcagagagccaagcatcttccctgggaagtctttctggccaagtctggccagcctggccctgcaggtctcccatgaaggccaccccatggtctgatgggcatgaagcatctcagactccttggcaaaaaacggagtccgcaggccgcaggtgttgtgaagaccactcgttctgtggttggggtcctgcaagaaggcctcctcagcccgggggctatggccctgaccccagctctccactctgctgttagagtggcagctctgagctggttgtggcacagtagctggggagacctcagcagggctgctcagtgcctgcctctgacaaaattaaagcattgatggcctgtggacctgcaaaaaa

SEQ ID NO: 474 - DNA, 2691 bp, Homo sapiens
  ref <308>: DATABASE ACCESSION NUMBER: NM_000358
  ref <309>: DATABASE ENTRY DATE: 2001-06-18
gcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctcctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtagagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtctttgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacata

SEQ ID NO: 475 - DNA, 2709 bp, Homo sapiens
  ref <308>: DATABASE ACCESSION NUMBER: NM_000359
  ref <309>: DATABASE ENTRY DATE: 2001-06-18
gggtcctgtcccatccatcctgacctgttccatctcagccccaggactcagtactgcggttgccaacactgctgccaggcatgatggatgggccacgttccgatgtgggccgttggggtggcaaccccttgcagccccctaccacgccatctccagagccagagccagagccagacggacgctctcgcagaggaggaggccgttccttctgggctcgctgctgtggctgctgttcatgccgaaatgcggcagatgacgactggggacctgaaccctctgactccaggggtcgagggtccagctctggcactcgaagacctggctcccggggctcagactcccgccggcctgtatcccggggcagcggtgtcaatgcagctggagatggcaccatccgagagggcatgctagtagtgaacggtgtggacttgctgagctcgcgctcggaccagaaccgccgagagcaccacacagacgagtatgagtacgacgagctgatagtgcgccgcgggcagcctttccatatgctcctcctcctgtcccggacctatgaatcctctgatcgcatcacccttgagttactcatcggaaacaaccccgaggtgggcaagggcacgcacgtgatcatcccagtgggcaaggggggcagtggaggctggaaagcccaggtggtcaaggccagtgggcagaatctgaacctgcgggtccacacttcccccaacgccatcatcggcaagtttcagttcacagtccgcacacaatcagacgctggggagttccagttgccctttgacccccgcaatgagatctacatcctcttcaacccctggtgcccagaggacattgtgtacgtggaccatgaggattggcggcaggagtatgttcttaatgagtctgggagaatttactacgggaccgaagcacagattggtgagcggacctggaactacggccagtttgaccacggggtgctggatgcctgcttatacatcctggaccggcgggggatgccatatggaggccgtggagacccagtcaatgtctcccgggtcatctctgccatggtgaactccctggatgacaatggagtcctgattgggaactggtctggtgattactcccgaggcaccaacccatcagcgtgggtgggcagcgtggagatcctgcttagctacctacgcacgggatattccgtcccctatggccagtgctgggtctttgctggagtgaccaccacagtgctgcgctgcctgggtctggccacccgtactgtcaccaacttcaactccgcccacgacacagacacatcccttaccatggacatctacttcgacgagaacatgaagcccctggagcacctgaaccatgattctgtctggaacttccatgtgtggaacgactgctggatgaagaggccggatctgccctcgggctttgatgggtggcaggtggtggatgccacaccccaagagactagcagtggcatcttctgctgcggcccctgctctgtggagtccatcaagaatggcctggtctacatgaagtacgacacgcctttcatttttgctgaggtgaatagtgacaaggtgtactggcagcggcaggatgatggcagcttcaagattgtttatgtggaggagaaggccatcggcacactcattgtcacaaaggccatcagctccaacatgcgggaggacatcacctacctctataagcacccagaaggctcagacgcagagcggaaggcagtagagacagcagcagcccacggcagcaaacccaatgtgtatgccaaccggggctcagcggaggatgtggccatgcaggtggaggcacaggacgcggtgatggggcaggatctgatggtctctgtgatgctgatcaatcacagcagcagccgccgcacagtgaaactgcacctctacctctcagtcactttctatactggtgtcagtggtaccatcttcaaggagaccaagaaggaagtggagctggcaccaggggcctcggaccgtgtgaccatgccagtggcctacaaggaataccggccccatcttgtggaccagggggccatgctgctcaatgtctcaggccacgtcaaggagagcgggcaggtgctggccaagcagcacaccttccgtctgcgcaccccagacctctccctcacgttactgggagcagcagtggttggccaggagtgtgaagtacagattgtcttcaagaacccccttcccgtcaccctcaccaatgtcgtcttccggctcgaaggctctgggttacagaggcccaagatcctcaacgttggggacattggaggcaatgaaacagtgacactgcgccagtcgtttgtgcctgtgcgaccaggcccccgccagctcattgccagcttggacagcccacagctctcccaggtgcacggtgtcatccaggtggatgtggccccagcccctggggatgggggcttcttctcagacgctggaggtgacagtcacttaggagagaccatccctatggcatctcgaggtggagcttagccctgtgccaggagcaatgggactggagtcagatgagcaaggacattgccccaagataggggcacactacagagcagctccccaggagctcaggtggggagtccagggctcccggagagggagtcagtcttcacttgcactgggggaacagatgctaataaactgttttttaatg

SEQ ID NO: 476 - DNA, 5483 bp, Homo sapiens
  Modified_base 1 ... 5483: n = a,c,g, or t
  ref <308>: DATABASE ACCESSION NUMBER: NM_000362
  ref <309>: DATABASE ENTRY DATE: 2001-06-18
tctgtcgacttgccccagagctgatccttgtctttgtccacttctcagcgaggatggcacttcagggagcccttcccttactatcgcagagagagcaggccctccccagtcatgtccaacccagaactctgttttgttttcttcatagccctagcatcacagaaaatcaccctgtgcattcatggatgtccacgggggcaagggctttgtgttgcttaacccagcatcctgaaccgtgtttgttgaatgaatacagaaccccgtttgctctgggagagcacagaaaacagtcttctatcatatatcatagccagctcgaaacagcagatggcttccatatccagagagcaagaaccagagagagagagaaagagagagagtttgggtctttctcctctntncctgctctctccagagaaactggaggggtagcagttagcattcccccgctggttccaccaagcacagtcaaggtctctaggacatggccacccctcacctgtggaagcggtcctgctggggtgggtgggtgttagttggttctggtttgggtcagagacacccagtggcccaggtgggcgtggggccagggcgcagacgagaaggggcacgagggctccgctccgaggacccagcggcaagcaccggtcccgggngggccccagcccacccactcgcgtgcccacggcggcattattccctataaggatctgaacgatccgggggcggccccgccccgttaccccttgcccccggccccgccccctttttggagggccgatgaggtaatgcggctctgccattggtctgagggggcgggccccaacagcccgaggcggggtccccgggggcccagcgctatatcactcggccgcccaggcagacggcgcagagcgggcagcaggcaggcggcgggcgctcagacggcttctcctcctcctcttgctcctccagctcctgctccttcgccgggaggccgcccgccgagtcctggccagcgccgaggcagcctgcctgcgccccatcccgtcccgccgggcactcggagggcagcgcgccggaggccaaggttgccccgcacggcccggcgggcgagcgagctcgggctgcagcagccccgccggcgcgcacggcaactttggagaggcgagcagcagccccggcagcggcggcagcagcggcaatgaccccttggctcgggctcatcgtgctcctgggcagctggagcctgggggactggggcgccgaggcgtgcacatgctcgcccagccacccccaggacgccttctgcaactccgacatcgtgatccgggccaaggtggtggggaagaagctggtaaaggaggggcccttcggcacgctggtctacaccatcaagcagatgaagatgtaccgaggcttcaccaagatgccccatgtgcagtacatccacacggaagcttccgagagtctctgtggccttaagctggaggtcaacaagtaccagtacctgctgacaggtcgcgtctatgatggcaagatgtacacggggctgtgcaacttcgtggagaggtgggaccagctcaccctctcccagcgcaaggggctgaactatcggtatcacctgggttgtaactgcaagatcaagtcctgctactacctgccttgctttgtgacttccaagaacgagtgtctctggaccgacatgctctccaatttcggttaccctggctaccagtccaaacactacgcctgcatccggcagaagggcggctactgcagctggtaccgaggatgggcccccccggataaaagcatcatcaatgccacagacccctgagcgccagaccctgccccacctcacttccctcccttcccgctgagcttcccttggacactaactcttcccagatgatgacaatgaaattagtgcctgttttcttgcaaatttagcacttggaacatttaaagaaaggtctatgctgtcatatggggtttattgggaactatcctcctggccccaccctgccccttctttttggttttgacatcattcatttccacctgggaatttctggtgccatgccagaaagaatgaggaacctgtattcctcttcttcgtgataatataatctctatttttttaggaaaacaaaaatgaaaaactactccatttgaggattgtaattcccacccctcttgcttcttccccacctcaccatctcccagaccctcttccctttgcccttctcctccaatacataaaggacacagacaaggaacttgctgaaaggccaaccatttcaggatcagtcaaaggcagcaagcagatagactcaaggtgtgtgaaagatgttatacaccaggagctgccactgcatgtcccaaccagactgtgtctgtctgtgtctgcatgtaagagtgagggagggaaggaaggaactacaagagagtcggagatgatgcagcacacacacaattccccagcccagtgatgcttgtgttgaccagatgttcctgagtctggagcaagcacccaggccagaataacagagctttcttagttggtgaagacttaaacatctgcctgaggtcaggaggcaatttgcctgccttgtacaaaagctcaggtgaaagactgagatgaatgtctttcctctccctgcctcccaccagacttcctcctggaaaacgctttggtagatttggccaggagctttcttttatgtaaattggataaatacacacaccatacactatccacagatatagccaagtagatttgggtagaggatactatttccagaatagtgtttagctcacctagggggatatgtttgtatacacatttgcatatacccacatggggacataagctaatttttttacaggacacagaattctgttcaatgctgttaaatatgccaatagtttaatctcttctattttgttgtcgttgcttgtttgaagaaaatcatgacattccaagttgacattttttttttcattttaattaaaatttgaaattctgaacaccgtcagcaccctctcttccctatcatgggtcatctgacccctgtccgtctccttgtccctgcttcatgtttgggggcctttctttaactgccttcctggcttagctcagatggcagatgagagtgtagtcaagggcctgggcacaggagggagagctgcagagtgtcctgcctgccttggctggagggacacctctcctgggtgtggagacagcttggttccctttccctagctccctggtgggtgaatgccacctcctgagatcctcacctcttggaattaaaattgttggtcactggggaaagcctgagtttgcaaccagttgtagggtttctgttgtgttttttttttttttgaaataaaactataatataaattctcctattaaataaaattattttaagttttagtgtcaaaagtgagatgctgagagtaggtgataatgtatattttacagagtgggggttggcaggatggtgacattgaacatgattgctctctgtctcttttttcagcttatgggtatttatcttctattagtatttgtatcttcagttcattccactttaggaaacagagctgccaattgaaacagaagaagaaaaaaaaaaaagcagcagacaacacactgtagagtcttgcacacacacaagtgcccaggcaaggtgcttggcagaaccgcagagtgggaagagagtaccggcatcgggtttccttgggatcaatttcattaccgtgtacctttcccattgtggtcacgccatttggcagggggagaatgggaggcttggccttctttgtgaggcagtgtgagcagaagaagctgatgccagcatgtcactggttttgaagggatgagcccagacttgatgttttgggattgtccttattttaacctcaaggtctcgcatggtggggcccctgaccaacctacacaagttccctcccacaagtggacatcagtgtcttctctgtgaggcatctggccattcgcactccctggtgtggtcagcctctctcacacaaggaggaacttgggtgaaggctgagtgtgaggcacctgaagtttccctgcggagtcgataaattagcagaaccacatccccatctgttaggccttggtgaggaggccctgggcaaagaagggtctttcgcaaagcgatgtcagagggcggttttgagctttctataagctatagctttgtttatttcacccgttcacttactgtataatttaaaatcatttatgtagctgagacacttctgtatttcaatcatatcatgaacattttattttgctaaatcttgtgtcatgtgtaggctgtaatatgtgtacattgtgtttaagagaaaaatgaaacccacatgccgccattttcctgaatcaaattctgcagtggaatggagaggaaaatacttctaggcaagcagctagactggtgaattgggggaaatagaaggaactagtaactgagactcctccagcctcttccctattggaatcccaatggctcctggagtaggaaaaaagtttaaactacattcatgttcttgttctgtgtcactcggccctgggtagtctaccatttacttcaccccaagtcctgctgcccatccagttgggaagcccatgattttcctaagaatccagggccataggagatacaattccaagttctcgcttcctcctttgggcatctcttctgcctcccaatcaaggaagctccacgctcaggctctcagctctcgggccagtgctctgctctgtccagggtaggtaatactgggagactcctgtcttttaccctcccctcgttccagacctgcctcatggtggcaacatggttcttgaacaattaaagaaacaaatgactttttggaatagccctgtctagggcaaactgtggcccccaggagacactacccttccatgccccagacctctgtcttgcatgtgacaattgacaatctggactaccccaagatggcacccaagtgtttggcttctggctacctaaggttaacatgtcactagagtatttttatgagagacaaacattataaaaatctgatggcaaaagcaaaacaaaatggaaagtaggggaggtggatgtgacaacaacttccaaattggctctttggaggcgagaggaaggggagaacttggagaatagtttttgctttgggggtagaggcttcttagattctcccagcatccgcctttccctttagccagtctgctgtcctgaaacccagaagtgatggagagaaaccaacaagagatctcgaaccctgtctagaaggaatgtatttgttgctaaatttcgtagcactgtttacagttttcctccatgttatttatgaattttatattccgtgaatgtatattgtcttgtaatgttgcataatgttcactttttatagtgtgtcctttattctaaacagtaaagtggttttatttctatcac

SEQ ID NO: 477 - DNA, 1229 bp, Homo sapiens
  ref <308>: DATABASE ACCESSION NUMBER: NM_000365
  ref <309>: DATABASE ENTRY DATE: 2001-06-18
gcgcgacactgaccttcagcgcctcggctcggccatggcgccctccaggaagttcttcgttgggggaaactggaagatgaacgggcggaagcagagtctgggggagctcatcggcactctgaacgcggccaaggtgccggccgacaccgaggtggtttgtgctccccctactgcctatatcgacttcgcccggcagaagctagatcccaagattgctgtggctgcgcagaactgctacaaagtgactaatggggcttttactggggagatcagccctggcatgatcaaagactgcggagccacgtgggtggtcctgggacactcagagagaaggcatgtctttggggagtcagatgagctgattgggcagaaagtggcccatgctctggcagagggactcggagtaatcgcctgcattggggagaagctagatgaaagggaagctggcatcactgagaaggttgttttcgagcagacaaaggtcatcgcagataacgtgaaggactggagcaaggtcgtcctcgcctatgagcctgtgtgggccattggtactggcaagactgcaacaccccaacaggcccaggaagtacacgagaagctccgaggatggctgaagtccaacgtctctgatgcggtggctcagagcacccgtatcatttatggaggctctgtgactggggcaacctgcaaggagctggccagccagcctgatgtggatggcttccttgtgggtggtgcttccctcaagcccgaattcgtggacatcatcaatgccaaacaatgagccccatccatcttccctacccttcctgccaagccagggactaagcagcccagaagcccagtaactgccctttccctgcatatgcttctgatggtgtcatctgctccttcctgtggcctcatccaaactgtatcttcctttactgtttatatcttcaccctgtaatggttgggaccaggccaatcccttctccacttactataatggttggaactaaacgtcaccaaggtggcttctccttggctgagagatggaaggcgtggtgggatttgctcctgggttccctaggccctagtgagggcagaagagaaaccatcctctcccttcttacaccgtgaggccaagatcccctcagaaggcaggagtgctgccctctcccatggtgcccgtgcctctgtgctgtgtatgtgaaccacccatgtgagggaataaacctagcactagg

SEQ ID NO: 478 - DNA, 3452 bp, Homo sapiens
  ref <308>: DATABASE ACCESSION NUMBER: NM_000381
  ref <309>: DATABASE ENTRY DATE: 2001-06-18
atttcgccgggttgcttttgtcttgcgggctcctgtcgggttcggtgtttccgctctgaagactgcgacgcgggctccgatgcagctcgctccctgccggatgggtcatgggattctaaacatgaggcagatagctgatcagcttccttgggttttgctgatgacacaagagagctttgcctgaagatggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttggactgcacagagcagctgccgtgagcgtctggccacatggagctgctttctggggaacagtaaggttcaggccactatttaggggactgagaaagcacaggcttcatgagtgtaatgaaatctcaccagaagtgtcccgaaatcggctcagatagggctcaaaacaagagattcctctccttttactgtgtcttgtattaagtacgggctttaataatttctttaatttttttgtatttagaggaaaatctatagattatttataagagaaacataatcaggattacaacttttaggaattacttggttttgcacattaagaggcccataagtttatcagctatttacaaccttcatttcatcacaatctgtgggcttacaaaaaaacaaaaacttttgtagttttgtatgttactcatcttcttacctgatatcccatgatgatcccatggtaggtcttctcacctcgatggtgcataacaggatgtgtttgaacctagtaggggaggaaacaggctttcttactctggtttaatttgaagtgttttaattgtgatgtcaaaaagttgtatcagatcaactaaaatggagagcaagacagagaatgaaaagagttgattttggacctcggaccttgccgtggctaaatctttaccttctcatagctgatgggataatgttggaaagaaaggttgtgaatcctttggccacattttgccctgcttctctcagggttaagggttctggaagaacattaagaatgagatgcaattgaaaatagtcattttgaatcctattgattattcaaaaattcaggctgattgtcttttatcagaggtaggattctgttttatagtatagaatctactttatcccttccttttaatagttcctttagacctgtgaaatttcttcactacatttaatagttctcctatttcccgctcccccatatcaattttccttttgtctccggggctgagtaaataaacatgttctgtcacaaatagcagcaccactttggattgattttgctctccaggacatcagcacatggccctgatcagcactaccacatccaaacataagtcactgaaaaacacttaatatttatgagttggtaatgacaagggacattgtataaagtactatttgctagattcatgcctcaaaagttattataaacagacctttattaaacacatcttgaaagatgtagaagtccctctatagtctagtatagtttacaatagagttgtaagaccaaaaaaaaaaaaaaaaaaaaa

SEQ ID NO: 479 - DNA, 1669 bp, Homo sapiens
  ref <308>: DATABASE ACCESSION NUMBER: NM_000396
  ref <309>: DATABASE ENTRY DATE: 2001-06-18
gaaacaagcactggattccatatcccactgccaaaaccgcatggttcagattatcgctattgcagctttcatcataatacacacctttgctgccgaaacgaagccagacaacagatttccatcagcaggatgtgggggctcaaggttctgctgctacctgtggtgagctttgctctgtaccctgaggagatactggacacccactgggagctatggaagaagacccacaggaagcaatataacaacaaggtggatgaaatctctcggcgtttaatttgggaaaaaaacctgaagtatatttccatccataaccttgaggcttctcttggtgtccatacatatgaactggctatgaaccacctgggggacatgaccagtgaagaggtggttcagaagatgactggactcaaagtacccctgtctcattcccgcagtaatgacaccctttatatcccagaatgggaaggtagagccccagactctgtcgactatcgaaagaaaggatatgttactcctgtcaaaaatcagggtcagtgtggttcctgttgggcttttagctctgtgggtgccctggagggccaactcaagaagaaaactggcaaactcttaaatctgagtccccagaacctagtggattgtgtgtctgagaatgatggctgtggagggggctacatgaccaatgccttccaatatgtgcagaagaaccggggtattgactctgaagatgcctacccatatgtgggacaggaagagagttgtatgtacaacccaacaggcaaggcagctaaatgcagagggtacagagagatccccgaggggaatgagaaagccctgaagagggcagtggcccgagtgggacctgtctctgtggccattgatgcaagcctgacctccttccagttttacagcaaaggtgtgtattatgatgaaagctgcaatagcgataatctgaaccatgcggttttggcagtgggatatggaatccagaagggaaacaagcactggataattaaaaacagctggggagaaaactggggaaacaaaggatatatcctcatggctcgaaataagaacaacgcctgtggcattgccaacctggccagcttccccaagatgtgactccagccagccaaatccatcctgctcttccatttcttccacgatggtgcagtgtaacgatgcactttggaagggagttggtgtgctatttttgaagcagatgtggtgatactgagattgtctgttcagtttccccatttgtttgtgcttcaaatgatccttcctactttgcttctctccacccatgacctttttcactgtggccatcaggactttccctgacagctgtgtactcttaggctaagagatgtgactacagcctgcccctgactgtgttgtcccagggctgatgctgtacaggtacaggctggagattttcacataggttagattctcattcacgggactagttagctttaagcaccctagaggactagggtaatctgacttctcacttcctaagttcccttctatatcctcaaggtagaaatgtctatgttttctactccaattcataaatctattcataagtctttggtacaagtttacatgataaaaagaaatgtgatttgtcttcccttctttgcacttttgaaataaagtatttatc

SEQ ID NO: 480 - DNA, 4266 bp, Homo sapiens
  ref <308>: DATABASE ACCESSION NUMBER: NM_000397
  ref <309>: DATABASE ENTRY DATE: 2001-06-18
cttcctctgccaccatggggaactgggctgtgaatgaggggctctccatttttgtcattctggtttggctggggttgaacgtcttcctctttgtctggtattaccgggtttatgatattccacctaagttcttttacacaagaaaacttcttgggtcagcactggcactggccagggcccctgcagcctgcctgaatttcaactgcatgctgattctcttgccagtctgtcgaaatctgctgtccttcctcaggggttccagtgcgtgctgctcaacaagagttcgaagacaactggacaggaatctcacctttcataaaatggtggcatggatgattgcacttcactctgcgattcacaccattgcacatctatttaatgtggaatggtgtgtgaatgcccgagtcaataattctgatccttattcagtagcactctctgaacttggagacaggcaaaatgaaagttatctcaattttgctcgaaagagaataaagaaccctgaaggaggcctgtacctggctgtgaccctgttggcaggcatcactggagttgtcatcacgctgtgcctcatattaattatcacttcctccaccaaaaccatccggaggtcttactttgaagtcttttggtacacacatcatctctttgtgatcttcttcattggccttgccatccatggagctgaacgaattgtacgtgggcagaccgcagagagtttggctgtgcataatataacagtttgtgaacaaaaaatctcagaatggggaaaaataaaggaatgcccaatccctcagtttgctggaaaccctcctatgacttggaaatggatagtgggtcccatgtttctgtatctctgtgagaggttggtgcggttttggcgatctcaacagaaggtggtcatcaccaaggtggtcactcaccctttcaaaaccatcgagctacagatgaagaagaaggggttcaaaatggaagtgggacaatacatttttgtcaagtgcccaaaggtgtccaagctggagtggcacccttttacactgacatccgcccctgaggaagacttctttagtatccatatccgcatcgttggggactggacagaggggctgttcaatgcttgtggctgtgataagcaggagtttcaagatgcgtggaaactacctaagatagcggttgatgggccctttggcactgccagtgaagatgtgttcagctatgaggtggtgatgttagtgggagcagggattggggtcacacccttcgcatccattctcaagtcagtctggtacaaatattgcaataacgccaccaatctgaagctcaaaaagatctacttctactggctgtgccgggacacacatgcctttgagtggtttgcagatctgctgcaactgctggagagccagatgcaggaaaggaacaatgccggcttcctcagctacaacatctacctcactggctgggatgagtctcaggccaatcactttgctgtgcaccatgatgaggagaaagatgtgatcacaggcctgaaacaaaagactttgtatggacggcccaactgggataatgaattcaagacaattgcaagtcaacaccctaataccagaataggagttttcctctgtggacctgaagccttggctgaaaccctgagtaaacaaagcatctccaactctgagtctggccctcggggagtgcatttcattttcaacaaggaaaacttctaacttgtctcttccatgaggaaataaatgtgggttgtgctgccaaatgctcaaataatgctaattgataatataaataccccctgcttaaaaatggacaaaaagaaactataatgtaatggttttcccttaaaggaatgtcaaagattgtttgatagtgataagttacatttatgtggagctctatggttttgagagcacttttacaaacattatttcatttttttcctctcagtaatgtcagtggaagttagggaaaagattcttggactcaattttagaatcaaaagggaaaggatcaaaaggttcagtaacttccctaagattatgaaactgtgaccagatctagcccatcttactccaggtttgatactctttccacaatactgagctgcctcagaatcctcaaaatcagtttttatattccccaaaagaagaaggaaaccaaggagtagctatatatttctactttgtgtcatttttgccatcattattatcatactgaaggaaattttccagatcattaggacataatacatgttgagagtgtctcaacacttattagtgacagtattgacatctgagcatactccagtttactaatacagcagggtaactgggccagatgttctttctacagaagaatattggattgattggagttaatgtaatactcatcatttaccactgtgcttggcagagagcggatactcaagtaagttttgttaaatgaatgaatgaatttagaaccacacaatgccaagatagaattaatttaaagccttaaacaaaatttatctaaagaaataacttctattactgtcatagaccaaaggaatctgattctccctagggtcaagaacaggctaaggatactaaccaataggattgcctgaagggttctgcacattcttatttgaagcatgaaaaaagagggttggaggtggagaattaacctcctgccatgactctggctcatctagtcctgctccttgtgctataaaataaatgcagactaatttcctgcccaaagtggtcttctccagctagcccttatgaatattgaacttaggaattgtgacaaatatgtatctgatatggtcatttgttttaaataacacccaccccttattttccgtaaatacacacacaaaatggatcgcatctgtgtgactaatggtttatttgtattatatcatcatcatcatcctaaaattaacaacccagaaacaaaaatctctatacagagatcaaattcacactcaatagtatgttctgaatatatgttcaagagagagtctctaaatcactgttagtgtggccaagagcagggttttctttttgttcttagaactgctcccatttctgggaactaaaaccagttttatttgccccaccccttggagccacaaatgtttagaactcttcaacttcggtaatgaggaagaaggagaaagagctgggggaagggcagaagactggtttaggaggaaaaggaaataaggagaaaagagaatgggagagtgagagaaaataaaaaaggcaaaagggagagagaggggaagggggtctcatattggtcattccctgccccagatttcttaaagtttgatatgtatagaatataattgaaggaggtatacacatactgatgttgttttgattatctatggtattgaatcttttaaaatctggtcacaaattttgatgctgagggggattattcaagggactaggatgaactaaataagaactcagttgttctttgtcatactactattcctttcgtctcccagaatcctcagggcactgagggtaggtctgacaaataaggcctgctgtgcgaatatagcctttctgaaatgtaccaggatggtttctgcttagagacacttaggtccagcctgttcacactgcacctcaggtatcaattcatctattcaacagatatttattgtgttattactatgagtcaggctctgtttattgtttcaattctttacaccaaagtatgaactggagagggtacctcagttataaggagtctgagaatattggccctttctaacctatgtgcataattaaaaccagcttcatttgttgctccgagagtgtttctccaaggttttctatcttcaaaaccaactaagttatgaaagtagagagatctgccctgtgttatccagttatgagataaaaaatgaatataagagtgcttgtcattataaaagtttcctttttatctctcaagccaccagctgccagccaccacgagccagctgccagcctagctttttttttttttttttttttagcacttagtatttagcatttattaacaggtactctaagaatgatgaagcattgtttttaatcttaagactatgaaggtttttcttagttcttctgcttttgcaattgtgtttgtgaaatttgaatacttgcaggctttgtatgtgaataattctagcgggggacctgggagataattctacggggaattcttaaaactgtgctcaactattaaaatgaatgagctttc

SEQ ID NO: 481 - DNA, 2984 bp, Homo sapiens
  ref <308>: DATABASE ACCESSION NUMBER: NM_000399
  ref <309>: DATABASE ENTRY DATE: 2001-06-18
taactgagcgaggagcaattgattaatagctcggcgaggggactcactgactgttataataacactacaccagcaactcctggcttcccagcagccggaacacagacaggagagagtcagtggcaaatagacatttttcttatttcttaaaaaacagcaacttgtttgctacttttatttctgttgatttttttttcttggtgtgtgtggtggttgtttttaagtgtggagggcaaaaggagataccatcccaggctcagtccaacccctctccaaaacggcttttctgacactccaggtagcgagggagttgggtctccaggttgtgcgaggagcaaatgatgaccgccaaggccgtagacaaaatcccagtaactctcagtggttttgtgcaccagctgtctgacaacatctacccggtggaggacctcgccgccacgtcggtgaccatctttcccaatgccgaactgggaggcccctttgaccagatgaacggagtggccggagatggcatgatcaacattgacatgactggagagaagaggtcgttggatctcccatatcccagcagctttgctcccgtctctgcacctagaaaccagaccttcacttacatgggcaagttctccattgaccctcagtaccctggtgccagctgctacccagaaggcataatcaatattgtgagtgcaggcatcttgcaaggggtcacttccccagcttcaaccacagcctcatccagcgtcacctctgcctcccccaacccactggccacaggacccctgggtgtgtgcaccatgtcccagacccagcctgacctggaccacctgtactctccgccaccgcctcctcctccttattctggctgtgcaggagacctctaccaggacccttctgcgttcctgtcagcagccaccacctccacctcttcctctctggcctacccaccacctccttcctatccatcccccaagccagccacggacccaggtctcttcccaatgatcccagactatcctggattctttccatctcagtgccagagagacctacatggtacagctggcccagaccgtaagccctttccctgcccactggacaccctgcgggtgccccctccactcactccactctctacaatccgtaactttaccctggggggccccagtgctggggtgaccggaccaggggccagtggaggcagcgagggaccccggctgcctggtagcagctcagcagcagcagcagccgccgccgccgccgcctataacccacaccacctgccactgcggcccattctgaggcctcgcaagtaccccaacagacccagcaagacgccggtgcacgagaggccctacccgtgcccagcagaaggctgcgaccggcggttctcccgctctgacgagctgacacggcacatccgaatccacactgggcataagcccttccagtgtcggatctgcatgcgcaacttcagccgcagtgaccacctcaccacccatatccgcacccacaccggtgagaagcccttcgcctgtgactactgtggccgaaagtttgcccggagtgatgagaggaagcgccacaccaagatccacctgagacagaaagagcggaaaagcagtgccccctctgcatcggtgccagccccctctacagcctcctgctctgggggcgtgcagcctgggggtaccctgtgcagcagtaacagcagcagtcttggcggagggccgctcgccccttgctcctctcggacccggacaccttgagatgagactcaggctgatacaccagctcccaaaggtcccggaggccctttgtccactggagctgcacaacaaacactaccaccctttcctgtccctctctccctttgttgggcaaagggctttggtggagctagcactgccccctttccacctagaagcaggttcttcctaaaacttagcccattctagtctctcttaggtgagttgactatcaacccaaggcaaaggggaggctcagaaggaggtggtgtggggatcccctggccaagagggctgaggtctgaccctgctttaaagggttgtttgactaggttttgctaccccacttccccttattttgacccatcacaggtttttgaccctggatgtcagagttgatctaagacgttttctacaataggttgggagatgctgatcccttcaagtggggacagcaaaaagacaagcaaaactgatgtgcactttatggcttgggactgatttgggggacattgtacagtgagtgaagtatagcctttatgccacactctgtggccctaaaatggtgaatcagagcatatctagttgtctcaacccttgaagcaatatgtattatatactcagagaacagaagtgcaatgtgatgggaggaacgtagcaatatctgctccttttcgagttgtttgagaaatgtaggctattttttcagtgtatatccactcagattttgtgtatttttgatgtacccacactgttctctaaattctgaatctttgggaaaaaatgtaaagcatttatgatctcagaggttaacttatttaagggggatgtacatattctctgaaactaggatgcatgcaattgtgttggaagtgtccttggtcgccttgtgtgatgtagacaaatgttacaaggctgcatgtaaatgggttgccttattatggagaaaaaaatcactccctgagtttagtatggctgtatatttatgcctattaatatttggaattttttttagaaagtatatttttgtatgctttgttttgtgacttaaaagtgttacctttgtagtcaaatttcagataagaatgtacataatgttaccggagctgatttgtttggtcattagctcttaatagttgtgaaaaaataaatctattctaacgcaaaaccactaactgaagttcagatataatggatggtttgtgactatagtgtaaataaatacttttcaacaat

SEQ ID NO: 482 - DNA, 2593 bp, Homo sapiens
  ref <308>: DATABASE ACCESSION NUMBER: NM_000414
  ref <309>: DATABASE ENTRY DATE: 2001-06-18
ggccagcgcgtctgcttgttcgtgtgtgtgtcgttgcaggccttattcatgggctcaccgctgaggttcgacgggcgggtggtactggtcaccggcgcgggggcaggattgggccgagcctatgccctggcttttgcagaaagaggagcgttagttgttgtgaatgatttgggaggggacttcaaaggagttggtaaaggctccttagctgctgataaggttgttgaagaaataagaaggagaggtggaaaagcagtggccaactatgattcagtggaagaaggagagaaggttgtgaagacagccctggatgcttttggaagaatagatgttgtggtcaacaatgctggaattctgagggatcgttcctttgctaggataagtgatgaagactgggatataatccacagagttcatttgcggggttcattccaagtgacacgggcagcatgggaacacatgaagaaacagaagtatggaaggattattatgacttcatcagcttcaggaatatatggcaactttggccaggccaattatagtgctgcaaagttgggtcttctgggccttgcaaattctcttgcaattgaaggcaggaaaagcaacattcattgtaacaccattgctcctaatgcgggatcacggatgactcagacagttatgcctgaagatcttgtggaagccctgaagccagagtatgtggcacctcttgtcctttggctttgtcacgagagttgtgaggagaatggtggcttgtttgaggttggagcaggatggattggaaaattacgctgggagcggactcttggagctattgtaagacaaaagaatcacccaatgactcctgaggcagtcaaggctaactggaagaagatctgtgactttgagaatgccagcaagcctcagagtatccaagaatcaactggcagtataattgaagttctgagtaaaatagattcagaaggaggagtttcagcaaatcatactagtcgtgcaacgtctacagcaacatcaggatttgctggagctattggccagaaactccctccattttcttatgcttatacggaactggaagctattatgtatgcccttggagtgggagcgtcaatcaaggatccaaaagatttgaaatttatttatgaaggaagttctgatttctcctgtttgcccaccttcggagttatcataggtcagaaatctatgatgggtggaggattagcagaaattcctggactttcaatcaactttgcaaaggttcttcatggagagcagtacttagagttatataaaccacttcccagagcaggaaaattaaaatgtgaagcagttgttgctgatgtcctagataaaggatccggtgtagtgattattatggatgtctattcttattctgagaaggaacttatatgccacaatcagttctctctctttcttgttggctctggaggctttggtggaaaacggacatcagacaaagtcaaggtagctgtagccatacctaatagacctcctgatgctgtacttacagataccacctctcttaatcaggctgctttgtaccgcctcagtggagactggaatcccttacacattgatcctaactttgctagtctagcaggttttgacaagcccatattacatggattatgtacatttggattttctgccaggcgtgtgttacagcagtttgcagataatgatgtgtcaagattcaaggcaattaaggctcgttttgcaaaaccagtatatccaggacaaactctacaaactgagatgtggaaggaaggaaacagaattcattttcaaaccaaggtccaagaaactggagacattgtcatttcaaatgcatatgtggatcttgcaccaacatctggtacttcagctaagacaccctctgagggcgggaagcttcagagtacctttgtatttgaggaaataggacgccgcctaaaggatattgggcctgaggtggtgaagaaagtaaatgctgtatttgagtggcatataaccaaaggcggaaatattggggctaagtggactattgacctgaaaagtggttctggaaaagtgtaccaaggccctgcaaaaggtgctgctgatacaacaatcatactttcagatgaagatttcatggaggtggtcctgggcaagcttgaccctcagaaggcattctttagtggcaggctgaaggccagagggaacatcatgctgagccagaaacttcagatgattcttaaagactacgccaagctctgaagggcacactacactattaataaaaatggaatcattaaatactctcttcacccaaatatgcttgattattctgcaaaagtgattagaactaagatgcaggggaaattgcttaacattttcagatatcagataactgcagattttcattttctactaattttcatgtatcattatttttacaaggaactatatataagctagcacatgattatccttctgttcttagatctgtatcttcataataaaaaattttgcccaagtcctgtttccttagaatttgtgatagcattgataagttgaaaggaaaattaaatcaataaaggcctttgatacc

SEQ ID NO: 483 - DNA, 2059 bp, Homo sapiens
  ref <308>: DATABASE ACCESSION NUMBER: NM_000416
  ref <309>: DATABASE ENTRY DATE: 2001-06-18
ccgcaggcgctcggggttggagccagcgaccgtcggtagcagcatggctctcctctttctcctaccccttgtcatgcagggtgtgagcagggctgagatgggcaccgcggatctggggccgtcctcagtgcctacaccaactaatgttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgagatccagtataaaatactcacgcagaaggaagatgattgtgacgagattcagtgccagttagcgattccagtatcctcactgaattctcagtactgtgtttcagcagaaggagtcttacatgtgtggggtgttacaactgaaaagtcaaaagaagtttgtattaccattttcaatagcagtataaaaggttctctttggattccagttgttgctgctttactactctttctagtgcttagcctggtattcatctgtttttatattaagaaaattaatccattgaaggaaaaaagcataatattacccaagtccttgatctctgtggtaagaagtgctactttagagacaaaacctgaatcaaaatatgtatcactcatcacgtcataccagccattttccttagaaaaggaggtggtctgtgaagagccgttgtctccagcaacagttccaggcatgcataccgaagacaatccaggaaaagtggaacatacagaagaactttctagtataacagaagtggtgactactgaagaaaatattcctgacgtggtcccgggcagccatctgactccaatagagagagagagttcttcacctttaagtagtaaccagtctgaacctggcagcatcgctttaaactcgtatcactccagaaattgttctgagagtgatcactccagaaatggttttgatactgattccagctgtctggaatcacatagctccttatctgactcagaatttcccccaaataataaaggtgaaataaaaacagaaggacaagagctcataaccgtaataaaagcccccacctcctttggttatgataaaccacatgtgctagtggatctacttgtggatgatagcggtaaagagtccttgattggttatagaccaacagaagattccaaagaattttcatgagatcagctaagttgcaccaactttgaagtctgattttcctggacagttttctgctttaatttcatgaaaagattatgatctcagaaattgtatcttagttggtatcaaccaaatggagtgacttagtgtacatgaaagcgtaaagaggatgtgtggcattttcacttttggcttgtaaagtacagacttttttttttttttaaacaaaaaaagcattgtaacttatgaacctttacatccagataggttaccagtaacggaacatatccagtactcctggttcctaggtgagcaggtgatgccccagggacctttgtagccacttcactttttttcttttctctgccttggtatagcatatgtgttttgtaagtttatgcatacagtaattttaagtaatttcagaagaaattctcgaagcttttcaaaattggacttaaaatctaattcaaactaatagaattaatggaatatgtaaatagaaacgtgtatattttttatgaaacattacagttagagatttttaaataaagaattttaaaactc

SEQ ID NO: 484 - DNA, 1512 bp, Homo sapiens
  ref <308>: DATABASE ACCESSION NUMBER: NM_000422
  ref <309>: DATABASE ENTRY DATE: 2001-06-18
ctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggagcagccgccccatctgccccacagtctccggcctctccagcctcagccccctgcttcagtcccttccccatgcttccttgcctgatgacaataaagcttgttgactcagctaaaaaaaaaaaaaaa

SEQ ID NO: 485 - DNA, 2529 bp, Homo sapiens
  ref <308>: DATABASE ACCESSION NUMBER: NM_000424
  ref <309>: DATABASE ENTRY DATE: 2001-06-18
gcatcctttttgggctgctcacagcccccagcctctatggtgaagacatacttgctagcagcgtcaccaacttgctgccaagagatcagtgctgcaaggcaaggttatttctaactgagcagagcctgccaggaagaaagcgtttgcaccccacaccactgtgcaggtgtgaccggtgagctcacagctgccccccaggcatgcccagcccacttaatcattcacagctcgacagctctctcgcccagcccagttctggaagggataaaaagggggcatcaccgttcctgggtaacagagccaccttctgcgtcctgctgagctctgttctctccagcacctcccaacccactagtgcctggttctcttgctccaccaggaacaagccaccatgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagaggaggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatcacagagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcagactcagtggagaaggagttggaccagtcaacatctctgttgtcacaagcagtgtttcctctggatatggcagtggcagtggctatggcggtggcctcggtggaggtcttggcggcggcctcggtggaggtcttgccggaggtagcagtggaagctactactccagcagcagtgggggtgtcggcctaggtggtgggctcagtgtggggggctctggcttcagtgcaagcagtggccgagggctgggggtgggctttggcagtggcgggggtagcagctccagcgtcaaatttgtctccaccacctcctcctcccggaagagcttcaagagctaagaacctgctgcaagtcactgccttccaagtgcagcaacccagcccatggagattgcctcttctaggcagttgctcaagccatgttttatccttttctggagagtagtctagaccaagccaattgcagaaccacattctttggttcccaggagagccccattcccagcccctggtctcccgtgccgcagttctatattctgcttcaaatcagccttcaggtttcccacagcatggcccctgctgacacgagaacccaaagttttcccaaatctaaatcatcaaaacagaatccccaccccaatcccaaattttgttttggttctaactacctccagaatgtgttcaataaaatgcttttataatat

SEQ ID NO: 486 - DNA, 2206 bp, Homo sapiens
  ref <308>: DATABASE ACCESSION NUMBER: NM_000433
  ref <309>: DATABASE ENTRY DATE: 2001-06-18
ctagtctttcagccttcaggctgtttttggcttgaagctctcttggcctcctagtttctacctaatcatgtccctggtggaggccatcagcctctggaatgaaggggtgctggcagcggacaagaaggactggaagggagccctggatgccttcagtgccgtccaggacccccactcccggatttgcttcaacattggctgcatgtacactatcctgaagaacatgactgaagcagagaaggcctttaccagaagcattaaccgagacaagcacttggcagtggcttacttccaacgagggatgctctactaccagacagagaaatatgatttggctatcaaagaccttaaagaagccttgattcagcttcgagggaaccagctgatagactataagatcctggggctccagttcaagctgtttgcctgtgaggtgttatataacattgctttcatgtatgccaagaaggaggaatggaaaaaagctgaagaacagttagcattggccacgagcatgaagtctgagcccagacattccaaaatcgacaaggcgatggagtgtgtctggaagcagaagctatatgagccagtggtgatccctgtgggcaagctgtttcgaccaaatgagagacaagtggctcagctggccaagaaggattacctaggcaaggcgacggtcgtggcatctgtggtggatcaagacagtttctctgggtttgcccctctgcaaccacaggcagctgagcctccacccagaccgaaaaccccagagatcttcagggctctggaaggggaggctcaccgtgtgctatttgggtttgtgcctgagacaaaagaagagctccaggtcatgccagggaacattgtctttgtcttgaagaagggcaatgataactgggccacggtcatgttcaacgggcagaaggggcttgttccctgcaactaccttgaaccagttgagttgcggatccaccctcagcagcagccccaggaggaaagctctccgcagtccgacatcccagctcctcctagttccaaagcccctggaaaaccccagctgtcaccaggccagaaacaaaaagaagagcctaaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgagctatcggcctcgggacagcaatgagctggtgcccctttcagaagacagcatgaaggatgcctggggccaggtgaaaaactactgcctgactctgtggtgtgagaacacagtgggtgaccaaggctttccagatgaacccaaggaaagtgaaaaagctgatgctaataaccagacaacagaacctcagcttaagaaaggcagccaagtggaggcactcttcagttatgaggctacccaaccagaggacctggagtttcaggaaggggatataatcctggtgttatcaaaggtgaatgaagaatggctggaaggggagtgcaaagggaaggtgggcattttccccaaagtttttgttgaagactgcgcaactacagatttggaaagcactcggagagaagtctaggatgtttcacaaactacaaagctgaagaaaatgaagccctattacttgtttgtaagatttagcacccttctgctgtatactgtactgagacattacagtttggaagtgttaactatttattccctgttaaaatttaacctactagacaatgatgtgagtacccaggatgatttcctggggcacagtgggtgaggagatggggacaggtgaatggaggagttaggggagaggaaaagtggatggaagtgtctggaaagggcacgagagagtcttccaggtactgatcctgtttcttgctctgagtgctagctagccagctgtgttcacactgtaaacattcatcaagctgtacatttggtgcacttttctgtgtcataccacaataaaaaaaaacctatcatcatcttacaaaaacaagacacccaagtccaggcccaaggagtaagtacaaatattcctgtttctgaaccattactgtaattggctcttaaggcttgaagtaaccttataggttactcataaggcatatacaaataaacttgtttgttttcttttttc

SEQ ID NO: 487 - DNA, 3337 bp, Homo sapiens
  ref <308>: DATABASE ACCESSION NUMBER: NM_000436
  ref <309>: DATABASE ENTRY DATE: 2001-06-18
gtcgagcctctagcccgcccgggtttccttcgcagtcgcgcaccgacgctcaaacgcgcgctccaacccgcagcctcctcctgcctcaccgcccgaagatggcggctctcaaactcctctcctccgggcttcggctctgcgcctctgcccgcggatctggggcaacctggtacaagggatgtgtttgttccttttccaccagtgctcatcgccataccaagttttatacagatccagtagaagctgtaaaagacatccctgatggtgccacggttttggttggtggttttgggctatgtggaattccagagaatcttatagatgctttactgaaaactggagtaaaaggactaactgcagtcagcaacaatgcaggggttgacaattttggtttggggcttttgcttcggtcgaagcagataaaacgcatggtctcttcatatgtgggagaaaatgcagaatttgaacgacagtacttatctggtgaattagaagtggagctgacaccacagggcacacttgcagagaggatccgtgcaggcggggctggagttcctgcattttacaccccaacagggtatgggaccctggtacaagaaggaggatcgcccatcaaatacaacaaagatggcagtgttgccattgccagtaagccaagagaggtgagggagttcaatggtcagcactttattttggaggaagcaattacaggggattttgctttggtgaaagcctggaaggcggaccgagcaggaaacgtgattttcaggaaaagtgcaaggaatttcaacttgccaatgtgcaaagctgcagaaaccacagtggtagaggttgaagaaattgtggatattggagcatttgctccagaagacatccatattcctcagatttatgtacatcgccttataaagggagaaaaatatgagaaaagaattgagcgtttatcaatccggaaagagggagatggggaagccaaatctgctaaacctggagatgacgtaagggaacgaatcatcaagagggccgctcttgagtttgaggatggcatgtatgctaatttgggcataggaatccctctcctggccagcaattttatcagcccaaatataactgttcatcttcaaagtgaaaatggagttctgggtttgggtccatatccacgacaacatgaagctgatgcagatctcatcaatgcaggcaaggaaacagttactattcttccaggagcctcttttttctccagcgatgaatcatttgcaatgattagaggtggacacgtcgatctgacaatgctaggagcgatgcaggtttccaaatatggtgacctggctaactggatgatacctgggaagatggtgaaaggaatgggaggtgctatggatttagtgtccagtgcgaaaaccaaagtggtggtcaccatggagcattctgcaaagggaaatgcacataaaatcatggagaaatgtacattaccattgactggaaagcaatgtgtcaaccgcattattactgaaaaggctgtgtttgatgtggacaagaagaaagggttgactctgattgagctctgggaaggcctgacagtggatgacgtacaaaagagtactgggtgtgattttgcagtttcaccaaaactcatgccaatgcagcagatcgcaaattgaaatatggatatttgtaccaggctgcgtgtttttcattttaaacacacaagatttaattgaaaggacatcaataatcataattgtgtatttaacaggtggttttttattagttttcttgtgtttcagactttatgcagccatataaactgttctctaggcatgctgtgacattttaataaaaagcaaaaggagcatttataattatctcatttgttaaggctgagaaggttgtttttataataggtaattatattgaatgcattttcactgaatatggtatgtatgctaaattatatgaacctttccccaagaagggccctagaaattgatgtggctttcctcttaaatattaattattagtcctgaaagaaagataacatatgtgatttttgtggttaggagagttgctgtcatgattgttttttcttcagcctcctctgacttttcttttggggcttcagattttatgattacatcttgtccccctagaacatcccccttcctcccatactgcttttaaacagatgcccaagaaggcaagcaggaatgcctcttgtgggggagggcagggagaaataactagttcaaaccaactatctatctatgctttgcaaagactaaggcgtattataggaagagggctagaaacctaactgattcttctcagttttctcattttaaaacagcccagtattcctttgtatcctcaagggtccttgagaatacttctgttattgaaaccctgtgggctacttgtactgtacctcctctcaagccaagaagggctgtgggataatttaccatgaatccttagtagcaatgacagcagagttaaaaaataaaaggtgttttactttcaggctcttgttttggttcagaggagattttaaatattgaatgacacttctacagaacaacggtttttcttctgccaaggctacttcctttaacgaagtgcctttaattcagccttatccaactagggaaaataatgttggacaagtctaggatttgaagagtcagtgaacttttagtgtcagggaataaacatggtgggtagattaggtttgaaaaaaacttccttagaggtatttattctcaatacctgacaggggcccatgggaatgacttcagaagcatcccggataatagatgggtaaaaagtctaggcaccctgaagaacaggtgagacagctggcctctggacagaggtaggcatagtacagtacgatatatcattcctctggtcctaaatatacaaacttattcatgtttttaggtgatgatggtcattgaaactcacttcttttcaggtgtagctacaattgtgtaatgtacaatattagagaaaggacaggctttttatgagtaacacacaccatatataaaacagcctttctggctgaccacatggttaaatgcataccttcccagtactggggggaaaatgacccttcttagaatgtgcaagttccatagagtaatatattgatatgattttgaaaagaattgttgatagttacatcttcaaacttatcattccagtatgcatctttaagataatgtgattctaagtagatgactttatattcttgattaaagagtgctatacatgttaagaaatgcattaaggaatacaataaatattctaaactgatgaaaaaaaaaaaaaaaaa

SEQ ID NO: 488 - DNA, 3834 bp, Homo sapiens
  ref <308>: DATABASE ACCESSION NUMBER: NM_000450
  ref <309>: DATABASE ENTRY DATE: 2001-06-18
cctgagacagaggcagcagtgatacccacctgagagatcctgtgtttgaacaactgcttcccaaaacggaaagtatttcaagcctaaacctttgggtgaaaagaactcttgaagtcatgattgcttcacagtttctctcagctctcactttggtgcttctcattaaagagagtggagcctggtcttacaacacctccacggaagctatgacttatgatgaggccagtgcttattgtcagcaaaggtacacacacctggttgcaattcaaaacaaagaagagattgagtacctaaactccatattgagctattcaccaagttattactggattggaatcagaaaagtcaacaatgtgtgggtctgggtaggaacccagaaacctctgacagaagaagccaagaactgggctccaggtgaacccaacaataggcaaaaagatgaggactgcgtggagatctacatcaagagagaaaaagatgtgggcatgtggaatgatgagaggtgcagcaagaagaagcttgccctatgctacacagctgcctgtaccaatacatcctgcagtggccacggtgaatgtgtagagaccatcaataattacacttgcaagtgtgaccctggcttcagtggactcaagtgtgagcaaattgtgaactgtacagccctggaatcccctgagcatggaagcctggtttgcagtcacccactgggaaacttcagctacaattcttcctgctctatcagctgtgataggggttacctgccaagcagcatggagaccatgcagtgtatgtcctctggagaatggagtgctcctattccagcctgcaatgtggttgagtgtgatgctgtgacaaatccagccaatgggttcgtggaatgtttccaaaaccctggaagcttcccatggaacacaacctgtacatttgactgtgaagaaggatttgaactaatgggagcccagagccttcagtgtacctcatctgggaattgggacaacgagaagccaacgtgtaaagctgtgacatgcagggccgtccgccagcctcagaatggctctgtgaggtgcagccattcccctgctggagagttcaccttcaaatcatcctgcaacttcacctgtgaggaaggcttcatgttgcagggaccagcccaggttgaatgcaccactcaagggcagtggacacagcaaatcccagtttgtgaagctttccagtgcacagccttgtccaaccccgagcgaggctacatgaattgtcttcctagtgcttctggcagtttccgttatgggtccagctgtgagttctcctgtgagcagggttttgtgttgaagggatccaaaaggctccaatgtggccccacaggggagtgggacaacgagaagcccacatgtgaagctgtgagatgcgatgctgtccaccagcccccgaagggtttggtgaggtgtgctcattcccctattggagaattcacctacaagtcctcttgtgccttcagctgtgaggagggatttgaattatatggatcaactcaacttgagtgcacatctcagggacaatggacagaagaggttccttcctgccaagtggtaaaatgttcaagcctggcagttccgggaaagatcaacatgagctgcagtggggagcccgtgtttggcactgtgtgcaagttcgcctgtcctgaaggatggacgctcaatggctctgcagctcggacatgtggagccacaggacactggtctggcctgctacctacctgtgaagctcccactgagtccaacattcccttggtagctggactttctgctgctggactctccctcctgacattagcaccatttctcctctggcttcggaaatgcttacggaaagcaaagaaatttgttcctgccagcagctgccaaagccttgaatcagacggaagctaccaaaagccttcttacatcctttaagttcaaaagaatcagaaacaggtgcatctggggaactagagggatacactgaagttaacagagacagataactctcctcgggtctctggcccttcttgcctactatgccagatgcctttatggctgaaaccgcaacacccatcaccacttcaatagatcaaagtccagcaggcaaggacggccttcaactgaaaagactcagtgttccctttcctactctcaggatcaagaaagtgttggctaatgaagggaaaggatattttcttccaagcaaaggtgaagagaccaagactctgaaatctcagaattccttttctaactctcccttgctcgctgtaaaatcttggcacagaaacacaatattttgtggctttctttcttttgcccttcacagtgtttcgacagctgattacacagttgctgtcataagaatgaataataattatccagagtttagaggaaaaaaatgactaaaaatattataacttaaaaaaatgacagatgttgaatgcccacaggcaaatgcatggagggttgttaatggtgcaaatcctactgaatgctctgtgcgagggttactatgcacaatttaatcactttcatccctatgggattcagtgcttcttaaagagttcttaaggattgtgatatttttacttgcattgaatatattataatcttccatacttcttcattcaatacaagtgtggtagggacttaaaaaacttgtaaatgctgtcaactatgatatggtaaaagttacttattctagattaccccctcattgtttattaacaaattatgttacatctgttttaaatttatttcaaaaagggaaactattgtcccctagcaaggcatgatgttaaccagaataaagttctgagtgtttttactacagttgttttttgaaaacatggtagaattggagagtaaaaactgaatggaaggtttgtatattgtcagatattttttcagaaatatgtggtttccacgatgaaaaacttccatgaggccaaacgttttgaactaataaaagcataaatgcaaacacacaaaggtataattttatgaatgtctttgttggaaaagaatacagaaagatggatgtgctttgcattcctacaaagatgtttgtcagatgtgatatgtaaacataattcttgtatattatggaagattttaaattcacaatagaaactcaccatgtaaaagagtcatctggtagatttttaacgaatgaagatgtctaatagttattccctatttgttttcttctgtatgttagggtgctctggaagagaggaatgcctgtgtgagcaagcatttatgtttatttataagcagatttaacaattccaaaggaatctccagttttcagttgatcactggcaatgaaaaattctcagtcagtaattgccaaagctgctctagccttgaggagtgtgagaatcaaaactctcctacacttccattaacttagcatgtgttgaaaaaaaaagtttcagagaagttctggctgaacactggcaacgacaaagccaacagtcaaaacagagatgtgataaggatcagaacagcagaggttcttttaaaggggcagaaaaactctgggaaataagagagaacaactactgtgatcaggctatgtatggaatacagtgttattttctttgaaattgtttaagtgttgtaaatatttatgtaaactgcattagaaattagctgtgtgaaataccagtgtggtttgtgtttgagttttattgagaattttaaattataacttaaaatattttataatttttaaagtatatatttatttaagcttatgtcagacctatttgacataacactataaaggttgacaataaatgtgcttatgttt

SEQ ID NO: 489 - DNA, 2628 bp, Homo sapiens
  ref <308>: DATABASE ACCESSION NUMBER: NM_000462
  ref <309>: DATABASE ENTRY DATE: 2001-06-18
atggagaagctgcaccagtgttattggaaatcaggagaacctcagtctgacgacattgaagctagccgaatgaagcgagcagctgcaaagcatctaatagaacgctactaccaccagttaactgagggctgtggaaatgaagcctgcacgaatgagttttgtgcttcctgtccaacttttcttcgtatggataataatgcagcagctattaaagccctcgagctttataagattaatgcaaaactctgtgatcctcatccctccaagaaaggagcaagctcagcttaccttgagaactcgaaaggtgcccccaacaactcctgctctgagataaaaatgaacaagaaaggcgctagaattgattttaaagatgtgacttacttaacagaagagaaggtatatgaaattcttgaattatgtagagaaagagaggattattcccctttaatccgtgttattggaagagttttttctagtgctgaggcattggtacagagcttccggaaagttaaacaacacaccaaggaagaactgaaatctcttcaagcaaaagatgaagacaaagatgaagatgaaaaggaaaaagctgcatgttctgctgctgctatggaagaagactcagaagcatcttcctcaaggataggtgatagctcacagggagacaacaatttgcaaaaattaggccctgatgatgtgtctgtggatattgatgccattagaagggtctacaccagattgctctctaatgaaaaaattgaaactgcctttctcaatgcacttgtatatttgtcacctaacgtggaatgtgacttgacgtatcacaatgtatactctcgagatcctaattatctgaatttgttcattatcggaatggagaatagaaatctccacagtcctgaatatctggaaatggctttgccattattttgcaaagcgatgagcaagctaccccttgcagcccaaggaaaactgatcagactgtggtctaaatacaatgcagaccagattcggagaatgatggagacatttcagcaacttattacttataaagtcataagcaatgaatttaacagtcgaaatctagtgaatgatgatgatgccattgttgctgcttcgaagtgcttgaaaatggtttactatgcaaatgtagtgggaggggaagtggacacaaatcacaatgaagaagatgatgaagagcccatccctgagtccagcgagctgacacttcaggaacttttgggagaagaaagaagaaacaagaaaggtcctcgagtggaccccctggaaactgaacttggtgttaaaaccctggattgtcgaaaaccacttatcccttttgaagagtttattaatgaaccactgaatgaggttctagaaatggataaagattatacttttttcaaagtagaaacagagaacaaattctcttttatgacatgtccctttatattgaatgctgtcacaaagaatttgggattatattatgacaatagaattcgcatgtacagtgaacgaagaatcactgttctctacagcttagttcaaggacagcagttgaatccatatttgagactcaaagttagacgtgaccatatcatagatgatgcacttgtccggctagagatgatcgctatggaaaatcctgcagacttgaagaagcagttgtatgtggaatttgaaggagaacaaggagttgatgagggaggtgtttccaaagaattttttcagctggttgtggaggaaatcttcaatccagatattggtatgttcacatacgatgaatctacaaaattgttttggtttaatccatcttcttttgaaactgagggtcagtttactctgattggcatagtactgggtctggctatttacaataactgtatactggatgtacattttcccatggttgtctacaggaagctaatggggaaaaaaggaacttttcgtgacttgggagactctcacccagttctatatcagagtttaaaagatttattggagtatgaagggaatgtggaagatgacatgatgatcactttccagatatcacagacagatctttttggtaacccaatgatgtatgatctaaaggaaaatggtgataaaattccaattacaaatgaaaacaggaaggaatttgtcaatctttattctgactacattctcaataaatcagtagaaaaacagttcaaggcttttcggagaggttttcatatggtgaccaatgaatctcccttaaagtacttattcagaccagaagaaattgaattgcttatatgtggaagccggaatctagatttccaagcactagaagaaactacagaatatgacggtggctataccagggactctgttctgattagggagttctgggaaatcgttcattcatttacagatgaacagaaaagactcttcttgcagtttacaacgggcacagacagagcacctgtgggaggactaggaaaattaaagatgattatagccaaaaatggcccagacacagaaaggttacctacatctcatacttgctttaatgtgcttttacttccggaatactcaagcaaagaaaaacttaaagagagattgttgaaggccatcacgtatgccaaaggatttggcatgctgtaa

SEQ ID NO: 490 - DNA, 5076 bp, Homo sapiens
  ref <308>: DATABASE ACCESSION NUMBER: NM_000495
  ref <309>: DATABASE ENTRY DATE: 2001-06-18
atgaaactgcgtggagtcagcctggctgccggcttgttcttactggccctgagtctttgggggcagcctgcagaggctgcggcttgctatgggtgttctccaggatcaaagtgtgactgcagtggcataaaaggggaaaagggagagagagggtttccaggtttggaaggacacccaggattgcctggatttccaggtccagaagggcctccggggcctcggggacaaaagggtgatgatggaattccagggccaccaggaccaaaaggaatcagaggtcctcctggacttcctggatttccagggacaccaggtcttcctggaatgccaggccacgatggggccccaggacctcaaggtattcccggatgcaatggaaccaagggagaacgtggatttccaggcagtcccggttttcctggtttacagggtcctccaggaccccctgggatcccaggtatgaagggtgaaccaggtagtataattatgtcatcactgccaggaccaaagggtaatccaggatatccaggtcctcctggaatacaaggcctacctggtcccactggtataccagggccaattggtcccccaggaccaccaggtttgatgggccctcctggtccaccaggacttccaggacctaaggggaatatgggcttaaatttccagggacccaaaggtgaaaaaggtgagcaaggtcttcagggcccacctgggccacctgggcagatcagtgaacagaaaagaccaattgatgtagagtttcagaaaggagatcagggacttcctggtgaccgagggcctcctggacctccagggatacgtggtcctccaggtcccccaggtggtgagaaaggtgagaagggtgagcaaggagagccaggcaaaagaggtaaaccaggcaaagatggagaaaatggccaaccaggaattcctggtttgcctggtgatcctggttaccctggtgaacccggaagggatggtgaaaagggccaaaaaggtgacactggcccacctggacctcctggacttgtaattcctagacctgggactggtataactataggagaaaaaggaaacattgggttgcctgggttgcctggagaaaaaggagagcgaggatttcctggaatacagggtccacctggccttcctggacctccaggggctgcagttatgggtcctcctggccctcctggatttcctggagaaaggggtcagaaaggtgatgaaggaccacctggaatttccattcctggacctcctggacttgacggacagcctggggctcctgggcttccagggcctcctggccctgctggccctcacattcctcctagtgatgagatatgtgaaccaggccctccaggccccccaggatctccaggtgataaaggactccaaggagaacaaggagtgaaaggtgacaaaggtgacacttgcttcaactgcattggaactggtatttcagggcctccaggtcaacctggtttgccaggtctcccaggtcctccaggatctcttggtttccctggacagaaaggggaaaaaggacaagctggtgcaactggtcccaaaggattaccaggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctggtggaattacttttaagggtgaaagaggtccccctgggaacccaggtttaccaggcctcccagggaatatagggcctatgggtccccctggtttcggccctccaggcccagtaggtgaaaaaggcatacaaggtgtggcaggaaatccaggccagccaggaataccaggtcctaaaggggatccaggtcagactataacccagccggggaagcctggcttgcctggtaacccaggcagagatggtgatgtaggtcttccaggtgaccctggacttccagggcaaccaggcttgccagggatacctggtagcaaaggagaaccaggtatccctggaattgggcttcctggaccacctggtcccaaaggctttcctggaattccaggacctccaggagcacctgggacacctggaagaattggtctagaaggccctcctgggccacccggctttccaggaccaaagggtgaaccaggatttgcattacctgggccacctgggccaccaggacttccaggtttcaaaggagcacttggtccaaaaggtgatcgtggtttcccaggacctccgggtcctccaggacgcactggcttagatgggctccctggaccaaaaggtgatgttggaccaaatggacaacctggaccaatgggacctcctgggctgccaggaataggtgttcagggaccaccaggaccaccagggattcctgggccaataggtcaacctggtttacatggaataccaggagagaagggggatccaggacctcctggacttgatgttccaggacccccaggtgaaagaggcagtccagggatccccggagcacctggtcctataggacctccaggatcaccagggcttccaggaaaagcaggtgcctctggatttccaggtaccaaaggtgaaatgggtatgatgggacctccaggcccaccaggacctttgggaattcctggcaggagtggtgtacctggtcttaaaggtgatgatggcttgcagggtcagccaggacttcctggccctacaggagaaaaaggtagtaaaggagagcctggccttccaggccctcctggaccaatggatccaaatcttctgggctcaaaaggagagaagggggaacctggcttaccaggtatacctggagtttcagggccaaaaggttatcagggtttgcctggagacccagggcaacctggactgagtggacaacctggattaccaggaccaccaggtcccaaaggtaaccctggtctccctggacagccaggtcttataggacctcctggacttaaaggaaccatcggtgatatgggttttccagggcctcagggtgtggaagggcctcctggaccttctggagttcctggacaacctggctccccaggattacctggacagaaaggcgacaaaggtgatcctggtatttcaagcattggtcttccaggtcttcctggtccaaagggtgagcctggtctgcctggatacccagggaaccctggtatcaaaggttctgtgggagatcctggtttgcccggattaccaggaacccctggagcaaaaggacaaccaggccttcctggattcccaggaaccccaggccctcctggaccaaaaggtattagtggccctcctgggaaccccggccttccaggagaacctggtcctgtaggtggtggaggtcatcctgggcaaccagggcctccaggcgaaaaaggcaaacccggtcaagatggtattcctggaccagctggacagaagggtgaaccaggtcaaccaggctttggaaacccaggaccccctggacttccaggactttctggccaaaagggtgatggaggattacctgggattccaggaaatcctggccttccaggtccaaagggcgaaccaggctttcacggtttccctggtgtgcagggtcccccaggccctcctggttctccgggtccagctctggaaggacctaaaggcaaccctgggccccaaggtcctcctgggagaccaggtcctacaggttttcaaggtctaccaggtccagaaggtcctccaggtctccctggaaatggaggtattaaaggagagaagggaaatccaggccaacctgggctacctggcttgcctggtttgaaaggagatcaaggaccaccaggactccagggtaatcctggccggccgggtctcaatggaatgaaaggagatcctggtctccctggtgttccaggattcccaggcatgaaaggacccagtggagtacctggatcagctggccctgagggggaaccgggacttattggtcctccaggtcctcctggattacctggtccttcaggacagagtatcataattaaaggagatgctggtcctccaggaatccctggccagcctgggctaaagggtctaccaggaccccaaggacctcaaggcttaccaggtccaactggccctccaggagatcctggacgcaatggactccctggctttgatggtgcaggagggcgcaaaggagacccaggtctgccaggacagccaggtacccgtggtttggatggtccccctggtccagatggattgcaaggtcccccaggtccccctggaacctcctctgttgcacatggatttcttattacacgccacagccagacaacggatgcaccacaatgcccacagggaacacttcaggtctatgaaggcttttctctcctgtatgtacaaggaaataaaagagcccacggtcaagacttggggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcgatgtgcagtatgtgaagctccagctgtggtgatcgcagttcacagtcagacgatccagattccccattgtcctcagggatgggattctctgtggattggttattccttcatgatgcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcagtaaacctcagtcagaaacgctgaaagcaggagacttgaggacacgaattagccgatgtcaagtgtgcatgaagaggacataa

SEQ ID NO: 491 - DNA, 1476 bp, Homo sapiens
  ref <308>: DATABASE ACCESSION NUMBER: NM_000507
  ref <309>: DATABASE ENTRY DATE: 2001-06-18
ggcctggcccagttgcaccacgagcgctgcggacactcggggcggcagtcggtctgtcagtcctcccgccaggtcccgcggcccgcacctgccgcccgcacctgcagctccgcacctgcggccagtgcctactgccctctcttgccgcccgcacctgcagccccgcacctgccgcttgcacctgcagccccgcgctctacccggttcaagcatggctgaccaggcgcccttcgacacggacgtcaacaccctgacccgcttcgtcatggaggagggcaggaaggcccgcggcacgggcgagttgacccagctgctcaactcgctctgcacagcagtcaaagccatctcttcggcggtgcgcaaggcgggcatcgcgcacctctatggcattgctggttctaccaacgtgacaggtgatcaagttaagaagctggacgtcctctccaacgacctggttatgaacatgttaaagtcatcctttgccacgtgtgttctcgtgtcagaagaagataaacacgccatcatagtggaaccggagaaaaggggtaaatatgtggtctgttttgatccccttgatggatcttccaacatcgattgccttgtgtccgttggaaccatttttggcatctatagaaagaaatcaactgatgagccttctgagaaggatgctctgcaaccaggccggaacctggtggcagccggctacgcactgtatggcagtgccaccatgctggtccttgccatggactgtggggtcaactgcttcatgctggacccggccatcggggagttcattttggtggacaaggatgtgaagataaaaaagaaaggtaaaatctacagccttaacgagggctacgctaaggactttgaccctgccgtcactgagtacatccagaggaagaagttcccccagataattcagctccttatggggcccggtatgtgggctccatggtggctgatgttcatcgcactctggtctacggagggatatttctgtaccccgctaacaagaagagccccaatggaaaggctgagactgctgtacgaatgcaaccccatggcctacgtcatggagaaggctgggggaatggccaccactgggaaggaggccgtgttagacgtcattcccacagacattcaccagagggcgccggtgatcttggggtcccccgacgacgtgctcgagttcctgaaggtgtatgagaagcactctgcccagtgagcacctgccctgcctgtatctggagaattgcctctacctggaccttttgtctcacacagcagtaccctgacctgctgtgcaccttacattcctagagagcagaaataaaaagcatgactatttccaccatcaaatgctgtagaatgcttggcactccctaaccaaatgctgtctccataatgccactggtgttaagatatattttgagtggatggaggagaaataaacttattcctccttaaaaaaaa

SEQ ID NO: 492 - DNA, 1419 bp, Homo sapiens
  ref <308>: DATABASE ACCESSION NUMBER: NM_000526
  ref <309>: DATABASE ENTRY DATE: 2001-06-18
atgactacctgcagccgccagttcacctcctccagctccatgaagggctcctgcggcatcgggggcggcatcggggcgggctccagccgcatctcctccgtcctggccggagggtcctgccgcgcccccaacacctacgggggcggcctgtctgtctcatcctcccgcttctcctctgggggagcctatgggttggggggcggctatggcggtggcttcagcagcagcagcagcagctttggtagtggctttgggggaggatatggtggtggccttggtgctggcttgggtggtggctttggtggtggctttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcctgctgagatcaaagactacagtccctacttcaagaccattgaggacctgaggaacaagattctcacagccacagtggacaatgccaatgtccttctgcagattgacaatgcccgtctggccgcggatgacttccgcaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatggcaaggtggtgtccacccacgagcaggtccttcgcaccaagaactga

SEQ ID NO: 493 - DNA, 2383 bp, Homo sapiens
  ref <308>: DATABASE ACCESSION NUMBER: NM_000557
  ref <309>: DATABASE ENTRY DATE: 2001-06-18
ctccttcaagccctcagtcagttgtgcaggagaaagggggcggttggctttctcctttcaagaacgagttattttcagctgctgactggagacggtgcacgtctggatacgagagcatttccactatgggactggatacaaacacacacccggcagacttcaagagtctcagactgaggagaaagcctttccttctgctgctactgctgctgccgctgcttttgaaagtccactcctttcatggtttttcctgccaaaccagaggcacctttgctgctgccgctgttctctttggtgtcattcagcggctggccagaggatgagactccccaaactcctcactttcttgctttggtacctggcttggctggacctggaattcatctgcactgtgttgggtgcccctgacttgggccagagaccccaggggaccaggccaggattggccaaagcagaggccaaggagaggccccccctggcccggaacgtcttcaggccagggggtcacagctatggtgggggggccaccaatgccaatgccagggcaaagggaggcaccgggcagacaggaggcctgacacagcccaagaaggatgaacccaaaaagctgccccccagaccgggcggccctgaacccaagccaggacaccctccccaaacaaggcaggctacagcccggactgtgaccccaaaaggacagcttcccggaggcaaggcacccccaaaagcaggatctgtccccagctccttcctgctgaagaaggccagggagcccgggcccccacgagagcccaaggagccgtttcgcccaccccccatcacaccccacgagtacatgctctcgctgtacaggacgctgtccgatgctgacagaaagggaggcaacagcagcgtgaagttggaggctggcctggccaacaccatcaccagctttattgacaaagggcaagatgaccgaggtcccgtggtcaggaagcagaggtacgtgtttgacattagtgccctggagaaggatgggctgctgggggccgagctgcggatcttgcggaagaagccctcggacacggccaagccagcggcccccggaggcgggcgggctgcccagctgaagctgtccagctgccccagcggccggcagccggcctccttgctggatgtgcgctccgtgccaggcctggacggatctggctgggaggtgttcgacatctggaagctcttccgaaactttaagaactcggcccagctgtgcctggagctggaggcctgggaacggggcagggccgtggacctccgtggcctgggcttcgaccgcgccgcccggcaggtccacgagaaggccctgttcctggtgtttggccgcaccaagaaacgggacctgttctttaatgagattaaggcccgctctggccaggacgataagaccgtgtatgagtacctgttcagccagcggcgaaaacggcgggccccactggccactcgccagggcaagcgacccagcaagaaccttaaggctcgctgcagtcggaaggcactgcatgtcaacttcaaggacatgggctgggacgactggatcatcgcaccccttgagtacgaggctttccactgcgaggggctgtgcgagttcccattgcgctcccacctggagcccacgaatcatgcagtcatccagaccctgatgaactccatggaccccgagtccacaccacccacctgctgtgtgcccacgcggctgagtcccatcagcatcctcttcattgactctgccaacaacgtggtgtataagcagtatgaggacatggtcgtggagtcgtgtggctgcaggtagcagcactggccctctgtcttcctgggtggcacatcccaagagccccttcctgcactcctggaatcacagaggggtcaggaagctgtggcaggagcatctacacagcttgggtgaaaggggattccaataagcttgctcgctctctgagtgtgacttgggctaaaggcccccttttatccacaagttcccctggctgaggattgctgcccgtctgctgatgtgaccagtggcaggcacaggtccagggagacagactctgaatgggactgagtcccaggaaacagtgctttccgatgagactcagcccaccatttctcctcacctgggccttctcagcctctggactctcctaagcacctctcaggagagccacaggtgccactgcctcctcaaatcacatttgtgcctggtgacttcctgtccctgggacagttgagaagctgactgggcaagagtgggagagaagaggagagggcttggatagagttgaggagtgtgaggctgttagactgttagatttaaatgtatattgatgagataaaaagcaaaactgtgcct

SEQ ID NO: 494 - DNA, 1480 bp, Homo sapiens; identical to SEQ ID NO: 404
  ref <308>: DATABASE ACCESSION NUMBER: NM_000560
  ref <309>: DATABASE ENTRY DATE: 2001-06-18

SEQ ID NO: 495 - DNA, 1497 bp, Homo sapiens
  ref <308>: DATABASE ACCESSION NUMBER: NM_000576
  ref <309>: DATABASE ENTRY DATE: 2001-06-18
accaacctcttcgaggcacaaggcacaacaggctgctctgggattctcttcagccaatcttcattgctcaagtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacagctggagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccaggcctctctcacctctcctactcacttaaagcccgcctgacagaaaccacggccacatttggttctaagaaaccctctgtcattcgctcccacattctgatgagcaaccgcttccctatttatttatttatttgtttgtttgttttattcattggtctaatttattcaaagggggcaagaagtagcagtgtctgtaaaagagcctagtttttaatagctatggaatcaattcaatttggactggtgtgctctctttaaatcaagtcctttaattaagactgaaaatatataagctcagattatttaaatgggaatatttataaatgagcaaatatcatactgttcaatggttctgaaataaacttctctgaag

SEQ ID NO: 496 - DNA, 3655 bp, Homo sapiens
  ref <308>: DATABASE ACCESSION NUMBER: NM_000579
  ref <309>: DATABASE ENTRY DATE: 2001-06-18
cttcagatagattatatctggagtgaaggatcctgccacctacgtatctggcatagtattctgtgtagtgggatgagcagagaacaaaaacaaaataatccagtgagaaaagcccgtaaataaaccttcagaccagagatctattctccagcttattttaagctcaacttaaaaagaagaactgttctctgattcttttcgccttcaatacacttaatgatttaactccaccctccttcaaaagaaacagcatttcctacttttatactgtctatatgattgatttgcacagctcatctggccagaagagctgagacatccgttcccctacaagaaactctccccgggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacacggactcaagtgggctggtgacccagtcagagttgtgcacatggcttagttttcatacacagcctgggctgggggtggggtgggagaggtcttttttaaaaggaagttactgttatagagggtctaagattcatccatttatttggcatctgtttaaagtagattagatcttttaagcccatcaattatagaaagccaaatcaaaatatgttgatgaaaaatagcaacctttttatctccccttcacatgcatcaagttattgacaaactctcccttcactccgaaagttccttatgtatatttaaaagaaagcctcagagaattgctgattcttgagtttagtgatctgaacagaaataccaaaattatttcagaaatgtacaactttttacctagtacaaggcaacatataggttgtaaatgtgtttaaaacaggtctttgtcttgctatggggagaaaagacatgaatatgattagtaaagaaatgacacttttcatgtgtgatttcccctccaaggtatggttaataagtttcactgacttagaaccaggcgagagacttgtggcctgggagagctggggaagcttcttaaatgagaaggaatttgagttggatcatctattgctggcaaagacagaagcctcactgcaagcactgcatgggcaagcttggctgtagaaggagacagagctggttgggaagacatggggaggaaggacaaggctagatcatgaagaaccttgacggcattgctccgtctaagtcatgagctgagcagggagatcctggttggtgttgcagaaggtttactctgtggccaaaggagggtcaggaaggatgagcatttagggcaaggagaccaccaacagccctcaggtcagggtgaggatggcctctgctaagctcaaggcgtgaggatgggaaggagggaggtattcgtaaggatgggaaggagggaggtattcgtgcagcatatgaggatgcagagtcagcagaactggggtggatttggtttggaagtgagggtcagagaggagtcagagagaatccctagtcttcaagcagattggagaaacccttgaaaagacatcaagcacagaaggaggaggaggaggtttaggtcaagaagaagatggattggtgtaaaaggatgggtctggtttgcagagcttgaacacagtctcacccagactccaggctgtctttcactgaatgcttctgacttcatagatttccttcccatcccagctgaaatactgaggggtctccaggaggagactagatttatgaatacacgaggtatgaggtctaggaacatacttcagctcacacatgagatctaggtgaggattgattacctagtagtcatttcatgggttgttgggaggattctatgaggcaaccacaggcagcatttagcacatactacacattcaataagcatcaaactcttagttactcattcagggatagcactgagcaaagcattgagcaaaggggtcccatataggtgagggaagcctgaaaaactaagatgctgcctgcccagtgcacacaagtgtaggtatcattttctgcatttaaccgtcaataggcaaaggggggaagggacatattcatttggaaataagctgccttgagccttaaaacccacaaaagtacaatttaccagcctccgtatttcagactgaatgggggtggggggggcgccttaggtacttattccagatgccttctccagacaaaccagaagcaacagaaaaaatcgtctctccctccctttgaaatgaatataccccttagtgtttgggtatattcatttcaaagggagagagagaggtttttttctgttctttctcatatgattgtgcacatacttgagactgttttgaatttgggggatggctaaaaccatcatagtacaggtaaggtgagggaatagtaagtggtgagaactactcagggaatgaaggtgtcagaataataagaggtgctactgactttctcagcctctgaatatgaacggtgagcattgtggctgtcagcaggaagcaacgaagggaaatgtctttccttttgctcttaagttgtggagagtgcaacagtagcataggaccctaccctctgggccaagtcaaagacattctgacatcttagtatttgcatattcttatgtatgtgaaagttacaaattgcttgaaagaaaatatgcatctaataaaaaacaccttcta

SEQ ID NO: 497 - DNA, 1639 bp, Homo sapiens; identical to SEQ ID NO: 396
  ref <308>: DATABASE ACCESSION NUMBER: NM_000584
  ref <309>: DATABASE ENTRY DATE: 2001-06-18

SEQ ID NO: 498 - DNA, 1367 bp, Homo sapiens
  ref <308>: DATABASE ACCESSION NUMBER: NM_000591
  ref <309>: DATABASE ENTRY DATE: 2001-06-18
ccggccggccgaagagttcacaagtgtgaagcctgaagccgccgggtgccgctgtgtagaaagaagctaaagcacttccagagcctgctgagctcagaggttcggaagacttatcgaccatggagcgcgcgtcctgcttgttgctgctgctgctgccgctggtgcacgtctctgcgaccacgccagaaccttgtgagctggacgatgaagatttccgctgcgtctgcaacttctccgaacctcagcccgactggtccgaagccttccagtgtgtgtctgcagtagaggtggagatccatgccggcggtctcaacctagagccgtttctaaagcgcgtcgatgcggacgccgacccgcggcagtatgctgacacggtcaaggctctccgcgtgcggcggctcacagtgggagccgcacaggttcctgctcagctactggtaggcgccctgcgtgtgctagcgtactcccgcctcaaggaactgacgctcgaggacctaaagataaccggcaccatgcctccgctgcctctggaagccacaggacttgcactttccagcttgcgcctacgcaacgtgtcgtgggcgacagggcgttcttggctcgccgagctgcagcagtggctcaagccaggcctcaaggtactgagcattgcccaagcacactcgcctgccttttcctgcgaacaggttcgcgccttcccggcccttaccagcctagacctgtctgacaatcctggactgggcgaacgcggactgatggcggctctctgtccccacaagttcccggccatccagaatctagcgctgcgcaacacaggaatggagacgcccacaggcgtgtgcgccgcactggcggcggcaggtgtgcagccccacagcctagacctcagccacaactcgctgcgcgccaccgtaaaccctagcgctccgagatgcatgtggtccagcgccctgaactccctcaatctgtcgttcgctgggctggaacaggtgcctaaaggactgccagccaagctcagagtgctcgatctcagctgcaacagactgaacagggcgccgcagcctgacgagctgcccgaggtggataacctgacactggacgggaatcccttcctggtccctggaactgccctcccccacgagggctcaatgaactccggcgtggtcccagcctgtgcacgttcgaccctgtcggtgggggtgtcgggaaccctggtgctgctccaaggggcccggggctttgcctaagatccaagacagaataatgaatggactcaaactgccttggcttcaggggagtcccgtcaggacgttgaggacttttcgaccaattcaaccctttgccccacctttattaaaatcttaaac

SEQ ID NO: 499 - DNA, 5235 bp, Homo sapiens
  ref <308>: DATABASE ACCESSION NUMBER: NM_000592
  ref <309>: DATABASE ENTRY DATE: 2001-06-18
atgaggctgctctgggggctgatctgggcatccagcttcttcaccttatctctgcagaagcccaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccagaacgacaaacatccagggtatcaacctgctcttctcctctcgccgggggcacctctttttgcagacggaccagcccatttacaaccctggccagcgggttcggtaccgggtctttgctctggatcagaagatgcgcccgagcactgacaccatcacagtcatggtggagaactctcacggcctccgcgtgcggaagaaggaggtgtacatgccctcgtccatcttccaggatgactttgtgatcccagacatctcagagccagggacctggaagatctcagcccgattctcagatggcctggaatccaacagcagcacccagtttgaggtgaagaaatatgtccttcccaactttgaggtgaagatcacccctggaaagccctacatcctgacggtgccaggccatcttgatgaaatgcagttagacatccaggccaggtacatctatgggaagccagtgcagggggtggcatatgtgcgctttgggctcctagatgaggatggtaagaagactttctttcgggggctggagagtcagaccaagctggtgaatggacagagccacatttccctctcaaaggcagagttccaggacgccctggagaagctgaatatgggcattactgacctccaggggctgcgcctctacgttgctgcagccatcattgagtatccaggtggggagatggaggaggcagagctcacatcctggtattttgtgtcatctcccttctccttggatcttagcaagaccaagcgacaccttgtgcctggggcccccttcctgctgcaggccttggtccgtgagatgtcaggctccccagcttctggcattcctgtcaaagtttctgccacggtgtcttctcctgggtctgttcctgaagtccaggacattcagcaaaacacagacgggagcggccaagtcagcattccaataattatccctcagaccatctcagagctgcagctctcagtatctgcaggctccccacatccagcgatagccaggctcactgtggcagccccaccttcaggaggccccgggtttctgtctattgagcggccggattctcgacctcctcgtgttggggacactctgaacctgaacttgcgagccgtgggcagtggggccaccttttctcattactactacatgatcctatcccgagggcagatcgtgttcatgaatcgagagcccaagaggaccctgacctcggtctcggtgtttgtggaccatcacctggcaccctccttctactttgtggccttctactaccatggagaccacccagtggccaactccctgcgagtggatgtccaggctggggcctgcgagggcaagctggagctcagcgtggacggtgccaagcagtaccggaacggggagtccgtgaagctccacttagaaaccgactccctagccctggtggcgctgggagccttggacacagctctgtatgctgcaggcagcaagtcccacaagcccctcaacatgggcaaggtctttgaagctatgaacagctatgacctcggctgtggtcctgggggtggggacagtgcccttcaggtgttccaggcagcgggcctggccttttctgatggagaccagtggaccttatccagaaagagactaagctgtcccaaggagaagacaacccggaaaaagagaaacgtgaacttccaaaaggcgattaatgagaaattgggtcagtatgcttccccgacagccaagcgctgctgccaggatggggtgacacgtctgcccatgatgcgttcctgcgagcagcgggcagcccgcgtgcagcagccggactgccgggagcccttcctgtcctgctgccaatttgctgagagtctgcgcaagaagagcagggacaagggccaggcgggcctccaacgagccctggagatcctgcaggaggaggacctgattgatgaggatgacattcccgtgcgcagcttcttcccagagaactggctctggagagtggaaacagtggaccgctttcaaatattgacactgtggctccccgactctctgaccacgtgggagatccatggcctgagcctgtccaaaaccaaaggcctatgtgtggccaccccagtccagctccgggtgttccgcgagttccacctgcacctccgcctgcccatgtctgtccgccgctttgagcagctggagctgcggcctgtcctctataactacctggataaaaacctgactgtgagcgtccacgtgtccccagtggaggggctgtgcctggctgggggcggagggctggcccagcaggtgctggtgcctgcgggctctgcccggcctgttgccttctctgtggtgcccacggcagccgccgctgtgtctctgaaggtggtggctcgagggtccttcgaattccctgtgggagatgcggtgtccaaggttctgcagattgagaaggaaggggccatccatagagaggagctggtctatgaactcaaccccttggaccaccgaggccggaccttggaaatacctggcaactctgatcccaatatgatccctgatggggactttaacagctacgtcagggttacagcctcagatccattggacactttaggctctgagggggccttgtcaccaggaggcgtggcctccctcttgaggcttcctcgaggctgtggggagcaaaccatgatctacttggctccgacactggctgcttcccgctacctggacaagacagagcagtggagcacactgcctcccgagaccaaggaccacgccgtggatctgatccagaaaggctacatgcggatccagcagtttcggaaggcggatggttcctatgcggcttggttgtcacggggcagcagcacctggctcacagcctttgtgttgaaggtcctgagtttggcccaggagcaggtaggaggatcgcctgagaaactgcaggagacatctaactggcttctgtcccagcagcaggctgacggctcgttccaggacctctctccagtgatacataggagcatgcaggggggtttggtgggcaatgatgagactgtggcactcacagcctttgtgaccatcgcccttcatcatgggctggccgtcttccaggatgagggtgcagagccattgaagcagagagtggaagcctccatctcaaaggcaagctcatttttgggggagaaagcaagtgctgggctcctgggtgcccacgcagctgccatcacggcctatgccctgacactgaccaaggcccctgcggacctgcggggtgttgcccacaacaacctcatggcaatggcccaggagactggagataacctgtactggggctcagtcactggttctcagagcaatgccgtgtcgcccaccccggctcctcgcaacccatccgaccccatgccccaggccccagccctgtggattgaaaccacagcctacgccctgctgcacctcctgcttcacgagggcaaagcagagatggcagaccaggctgcggcctggctcacccgtcagggcagcttccaagggggattccgcagtacccaagacacggtgattgccctggatgccctgtctgcctactggattgcctcccacaccactgaggagaggggtctcaatgtgactctcagctccacaggccggaatgggttcaagtcccacgcgctgcagctgaacaaccgccagattcgcggcctggaggaggagctgcagttttccttgggcagcaagatcaatgtgaaggtgggaggaaacagcaaaggaaccctgaaggtccttcgtacctacaatgtcctggacatgaagaacacgacctgccaggacctacagatagaagtgacagtcaaaggccacgtcgagtacacgatggaagcaaacgaggactatgaggactatgagtacgatgagcttccagccaaggatgacccagatgcccctctgcagcccgtgacacccctgcagctgtttgagggtcggaggaaccgccgcaggagggaggcgcccaaggtggtggaggagcaggagtccagggtgcactacaccgtgtgcatctggcggaacggcaaggtggggctgtctggcatggccatcgcggacgtcaccctcctgagtggattccacgccctgcgtgctgacctggagaagctgacctccctctctgaccgttacgtgagtcactttgagaccgaggggccccacgtcctgctgtattttgactcggtccccacctcccgggagtgcgtgggctttgaggctgtgcaggaagtgccggtggggctggtgcagccggccagcgcaaccctgtacgactactacaaccccgagcgcagatgttctgtgttttacggggcaccaagtaagagcagactcttggccaccttgtgttctgctgaagtctgccagtgtgctgaggggaagtgccctcgccagcgtcgcgccctggagcggggtctgcaggacgaggatggctacaggatgaagtttgcctgctactacccccgtgtggagtacggcttccaggttaaggttctccgagaagacagcagagctgctttccgcctctttgagaccaagatcacccaagtcctgcacttcaccaaggatgtcaaggccgctgctaatcagatgcgcaacttcctggttcgagcctcctgccgccttcgcttggaacctgggaaagaatatttgatcatgggtctggatggggccacctatgacctcgagggacacccccagtacctgctggactcgaatagctggatcgaggagatgccctctgaacgcctgtgccggagcacccgccagcgggcagcctgtgcccagctcaacgacttcctccaggagtatggcactcaggggtgccaggtgtga

SEQ ID NO: 500 - DNA, 2824 bp, Homo sapiens
  ref <308>: DATABASE ACCESSION NUMBER: NM_000593
  ref <309>: DATABASE ENTRY DATE: 2001-06-18
gcggccgctttcgatttcgctttcccctaaatggctgagcttctcgccagcgcaggatcagcctgttcctgggactttccgagagccccgccctcgttccctcccccagccgccagtaggggaggactcggcggtacccggagcttcaggccccaccggggcgcggagagtcccagacccggccgggaccgggacggcgtccgagtgccaatggctagctctaggtgtcccgctccccgcgggtgccgctgcctccccggagcttctctcgcatggctggggacagtactgctacttctcgccgactgggtgctgctccggaccgcgctgccccgcatattctccctgctggtgcccaccgcgctgccactgctccgggtctgggcggtgggcctgagccgctgggccgtgctctggctgggggcctgcggggtcctcagggcaacggttggctccaagagcgaaaacgcaggtgcccagggctggctggctgctttgaagccattagctgcggcactgggcttggccctgccgggacttgccttgttccgagagctgatctcatggggagcccccgggtccgcggatagcaccaggctactgcactggggaagtcaccctaccgccttcgttgtcagttatgcagcggcactgcccgcagcagccctgtggcacaaactcgggagcctctgggtgcccggcggtcagggcggctctggaaaccctgtgcgtcggcttctaggctgcctgggctcggagacgcgccgcctctcgctgttcctggtcctggtggtcctctcctctcttggggagatggccattccattctttacgggccgcctcactgactggattctacaagatggctcagccgataccttcactcgaaacttaactctcatgtccattctcaccatagccagtgcagtgctggagttcgtgggtgacgggatctataacaacaccatgggccacgtgcacagccacttgcagggagaggtgtttggggctgtcctgcgccaggagacggagtttttccaacagaaccagacaggtaacatcatgtctcgggtaacagaggacacgtccaccctgagtgattctctgagtgagaatctgagcttatttctgtggtacctggtgcgaggcctatgtctcttggggatcatgctctggggatcagtgtccctcaccatggtcaccctgatcaccctgcctctgcttttccttctgcccaagaaggtgggaaaatggtaccagttgctggaagtgcaggtgcgggaatctctggcaaagtccagccaggtggccattgaggctctgtcggccatgcctacagttcgaagctttgccaacgaggagggcgaagcccagaagtttagggaaaagctgcaagaaataaagacactcaaccagaaggaggctgtggcctatgcagtcaactcctggaccactagtatttcaggtatgctgctgaaagtgggaatcctctacattggtgggcagctggtgaccagtggggctgtaagcagtgggaaccttgtcacatttgttctctaccagatgcagttcacccaggctgtggaggtactgctctccatctaccccagagtacagaaggctgtgggctcctcagagaaaatatttgagtacctggaccgcacccctcgctgcccacccagtggtctgttgactcccttacacttggagggccttgtccagttccaagatgtctcctttgcctacccaaaccgcccagatgtcttagtgctacaggggctgacattcaccctacgccctggcgaggtgacggcgctggtgggacccaatgggtctgggaagagcacagtggctgccctgctgcagaatctgtaccagcccaccgggggacagctgctgttggatgggaagccccttccccaatatgagcaccgctacctgcacaggcaggtggctgcagtgggacaagagccacaggtatttggaagaagtcttcaagaaaatattgcctatggcctgacccagaagccaactatggaggaaatcacagctgctgcagtaaagtctggggcccatagtttcatctctggactccctcagggctatgacacagaggtagacgaggctgggagccagctgtcagggggtcagcgacaggcagtggcgttggcccgagcattgatccggaaaccgtgtgtacttatcctggatgatgccaccagtgccctggatgcaaacagccagttacaggtggagcagctcctgtacgaaagccctgagcggtactcccgctcagtgcttctcatcacccagcacctcagcctggtggagcaggctgaccacatcctctttctggaaggaggcgctatccgggaggggggaacccaccagcagctcatggagaaaaaggggtgctactgggccatggtgcaggctcctgcagatgctccagaatgaaagccttctcagacctgcgcactccatctccctcccttttcttctctctgtggtggagaaccacagctgcagagtagcagctgcctccaggatgagttacttgaaatttgccttgagtgtgttacctcctttccaagctcctcgtgataatgcagacttcctggagtacaaacacaggatttgtaattcctactgtaacggagtttagagccagggctgatgctttggtgtggccagcactctgaaactgagaaatgttcagaatgtacggaaagatgatcagctattttcaacataactgaaggcatatgctggcccataaacaccctgtaggttcttgatatttataataaaattggtgttttgt

SEQ ID NO: 501 - DNA, 1585 bp, Homo sapiens
  ref <308>: DATABASE ACCESSION NUMBER: NM_000594
  ref <309>: DATABASE ENTRY DATE: 2001-06-18
cacaccctgacaagctgccaggcaggttctcttcctctcacatactgacccacggctccaccctctctcccctggaaaggacaccatgagcactgaaagcatgatccgggacgtggagctggccgaggaggcgctccccaagaagacaggggggccccagggctccaggcggtgcttgttcctcagcctcttctccttcctgatcgtggcaggcgccaccacgctcttctgcctgctgcactttggagtgatcggcccccagagggaagagtcccccagggacctctctctaatcagccctctggcccaggcagtcagatcatcttctcgaaccccgagtgacaagcctgtagcccatgttgtagcaaaccctcaagctgaggggcagctccagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccatctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcaacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctccagaactcactggggcctacagctttgatccctgacatctggaatctggagaccagggagcctttggttctggccagaatgctgcaggacttgagaagacctcacctagaaattgacacaagtggaccttaggccttcctctctccagatgtttccagacttccttgagacacggagcccagccctccccatggagccagctccctctatttatgtttgcacttgtgattatttattatttatttattatttatttatttacagatgaatgtatttatttgggagaccggggtatcctgggggacccaatgtaggagctgccttggctcagacatgttttccgtgaaaacggaggctgaacaataggctgttcccatgtagccccctggcctctgtgccttcttttgattatgttttttaaaatattatctgattaagttgtctaaacaatgctgatttggtgaccaactgtcactcattgctgaggcctctgctccccagggagttgtgtctgtaatcggcctactattcagtggcgagaaataaaggttgcttaggaaagaa

SEQ ID NO: 502 - DNA, 1433 bp, Homo sapiens
  ref <308>: DATABASE ACCESSION NUMBER: NM_000597
  ref <309>: DATABASE ENTRY DATE: 2001-06-18
attcggggcgagggaggaggaagaagcggaggaggcggctcccgctcgcagggccgtgcacctgcccgcccgcccgctcgctcgctcgcccgccgcgccgcgctgccgaccgccagcatgctgccgagagtgggctgccccgcgctgccgctgccgccgccgccgctgctgccgctgctgccgctgctgctgctgctactgggcgcgagtggcggcggcggcggggcgcgcgcggaggtgctgttccgctgcccgccctgcacacccgagcgcctggccgcctgcgggcccccgccggttgcgccgcccgccgcggtggccgcagtggccggaggcgcccgcatgccatgcgcggagctcgtccgggagccgggctgcggctgctgctcggtgtgcgcccggctggagggcgaggcgtgcggcgtctacaccccgcgctgcggccaggggctgcgctgctatccccacccgggctccgagctgcccctgcaggcgctggtcatgggcgagggcacttgtgagaagcgccgggacgccgagtatggcgccagcccggagcaggttgcagacaatggcgatgaccactcagaaggaggcctggtggagaaccacgtggacagcaccatgaacatgttgggcgggggaggcagtgctggccggaagcccctcaagtcgggtatgaaggagctggccgtgttccgggagaaggtcactgagcagcaccggcagatgggcaagggtggcaagcatcaccttggcctggaggagcccaagaagctgcgaccaccccctgccaggactccctgccaacaggaactggaccaggtcctggagcggatctccaccatgcgccttccggatgagcggggccctctggagcacctctactccctgcacatccccaactgtgacaagcatggcctgtacaacctcaaacagtgcaagatgtctctgaacgggcagcgtggggagtgctggtgtgtgaaccccaacaccgggaagctgatccagggagcccccaccatccggggggaccccgagtgtcatctcttctacaatgagcagcaggaggcttgcggggtgcacacccagcggatgcagtagaccgcagccagccggtgcctggcgcccctgccccccgcccctctccaaacaccggcagaaaacggagagtgcttgggtggtgggtgctggaggattttccagttctgacacacgtatttatatttggaaagagaccagcaccgagctcggcacctccccggcctctctcttcccagctgcagatgccacacctgctccttcttgctttccccgggggaggaagggggttgtggtcggggagctggggtacaggtttggggagggggaagagaaatttttatttttgaacccctgtgtcccttttgcataagattaaaggaaggaaaagt

SEQ ID NO: 503 - DNA, 1722 bp, Homo sapiens; identical to SEQ ID NO: 124
  ref <308>: DATABASE ACCESSION NUMBER: NM_000599
  ref <309>: DATABASE ENTRY DATE: 2001-06-18

SEQ ID NO: 504 - DNA, 1125 bp, Homo sapiens
  ref <308>: DATABASE ACCESSION NUMBER: NM_000600
  ref <309>: DATABASE ENTRY DATE: 2001-06-18
ttctgccctcgagcccaccgggaacgaaagagaagctctatctcgcctccaggagcccagctatgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcattttaaaaaattc

SEQ ID NO: 505 - DNA, 803 bp, Homo sapiens
  ref <308>: DATABASE ACCESSION NUMBER: NM_000607
  ref <309>: DATABASE ENTRY DATE: 2001-06-18
gcccatagtttattataaaggtgactgcaccctgcagccaccagcactgcctggctccacgtgcctcctggtctcagtatggcgctgtcctgggttcttacagtcctgagcctcctacctctgctggaagcccagatcccattgtgtgccaacctagtaccggtgcccatcaccaacgccaccctggaccagatcactggcaagtggttttatatcgcatcggcctttcgaaacgaggagtacaataagtcggttcaggagatccaagcaaccttcttttacttcacccccaacaagacagaggacacgatctttctcagagagtaccagacccgacaggaccagtgcatctataacaccacctacctgaatgtccagcgggaaaatgggaccatctccagatacgtgggaggccaagagcatttcgctcacttgctgatcctcagggacaccaagacctacatgcttgcttttgacgtgaacgatgagaagaactgggggctgtctgtctatgctgacaagccagagacgaccaaggagcaactgggagagttctacgaagctctcgactgcttgcgcattcccaagtcagatgtcgtgtacaccgattggaaaaaggataagtgtgagccactggagaagcagcacgagaaggagaggaaacaggaggagggggaatcctagcaggacacagccttggatcaggacagagacttggggccatcctgcccctccaacccgacatgtgtacctcagctttttccctcacttgcatcaataaagcttctgtgtttggaacagct

SEQ ID NO: 506 - DNA, 1356 bp, Homo sapiens
  ref <308>: DATABASE ACCESSION NUMBER: NM_000612
  ref <309>: DATABASE ENTRY DATE: 2001-06-18
ttctcccgcaaccttcccttcgctccctcccgtcccccccagctcctagcctccgactccctccccccctcacgcccgccctctcgccttcgccgaaccaaagtggattaattacacgctttctgtttctctccgtgctgttctctcccgctgtgcgcctgcccgcctctcgctgtcctctctccccctcgccctctcttcggcccccccctttcacgttcactctgtctctcccactatctctgcccccctctatccttgatacaacagctgacctcatttcccgataccttttcccccccgaaaagtacaacatctggcccgccccagcccgaagacagcccgtcctccctggacaatcagacgaattctccccccccccccaaaaaaaaaagccatccccccgctctgccccgtcgcacattcggcccccgcgactcggccagagcggcgctggcagaggagtgtccggcaggagggccaacgcccgctgttcggtttgcgacacgcagcagggaggtgggcggcagcgtcgccggcttccagacaccaatgggaatcccaatggggaagtcgatgctggtgcttctcaccttcttggccttcgcctcgtgctgcattgctgcttaccgccccagtgagaccctgtgcggcggggagctggtggacaccctccagttcgtctgtggggaccgcggcttctacttcagcaggcccgcaagccgtgtgagccgtcgcagccgtggcatcgttgaggagtgctgtttccgcagctgtgacctggccctcctggagacgtactgtgctacccccgccaagtccgagagggacgtgtcgacccctccgaccgtgcttccggacaacttccccagataccccgtgggcaagttcttccaatatgacacctggaagcagtccacccagcgcctgcgcaggggcctgcctgccctcctgcgtgcccgccggggtcacgtgctcgccaaggagctcgaggcgttcagggaggccaaacgtcaccgtcccctgattgctctacccacccaagaccccgcccacgggggcgcccccccagagatggccagcaatcggaagtgagcaaaactgccgcaagtctgcagcccggcgccaccatcctgcagcctcctcctgaccacggacgtttccatcaggttccatcccgaaaatctctcggttccacgtccccctggggcttctcctgacccagtccccgtgccccgcctccccgaaacaggctactctcctcggccccctccatcgggctgaggaagcacagcagcatcttcaaacatgtacaaaatcgattggctttaaacacccttcacataccctcccccc

SEQ ID NO: 507 - DNA, 5075 bp, Homo sapiens
  ref <308>: DATABASE ACCESSION NUMBER: NM_000627
  ref <309>: DATABASE ENTRY DATE: 2001-06-18
tgaattcggcacgaggtgggctctctcttttcccctcttgctcctttcttttctttttttctgtttttttaaaccttccaaggcaagttcatggatactaagctgatgtgtttgttgttctttttctccctgcctccgctcctagtgagtaaccacactggccgcatcaaggtggtctttactccgagcatctgtaaagtgacctgcaccaagggcagctgtcagaacagctgtgagaaggggaacaccaccactctcattagtgagaatggtcatgctgccgacaccctgacggccacgaacttccgagtggtaatttgccatcttccatgtatgaatggtggccagtgcagttcaagggacaaatgtcagtgccctccaaatttcacaggaaaactttgtcagatcccagtccatggtgccagcgtgcctaaactttatcagcattcccagcagccaggcaaggcgttggggacgcatgtcatccattcaacacataccttgcctctgaccgtgactagccagcaaggagtcaaagtgaaatttcctcctaacatagtcaatatccatgtgaaacatcctcctgaagcttccgtccagatacatcaggtttcaagaattgatggcccaacaggccagaagacaaaagaagctcaaccaggccaatcccaagtctcgtaccaagggcttcctgtccagaagacccagaccatacattccacatactcccaccagcaggtcattcctcacgtctaccccgtggctgctaagacacagcttggccggtgcttccaggaaaccattgggtcacagtgtggcaaagcgctccctggcctttcaaagcaagaggactgctgtggaactgtgggtacctcctggggctttaacaaatgccagaaatgccccaagaaaccatcttatcatggatacaaccaaatgatggaatgcctaccgggttataagcgggttaacaacaccttttgccaagatattaatgaatgtcagctacaaggtgtatgccctaatggtgagtgtttgaataccatgggcagctatcgatgtacctgcaaaataggatttgggccggatcctaccttttcaagttgtgttcctgatccccctgtgatctcggaagagaaagggccctgttaccgacttgtcagttctggaagacagtgtatgtaccctctgtctgttcacctcaccaagcagctctgctgttgtagtgtgggcaaggctgggccacactgtgagaaatgtccccttccaggcacagctgcttttaaggaaatctgtcctggtggaatgggttatacggtttctggcgttcatagacgcaggccaatccatcaccatgtaggtaaaggacctgtatttgtcaagccaaagaacactcaacctgttgctaaaagtactcatcctccacctctcccagccaaggaagagccagtggaggccctgaccttctcccgggaacacggggccaggagtgcggagccagaagtggcaactgcaccccctgaaaaggaaataccttcattggatcaagagaaaaccaaacttgagcctggtcaaccccagctgtctccaggcatttccgctattcatctgcatccacagtttccagtagtgattgaaaaaacatcacctcctgtgcctgttgaagtagctcctgaagcttctacgtctagtgccagccaagtgattgctcctactcaagtgacagaaatcaatgaatgtactgtgaaccctgatatctgtggagcaggacactgcattaacctaccagtgagatatacctgtatatgctacgagggctacaggttcagtgaacaacagaggaaatgtgtggatattgatgagtgtactcaggtccaacacctctgctcccagggccgctgtgaaaacaccgagggaagtttcttgtgcatttgcccagcaggatttatggccagtgaggagggtactaactgcatagatgttgacgaatgcctgaggccggacgtctgtggggaggggcactgtgtcaatactgtgggggccttccggtgtgaatactgtgacagcgggtaccgcatgactcagagaggccgttgtgaggatattgatgaatgtttgaatccaagcacttgtccagatgagcagtgtgtgaattctcctggatcttaccagtgcgttccctgcacagaaggattccgaggctggaatggacagtgccttgatgtggacgagtgcctggaaccaaacgtctgcgcaaatggtgattgttccaaccttgaaggctcctacatgtgttcatgccacaaaggctatacccggactccggaccacaagcactgtagagatattgatgaatgtcagcaagggaatctatgtgtaaacgggcagtgcaaaaataccgagggctccttcaggtgcacctgtggacaggggtaccagctgtcggcagctaaagaccagtgtgaagacattgatgaatgccagcaccgtcatctctgtgctcatgggcagtgcaggaacactgagggctcttttcaatgtgtgtgtgaccagggttacagagcatctgggcttggagaccactgtgaagatatcaatgaatgcttggaggacaagagtgtttgccagagaggagactgcattaatactgcagggtcctatgattgtacttgtccggatggatttcagctagatgacaataaaacatgtcaagatattaatgaatgtgaacatccagggctctgtggtccgcaaggggagtgcctaaacacagagggttctttccattgtgtctgccagcagggtttctcaatctctgcagatggccgtacgtgtgaagatattgatgaatgtgtaaacaacactgtttgtgacagtcacgggttttgtgacaatacagctggctccttccgctgcctctgttatcagggctttcaagccccacaggatgggcaagggtgtgtggatgtgaatgaatgtgaactgctcagtggggtgtgtggtgaagccttctgtgaaaacgtggaagggtccttcctgtgcgtgtgtgctgatgaaaaccaagagtacagccccatgactgggcagtgccgctcccggacctccacagatttagatgtagatgtagatcaacccaaagaagaaaagaaagaatgctactataatctcaatgacgccagtctctgtgataatgtgttggcccccaatgtcacgaaacaagaatgctgctgtacatcaggcgcgggatggggagataactgcgaaatcttcccctgcccggtcttgggaactgctgagttcactgaaatgtgtcccaaagggaaaggttttgtgcctgctggagaatcatcttctgaagctggtggtgagaactataaagatgcagatgaatgcctactttttggacaagaaatctgcaaaaatggtttctgtttgaacactcggcctgggtatgaatgctactgtaagcaagggacgtactatgatcctgtgaaactgcagtgctttgatatggatgaatgtcaagaccccagtagttgtattgatggccagtgtgttaatacagagggctcttacaactgcttctgtactcaccccatggtcctggatgcgtcagaaaaaagatgtatacgaccggctgagtcaaacgaacaaatagaagaaactgatgtctaccaagatttgtgctgggaacatctgagtgatgaatacgtgtgtagccggcctcttgtgggcaagcagacaacgtacactgagtgctgctgtctgtatggagaggcctggggcatgcagtgtgccctctgccccctgaaggattcagatgactatgctcagctgtgtaacatccccgtgacgggacgccggcagccatatggacgggacgccttggttgacttcagtgaacagtatactccagaagccgatccctacttcatccaagaccgttttctaaatagctttgaggagttacaggctgaggaatgcggcatcctcaatggatgtgaaaatggtcgctgtgtgagggtccaggaaggttacacctgcgattgcttggatgggtatcacttggatactgccaagatgacctgtttcgatgtaaatgaatgcgatgagttgaacaaccggatgtctctctgcaagaatgccaagtgcattaacaccgatggttcctacaagtgtttgtgtctgccaggctacgtgccttctgacaagccaaactactgcactccgttgaataccgccttgaatttagagaaagacagtgacctggagtgaaacagaatctacataacctaagcccatatactctgcactgtgtaaaggaaaagggagaaatgtattatacttgagacattgcacctaccccggaaggctggaaatacagaaacagcatggagttgcaagtcctctgaagacaatgagaggatttaggatgagcccgataggtgtggcagaccaaatggacatttctctaaaaaaccagtatatatagtctgttcatatgtaaaattcaatggaagagaggtggaacagtgctgttattttaaacagaaggttgtattattatgttgttttgttttttttactattgcttgattaaatttggcatttaaatagtggtggaaatatttttatataattttcattttttggttgtgcagttccttggctactgtttttcttttacttcagttttttaaaaatctcaaatgaaaaagtcttcgatacaatattgttaagctgtattataagtattgttacacagggttatgcaattcccggcctggagcatttttgaaattcaaattgtctgtcctgtggagcaggcagtgattttgttccaaaactttgtatacacatttggagaaaagtactttatattttcagtgttttgtctgattttaatgtccgttcttagccaagctgctagcaggtgttaattggatccctttccttcactgaaatggaagagtttataagcttacgttagtattgtaatatgtaaagtaagcccaacaaaaatttttaaaaatttgatgatccccaatatatctaccattgtatgttaaataaat

SEQ ID NO: 508 - DNA, 6030 bp, Homo sapiens
  ref <308>: DATABASE ACCESSION NUMBER: NM_000633
  ref <309>: DATABASE ENTRY DATE: 2001-06-18
gttggcccccgttacttttcctctgggaaatatggcgcacgctgggagaacagggtacgataaccgggagatagtgatgaagtacatccattataagctgtcgcagaggggctacgagtgggatgcgggagatgtgggcgccgcgcccccgggggccgcccccgcgccgggcatcttctcctcgcagcccgggcacacgccccatacagccgcatcccgggacccggtcgccaggacctcgccgctgcagaccccggctgcccccggcgccgccgcggggcctgcgctcagcccggtgccacctgtggtccacctgaccctccgccaggccggcgacgacttctcccgccgctaccgccgcgacttcgccgagatgtccaggcagctgcacctgacgcccttcaccgcgcggggacgctttgccacggtggtggaggagctcttcagggacggggtgaactgggggaggattgtggccttctttgagttcggtggggtcatgtgtgtggagagcgtcaaccgggagatgtcgcccctggtggacaacatcgccctgtggatgactgagtacctgaaccggcacctgcacacctggatccaggataacggaggctgggatgcctttgtggaactgtacggccccagcatgcggcctctgtttgatttctcctggctgtctctgaagactctgctcagtttggccctggtgggagcttgcatcaccctgggtgcctatctgggccacaagtgaagtcaacatgcctgccccaaacaaatatgcaaaaggttcactaaagcagtagaaataatatgcattgtcagtgatgttccatgaaacaaagctgcaggctgtttaagaaaaaataacacacatataaacatcacacacacagacagacacacacacacacaacaattaacagtcttcaggcaaaacgtcgaatcagctatttactgccaaagggaaatatcatttattttttacattattaagaaaaaaagatttatttatttaagacagtcccatcaaaactcctgtctttggaaatccgaccactaattgccaagcaccgcttcgtgtggctccacctggatgttctgtgcctgtaaacatagattcgctttccatgttgttggccggatcaccatctgaagagcagacggatggaaaaaggacctgatcattggggaagctggctttctggctgctggaggctggggagaaggtgttcattcacttgcatttctttgccctgggggctgtgatattaacagagggagggttcctgtggggggaagtccatgcctccctggcctgaagaagagactctttgcatatgactcacatgatgcatacctggtgggaggaaaagagttgggaacttcagatggacctagtacccactgagatttccacgccgaaggacagcgatgggaaaaatgcccttaaatcataggaaagtatttttttaagctaccaattgtgccgagaaaagcattttagcaatttatacaatatcatccagtaccttaagccctgattgtgtatattcatatattttggatacgcaccccccaactcccaatactggctctgtctgagtaagaaacagaatcctctggaacttgaggaagtgaacatttcggtgacttccgcatcaggaaggctagagttacccagagcatcaggccgccacaagtgcctgcttttaggagaccgaagtccgcagaacctgcctgtgtcccagcttggaggcctggtcctggaactgagccggggccctcactggcctcctccagggatgatcaacagggcagtgtggtctccgaatgtctggaagctgatggagctcagaattccactgtcaagaaagagcagtagaggggtgtggctgggcctgtcaccctggggccctccaggtaggcccgttttcacgtggagcatgggagccacgacccttcttaagacatgtatcactgtagagggaaggaacagaggccctgggcccttcctatcagaaggacatggtgaaggctgggaacgtgaggagaggcaatggccacggcccattttggctgtagcacatggcacgttggctgtgtggccttggcccacctgtgagtttaaagcaaggctttaaatgactttggagagggtcacaaatcctaaaagaagcattgaagtgaggtgtcatggattaattgacccctgtctatggaattacatgtaaaacattatcttgtcactgtagtttggttttatttgaaaacctgacaaaaaaaaagttccaggtgtggaatatgggggttatctgtacatcctggggcattaaaaaaaaaatcaatggtggggaactataaagaagtaacaaaagaagtgacatcttcagcaaataaactaggaaatttttttttcttccagtttagaatcagccttgaaacattgatggaataactctgtggcattattgcattatataccatttatctgtattaactttggaatgtactctgttcaatgtttaatgctgtggttgatatttcgaaagctgctttaaaaaaatacatgcatctcagcgtttttttgtttttaattgtatttagttatggcctatacactatttgtgagcaaaggtgatcgttttctgtttgagatttttatctcttgattcttcaaaagcattctgagaaggtgagataagccctgagtctcagctacctaagaaaaacctggatgtcactggccactgaggagctttgtttcaaccaagtcatgtgcatttccacgtcaacagaattgtttattgtgacagttatatctgttgtccctttgaccttgtttcttgaaggtttcctcgtccctgggcaattccgcatttaattcatggtattcaggattacatgcatgtttggttaaacccatgagattcattcagttaaaaatccagatggcaaatgaccagcagattcaaatctatggtggtttgacctttagagagttgctttacgtggcctgtttcaacacagacccacccagagccctcctgccctccttccgcgggggctttctcatggctgtccttcagggtcttcctgaaatgcagtggtgcttacgctccaccaagaaagcaggaaacctgtggtatgaagccagacctccccggcgggcctcagggaacagaatgatcagacctttgaatgattctaatttttaagcaaaatattattttatgaaaggtttacattgtcaaagtgatgaatatggaatatccaatcctgtgctgctatcctgccaaaatcattttaatggagtcagtttgcagtatgctccacgtggtaagatcctccaagctgctttagaagtaacaatgaagaacgtggacgcttttaatataaagcctgttttgtcttctgttgttgttcaaacgggattcacagagtatttgaaaaatgtatatatattaagaggtcacgggggctaattgctggctggctgccttttgctgtggggttttgttacctggttttaataacagtaaatgtgcccagcctcttggccccagaactgtacagtattgtggctgcacttgctctaagagtagttgatgttgcattttccttattgttaaaaacatgttagaagcaatgaatgtatataaaagcctcaactagtcatttttttctcctcttcttttttttcattatatctaattattttgcagttgggcaacagagaaccatccctattttgtattgaagagggattcacatctgcatcttaactgctctttatgaatgaaaaaacagtcctctgtatgtactcctctttacactggccagggtcagagttaaatagagtatatgcactttccaaattggggacaagggctctaaaaaaagccccaaaaggagaagaacatctgagaacctcctcggccctcccagtccctcgctgcacaaatactccgcaagagaggccagaatgacagctgacagggtctatggccatcgggtcgtctccgaagatttggcaggggcagaaaactctggcaggcttaagatttggaataaagtcacagaatcaaggaagcacctcaatttagttcaaacaagacgccaacattctctccacagctcacttacctctctgtgttcagatgtggccttccatttatatgtgatctttgttttattagtaaatgcttatcatctaaagatgtagctctggcccagtgggaaaaattaggaagtgattataaatcgagaggagttataataatcaagattaaatgtaaataatcagggcaatcccaacacatgtctagctttcacctccaggatctattgagtgaacagaattgcaaatagtctctatttgtaattgaacttatcctaaaacaaatagtttataaatgtgaacttaaactctaattaattccaactgtacttttaaggcagtggctgtttttagactttcttatcacttatagttagtaatgtacacctactctatcagagaaaaacaggaaaggctcgaaatacaagccattctaaggaaattagggagtcagttgaaattctattctgatcttattctgtggtgtcttttgcagcccagacaaatgtggttacacactttttaagaaatacaattctacattgtcaagcttatgaaggttccaatcagatctttattgttattcaatttggatctttcagggattttttttttaaattattatgggacaaaggacatttgttggaggggtgggagggaggaacaatttttaaatataaaacattcccaagtttggatcagggagttggaagttttcagaataaccagaactaagggtatgaaggacctgtattggggtcgatgtgatgcctctgcgaagaaccttgtgtgacaaatgagaaacattttgaagtttgtggtacgacctttagattccagagacatcagcatggctcaaagtgcagctccgtttggcagtgcaatggtataaatttcaagctggatatgtctaatgggtatttaaacaataaatgtgcagttttaactaacaggatatttaatgacaaccttctggttggtagggacatctgtttctaaatgtttattatgtacaatacagaaaaaaattttataaaattaagcaatgtgaaactgaattggagagtgataatacaagtcctttagtcttacccagtgaatcattctgttccatgtctttggacaaccatgaccttggacaatcatgaaatatgcatctcactggatgcaaagaaaatcagatggagcatgaatggtactgtaccggttcatctggactgccccagaaaaataacttcaagcaaacatcctatcaacaacaaggttgttctgcataccaagctgagcacagaagatgggaacactggtggaggatggaaaggctcgctcaatcaagaaaattctgagactattaataaataagactgtagtgtagatactgagtaaatccatgcacctaaaccttttggaaaatctgccgtgggccctccagatagctcatttcattaagtttttccctccaaggtagaatttgcaagagtgacagtggattgcatttcttttggggaagctttcttttggtggttttgtttattataccttcttaagttttcaaccaaggtttgcttttgttttgagttactggggttatttttgttttaaataaaaataagtgtacaataagtgtttttgtattgaaagcttttgttatcaagattttcatacttttaccttccatggctctttttaagattgatacttttaagaggtggctgatattctgcaacactgtacacataaaaaatacggtaaggatactttacatggttaaggtaaagtaagtctccagttggccaccattagctataatggcactttgtttgtgttgttggaaaaagtcacattgccattaaactttccttgtctgtctagttaatattgtgaagaaaaataaagtacagtgtgagatactg

SEQ ID NO: 509 - DNA, 1026 bp, Homo sapiens
  ref <308>: DATABASE ACCESSION NUMBER: NM_000636
  ref <309>: DATABASE ENTRY DATE: 2001-06-18
cagcatgttgagccgggcagtgtgcggcaccagcaggcagctgcctccggttttggggtatctgggctccaggcagaagcacagcctccccgacctgccctacgactacggcgccctggaacctcacatcaacgcgcagatcatgcagctgcaccacagcaagcaccacgcggcctacgtgaacaacctgaacgtcaccgaggagaagtaccaggaggcgttggccaagggagatgttacagcccagatagctcttcagcctgcactgaagttcaatggtggtggtcatatcaatcatagcattttctggacaaacctcagccctaacggtggtggagaacccaaaggggagttgctggaagccatcaaactggactttggttcctttgacaagtttaaggagaagctgacggctgcatctgttggtgtccaaggctcaggttggggttggcttggtttcaataaggaacggggacacttacaaattgctgcttgtccaaatcaggatccactgcaaggaacaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctag

SEQ ID NO: 510 - DNA, 1909 bp, Homo sapiens
  ref <308>: DATABASE ACCESSION NUMBER: NM_000639
  ref <309>: DATABASE ENTRY DATE: 2001-06-18
gaggtgtttcccttagctatggaaactctataagagagatccagcttgcctcctcttgagcagtcagcaacagggtcccgtccttgacacctcagcctctacaggactgagaagaagtaaaaccgtttgctggggctggcctgactcaccagctgccatgcagcagcccttcaattacccatatccccagatctactgggtggacagcagtgccagctctccctgggcccctccaggcacagttcttccctgtccaacctctgtgcccagaaggcctggtcaaaggaggccaccaccaccaccgccaccgccaccactaccacctccgccgccgccgccaccactgcctccactaccgctgccacccctgaagaagagagggaaccacagcacaggcctgtgtctccttgtgatgtttttcatggttctggttgccttggtaggattgggcctggggatgtttcagctcttccacctacagaaggagctggcagaactccgagagtctaccagccagatgcacacagcatcatctttggagaagcaaataggccaccccagtccaccccctgaaaaaaaggagctgaggaaagtggcccatttaacaggcaagtccaactcaaggtccatgcctctggaatgggaagacacctatggaattgtcctgctttctggagtgaagtataagaagggtggccttgtgatcaatgaaactgggctgtactttgtatattccaaagtatacttccggggtcaatcttgcaacaacctgcccctgagccacaaggtctacatgaggaactctaagtatccccaggatctggtgatgatggaggggaagatgatgagctactgcactactgggcagatgtgggcccgcagcagctacctgggggcagtgttcaatcttaccagtgctgatcatttatatgtcaacgtatctgagctctctctggtcaattttgaggaatctcagacgtttttcggcttatataagctctaagagaagcactttgggattctttccattatgattctttgttacaggcaccgagaatgttgtattcagtgagggtcttcttacatgcatttgaggtcaagtaagaagacatgaaccaagtggaccttgagaccacagggttcaaaatgtctgtagctcctcaactcacctaatgtttatgagccagacaaatggaggaatatgacggaagaacatagaactctgggctgccatgtgaagagggagaagcatgaaaaagcagctaccaggtgttctacactcatcttagtgcctgagagtatttaggcagattgaaaaggacaccttttaactcacctctcaaggtgggccttgctacctcaagggggactgtctttcagatacatggttgtgacctgaggatttaagggatggaaaaggaagactagaggcttgcataataagctaaagaggctgaaagaggccaatgccccactggcagcatcttcacttctaaatgcatatcctgagccatcggtgaaactaacagataagcaagagagatgttttggggactcatttcattcctaacacagcatgtgtatttccagtgcaattgtaggggtgtgtgtgtgtgtgtgtgtgtgtgtgtgtgtatgactaaagagagaatgtagatattgtgaagtacatattaggaaaatatgggttgcatttggtcaagattttgaatgcttcctgacaatcaactctaatagtgcttaaaaatcattgattgtcagctactaatgatgttttcctataatataataaatatttatgtagatgtgcatttttgtgaaatgaaaacatgtaataaaaagtatatgttaggatacaaaaaaaaaaaaaaaaaaaaaaaaaaaaaaaaaaaaaaaaaaaaaaaaaaaa

SEQ ID NO: 511 - DNA, 2232 bp, Homo sapiens
  ref <308>: DATABASE ACCESSION NUMBER: NM_000647
  ref <309>: DATABASE ENTRY DATE: 2001-06-18
ggattgaacaaggacgcatttccccagtacatccacaacatgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacatcggttattttggcggaatcttcttcatcatcctcctgacaatcgatagatacctggctattgtccatgctgtgtttgctttaaaagccaggacggtcacctttggggtggtgacaagtgtgatcacctggttggtggctgtgtttgcttctgtcccaggaatcatctttactaaatgccagaaagaagattctgtttatgtctgtggcccttattttccacgaggatggaataatttccacacaataatgaggaacattttggggctggtcctgccgctgctcatcatggtcatctgctactcgggaatcctgaaaaccctgcttcggtgtcgaaacgagaagaagaggcatagggcagtgagagtcatcttcaccatcatgattgtttactttctcttctggactccctataacattgtcattctcctgaacaccttccaggaattcttcggcctgagtaactgtgaaagcaccagtcaactggaccaagccacgcaggtgacagagactcttgggatgactcactgctgcatcaatcccatcatctatgccttcgttggggagaagttcagaagcctttttcacatagctcttggctgtaggattgccccactccaaaaaccagtgtgtggaggtccaggagtgagaccaggaaagaatgtgaaagtgactacacaaggactcctcgatggtcgtggaaaaggaaagtcaattggcagagcccctgaagccagtcttcaggacaaagaaggagcctagagacagaaatgacagatctctgctttggaaatcacacgtctggcttcacagatgtgtgattcacagtgtgaatcttggtgtctacgttaccaggcaggaaggctgagaggagagagactccagctgggttggaaaacagtattttccaaactaccttccagttcctcatttttgaatacaggcatagagttcagactttttttaaatagtaaaaataaaattaaagctgaaaactgcaacttgtaaatgtggtaaagagttagtttgagttgctatcatgtcaaacgtgaaaatgctgtattagtcacagagataattctagctttgagcttaagaattttgagcaggtggtatgtttgggagactgctgagtcaacccaatagttgttgattggcaggagttggaagtgtgtgatctgtgggcacattagcctatgtgcatgcagcatctaagtaatgatgtcgtttgaatcacagtatacgctccatcgctgtcatctcagctggatctccattctctcaggcttgctgccaaaagccttttgtgttttgttttgtatcattatgaagtcatgcgtttaatcacattcgagtgtttcagtgcttcgcagatgtccttgatgctcatattgttccctaatttgccagtgggaactcctaaatcaaattggcttctaatcaaagcttttaaaccctattggtaaagaatggaaggtggagaagctccctgaagtaagcaaagactttcctcttagtcgagccaagttaagaatgttcttatgttgcccagtgtgtttctgatctgatgcaagcaagaaacactgggcttctagaaccaggcaacttgggaactagactcccaagctggactatggctctactttcaggccacatggctaaagaaggtttcagaaagaagtggggacagagcagaactttcaccttcatatatttgtatgatcctaatgaatgcataaaatgttaagttgatggtgatgaaatgtaaatactgtttttaacaactatgatttggaaaataaatcaatgctataactatgttgataaaag

SEQ ID NO: 512 - DNA, 2324 bp, Homo sapiens
  ref <308>: DATABASE ACCESSION NUMBER: NM_000655
  ref <309>: DATABASE ENTRY DATE: 2001-06-18
ctccctttgggcaaggacctgagacccttgtgctaagtcaagaggctcaatgggctgcagaagaactagagaaggaccaagcaaagccatgatatttccatggaaatgtcagagcacccagagggacttatggaacatcttcaagttgtgggggtggacaatgctctgttgtgatttcctggcacatcatggaaccgactgctggacttaccattattctgaaaaacccatgaactggcaaagggctagaagattctgccgagacaattacacagatttagttgccatacaaaacaaggcggaaattgagtatctggagaagactctgcctttcagtcgttcttactactggataggaatccggaagataggaggaatatggacgtgggtgggaaccaacaaatctcttactgaagaagcagagaactggggagatggtgagcccaacaacaagaagaacaaggaggactgcgtggagatctatatcaagagaaacaaagatgcaggcaaatggaacgatgacgcctgccacaaactaaaggcagccctctgttacacagcttcttgccagccctggtcatgcagtggccatggagaatgtgtagaaatcatcaataattacacctgcaactgtgatgtggggtactatgggccccagtgtcagtttgtgattcagtgtgagcctttggaggccccagagctgggtaccatggactgtactcaccctttgggaaacttcagcttcagctcacagtgtgccttcagctgctctgaaggaacaaacttaactgggattgaagaaaccacctgtggaccatttggaaactggtcatctccagaaccaacctgtcaagtgattcagtgtgagcctctatcagcaccagatttggggatcatgaactgtagccatcccctggccagcttcagctttacctctgcatgtaccttcatctgctcagaaggaactgagttaattgggaagaagaaaaccatttgtgaatcatctggaatctggtcaaatcctagtccaatatgtcaaaaattggacaaaagtttctcaatgattaaggagggtgattataaccccctcttcattccagtggcagtcatggttactgcattctctgggttggcatttatcatttggctggcaaggagattaaaaaaaggcaagaaatccaagagaagtatgaatgacccatattaaatcgcccttggtgaaagaaaattcttggaatactaaaaatcatgagatcctttaaatccttccatgaaacgttttgtgtggtggcacctcctacgtcaaacatgaagtgtgtttccttcagtgcatctgggaagatttctacctgaccaacagttccttcagcttccatttcgcccctcatttatccctcaacccccagcccacaggtgtttatacagctcagctttttgtcttttctgaggagaaacaaataagaccataaagggaaaggattcatgtggaatataaagatggctgactttgctctttcttgactcttgttttcagtttcaattcagtgctgtacttgatgacagacacttctaaatgaagtgcaaatttgatacatatgtgaatatggactcagttttcttgcagatcaaatttcacgtcgtcttctgtatactgtggaggtacactcttatagaaagttcaaaaagtctacgctctcctttctttctaactccagtgaagtaatggggtcctgctcaagttgaaagagtcctatttgcactgtagcctcgccgtctgtgaattggaccatcctatttaactggcttcagcctccccaccttcttcagccacctctctttttcagttggctgacttccacacctagcatctcatgagtgccaagcaaaaggagagaagagagaaatagcctgcgctgttttttagtttgggggttttgctgtttccttttatgagacccattcctatttcttatagtcaatgtttcttttatcacgatattattagtaagaaaacatcactgaaatgctagctgcaagtgacatctctttgatgtcatatggaagagttaaaacaggtggagaaattccttgattcacaatgaaatgctctcctttcccctgcccccagaccttttatccacttacctagattctacatattctttaaatttcatctcaggcctccctcaaccccaccacttcttttataactagtcctttactaatccaacccatgatgagctcctcttcctggcttcttactgaaaggttaccctgtaacatgcaattttgcatttgaataaagcctgctttttaagtgttaa

SEQ ID NO: 513 - DNA, 873 bp, Homo sapiens
  ref <308>: DATABASE ACCESSION NUMBER: NM_000662
  ref <309>: DATABASE ENTRY DATE: 2001-06-18
atggacattgaagcatatcttgaaagaattggctataagaagtctaggaacaaattggacttggaaacattaactgacattcttcaacaccagatccgagctgttccctttgagaaccttaacatccattgtggggatgccatggacttaggcttagaggccatttttgatcaagttgtgagaagaaatcggggtggatggtgtctccaggtcaatcatcttctgtactgggctctgaccactattggttttgagaccacgatgttgggagggtatgtttacagcactccagccaaaaaatacagcactggcatgattcaccttctcctgcaggtgaccattgatggcaggaactacattgtcgatgctgggtttggacgctcataccagatgtggcagcctctggagttaatttctgggaaggatcagcctcaggtgccttgtgtcttccgtttgacggaagagaatggattctggtatctagaccaaatcagaagggaacagtacattccaaatgaagaatttcttcattctgatctcctagaagacagcaaataccgaaaaatctactcctttactcttaagcctcgaacaattgaagattttgagtctatgaatacatacctgcagacatctccatcatctgtgtttactagtaaatcattttgttccttgcagaccccagatggggttcactgtttggtgggcttcaccctcacccataggagattcaattataaggacaatacagatctaatagagttcaagactctgagtgaggaagaaatagaaaaagtgctgaaaaatatatttaatatttccttgcagagaaagcttgtgcccaaacatggtgatagattttttactatttag

SEQ ID NO: 514 - DNA, 1705 bp, Homo sapiens
  ref <308>: DATABASE ACCESSION NUMBER: NM_000663
  ref <309>: DATABASE ENTRY DATE: 2001-06-18
ggctcactgcatctccggctcctggactcaagcgattctcctgcctcaggctcccaaggtggcagcacgcaaagggtgtccctgtccctcaaggggtcatggcctccatgttgctcgcccagcggctggcctgcagcttccagcacacgtaccgcctgctggtgcctggatccagacacattagtcaagctgcagccaaagtcgacgttgaatttgattatgatgggcctctgatgaagacggaagtcccagggcctagatctcaggagttaatgaaacagctgaatataattcagaatgcagaggctgtgcattttttctgcaattacgaagagagccgaggcaattacctggttgatgtggacggcaaccgaatgctggatctttattcccagatctcctctgttcccataggttacagcgacccggccctcgtgaaactcatccaacagccacaaaatgcgagcatgtttgtcaacagacccgccctcgaaatcctgcctccggagaactttgtggagaagctccggcagtccttgctctcggtggctcccaaagggatgtcccagctcatcaccatggcctgcggctcctgctccaatgaaaacgccttaaagaccatcttcatgtggtaccggagcaaggaaagagggcagaggggattctccaaagaggagctggagacgtgcatgattaaccaggccccctggtgccccgactacagcatcctctccttcatgggttccttccatgggaggaccatgggttgcttagcgaccacgcactctaaagccattcacaagatcgatatcccttcctttgactggcccatcgcaccgttcccacggctgaaataccctctggaagagtttgtgaaagagaaccaacaggaagaggccggctgtctggaagaggttgaggatctgattgtgaaatatcgaaaaaagaagaagacggtggccgggatcatcgtggagcccatccagtccgagggtggagacaaccatgcatccgatgacttctttcggaagctgagagacatcgccaggaagcactgctgcgccttcttggtggacgaggtccagaccggaggaggctgcacgggcaagttctgggcccatgagcactggggcctggatgacccagcagacgtgatgaccttcagcaagaagatgatgactgggggcttcttcctcaaggaggagttcaggcctaatgctccctaccggatcttcaacacgtggctgggggacccgtccaagaacctgttgctggctgaggtcatcaacatcatcaagcgggaggacctgctaaataatgcagcccatgccgggaaggccctgctcacaggactgctggacctccaggcccggtacccccagttcatcagcagggtgagaggacgaggcaccttttgctccttcgatactcccgatgattccatacggaataagctcattttaattgccagaaacaaaggtgtggtgttgggtggctgtggtgacaaatccattcgtttccgtcccacgctggtgttcagggatcaccacgctcacctgttcctcaatattttcagtgacatcttagcagacttcaagtaaagaagccatttccactacagtgagaaagcccggatcccaacagttgtcaaattgattagtttgcctaattcatgttttcacttaaaagtatcagaggtggaatt

SEQ ID NO: 515 - DNA, 1415 bp, Homo sapiens
  ref <308>: DATABASE ACCESSION NUMBER: NM_000666
  ref <309>: DATABASE ENTRY DATE: 2001-06-18
gggcgctgagaggcgagcgtgagcccagcgacaggagagtgagctcaccacgcgcagcgccatgaccagcaagggtcccgaggaggagcacccatcggtgacgctcttccgccagtacctgcgtatccgcactgtccagcccaagcctgactatggagctgctgtggctttctttgaggagacagcccgccagctgggcctgggctgtcagaaagtagaggtggcacctggctatgtggtgaccgtgttgacctggccaggcaccaaccctacactctcctccatcttgctcaactcccacacggatgtggtgcctgtcttcaaggaacattggagtcacgacccctttgaggccttcaaggattctgagggctacatctatgccaggggtgcccaggacatgaagtgcgtcagcatccagtacctggaagctgtgaggaggctgaaggtggagggccaccggttccccagaaccatccacatgacctttgtgcctgatgaggaggttgggggtcaccaaggcatggagctgttcgtgcagcggcctgagttccacgccctgagggcaggctttgccctggatgagggcatagccaatcccactgatgccttcactgtcttttatagtgagcggagtccctggtgggtgcgggttaccagcactgggaggccaggccatgcctcacgcttcatggaggacacagcagcagagaagctgcacaaggttgtaaactccatcctggcattccgggagaaggaatggcagaggctgcagtcaaacccccacctgaaagaggggtccgtgacctccgtgaacctgactaagctagagggtggcgtggcctataacgtgatacctgccaccatgagcgccagctttgacttccgtgtggcaccggatgtggacttcaaggcttttgaggagcagctgcagagctggtgccaggcagctggcgagggggtcaccctagagtttgctcagaagtggatgcacccccaagtgacacctactgatgactcaaacccttggtgggcagcttttagccgggtctgcaaggatatgaacctcactctggagcctgagatcatgcctgctgccactgacaaccgctatatccgcgcggtgggggtcccagctctaggcttctcacccatgaaccgcacacctgtgctgctgcacgaccacgatgaacggctgcatgaggctgtgttcctccgtggggtggacatatatacacgcctgctgcctgcccttgccagtgtgcctgccctgcccagtgacagctgagccctggaactcctaaacctttgcccctggggcttccatcccaaccagtgccaaggacctcctcttcccccttccaaataataaagtctatggacagggctgtctctgaagtactaacacaaggaca

SEQ ID NO: 516 - DNA, 1733 bp, Homo sapiens
  ref <308>: DATABASE ACCESSION NUMBER: NM_000676
  ref <309>: DATABASE ENTRY DATE: 2001-06-18
gggcaatttgttagttatccgccgccaccaagacgcggcacggcgcctggaccggaggggccccgcgcgggcgcgaactttgggctcgggcgagtgggtggtgctccgcccagcccgagacgggcgggcgcgcgggccaatgggtgccgcctcttggccgcggggggccccgacccgtgggtcccggccaccagcgccccagccccgaggctcagaagcggcaggcggaggcgcggtccgggcgctatggccatgcccggcgggtctcacgcggctgcccctcgcccggcgcgccttcggtagggggcgcccggggcccagctggcccggccatgctgctggagacacaggacgcgctgtacgtggcgctggagctggtcatcgccgcgctttcggtggcgggcaacgtgctggtgtgcgccgcggtgggcacggcgaacactctgcagacgcccaccaactacttcctggtgtccctggctgcggccgacgtggccgtggggctcttcgccatcccctttgccatcaccatcagcctgggcttctgcactgacttctacggctgcctcttcctcgcctgcttcgtgctggtgctcacgcagagctccatcttcagccttctggccgtggcagtcgacagatacctggccatctgtgtcccgctcaggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacattaagatcttcctggtggcctgcaggcagcttcagcgcactgagctgatggaccactcgaggaccaccctccagcgggagatccatgcagccaagtcactggccatgattgtggggatttttgccctgtgctggttacctgtgcatgctgttaactgtgtcactcttttccagccagctcagggtaaaaataagcccaagtgggcaatgaatatggccattcttctgtcacatgccaattcagttgtcaatcccattgtctatgcttaccggaaccgagacttccgctacacttttcacaaaattatctccaggtatcttctctgccaagcagatgtcaagagtgggaatggtcaggctggggtacagcctgctctcggtgtgggcctatgatctaggctctcgcctcttccaggagaagatacaaatccacaagaaacaaagaggacacggctggttttcattgtgaaagatagctacacctcacaaggaaatggactgcctctcttgagcacttccctggagctaccacgtatctagctaatatgtatgtgtcagtagtaggctccaaggattgacaaatatatttatgatctattcagctgcttttactgtgtggattatgccaacagcttgaatggattctaacagactcttttgtttttaaaagtctgccttgtttatggtggaaaattactgaaactattttactgtgaaacagtgtgaactattataatgcaaatactttttaacttagaggcaatggaaaaataaaagttgactgtactaaaaatg

SEQ ID NO: 517 - DNA, 2347 bp, Homo sapiens
  ref <308>: DATABASE ACCESSION NUMBER: NM_000685
  ref <309>: DATABASE ENTRY DATE: 2001-06-18
attcggagctgcctcctcgccaatgattccagcgcctgacagccaggaccccaggcagcagcgagtgacaggacgtctggaccggcgcgccgctagcagctctgccgggccgcggcggtgatcgatggggagcggctggagcggacccagcgagtgagggcgcacagccgggacgccgaggcggcgggcgggagacccgcaccagcgcagccggccctcggcgggacgtgacgcagcgcccggggcgcgggtttgatatttgacaaattgatctaaaatggctgggtttttatctgaataactcactgatgccatcccagaaagtcggcaccaggtgtatttgatatagtgtttgcaacaaattcgacccaggtgatcaaaatgattctcaactcttctactgaagatggtattaaaagaatccaagatgattgtcccaaagctggaaggcataattacatatttgtcatgattcctactttatacagtatcatctttgtggtgggaatatttggaaacagcttggtggtgatagtcatttacttttatatgaagctgaagactgtggccagtgtttttcttttgaatttagcactggctgacttatgctttttactgactttgccactatgggctgtctacacagctatggaataccgctggccctttggcaattacctatgtaagattgcttcagccagcgtcagtttcaacctgtacgctagtgtgtttctactcacgtgtctcagcattgatcgatacctggctattgttcacccaatgaagtcccgccttcgacgcacaatgcttgtagccaaagtcacctgcatcatcatttggctgctggcaggcttggccagtttgccagctataatccatcgaaatgtatttttcattgagaacaccaatattacagtttgtgctttccattatgagtcccaaaattcaacccttccgatagggctgggcctgaccaaaaatatactgggtttcctgtttccttttctgatcattcttacaagttatactcttatttggaaggccctaaagaaggcttatgaaattcagaagaacaaaccaagaaatgatgatatttttaagataattatggcaattgtgcttttctttttcttttcctggattccccaccaaatattcacttttctggatgtattgattcaactaggcatcatacgtgactgtagaattgcagatattgtggacacggccatgcctatcaccatttgtatagcttattttaacaattgcctgaatcctcttttttatggctttctggggaaaaaatttaaaagatattttctccagcttctaaaatatattcccccaaaagccaaatcccactcaaacctttcaacaaaaatgagcacgctttcctaccgcccctcagataatgtaagctcatccaccaagaagcctgcaccatgttttgaggttgagtgacatgttcgaaacctgtccataaagtaattttgtgaaagaaggagcaagagaacattcctctgcagcacttcactaccaaatgagcattagctacttttcagaattgaaggagaaaatgcattatgtggactgaaccgacttttctaaagctctgaacaaaagcttttctttccttttgcaacaagacaaagcaaagccacattttgcattagacagatgacggctgctcgaagaacaatgtcagaaactcgatgaatgtgttgatttgagaaattttactgacagaaatgcaatctccctagcctgcttttgtcctgttattttttatttccacataaaggtatttagaatatattaaatcgttagaggagcaacaggagatgagagttccagattgttctgtccagtttccaaagggcagtaaagttttcgtgccggttttcagctattagcaactgtgctacacttgcacctggtactgcacattttgtacaaagatatgctaagcagtagtcgtcaagttgcagatctttttgtgaaattcaacctgtgtcttataggtttacactgccaaaacaatgcccgtaagatggcttatttgtataatggtgttactaaagtcacatataaaagttaaactacttgtaaaggtgctgcactggtcccaagtagtagtgtcctcctagtatattagtttgatttaatatctgagaagtgtatatagtttgtggtaaaaagattatatatcataaagtatgccttcctgtttaaaaaaagtatatattctacacatatatatatatgtatatctatatctctaaactgctgttaattgattaaaatctggcaaagttatatttactttaaaataaaataattttattgc

SEQ ID NO: 518 - DNA, 3442 bp, Homo sapiens
  ref <308>: DATABASE ACCESSION NUMBER: NM_000693
  ref <309>: DATABASE ENTRY DATE: 2001-06-18
agccggtgcgccgcagactagggcgcctcgggccagggagcgcggaggagccatggccaccgctaacggggccgtggaaaacgggcagccggacgggaagccgccggccctgccgcgccccatccgcaacctggaggtcaagttcaccaagatatttatcaacaatgaatggcacgaatccaagagtgggaaaaagtttgctacatgtaacccttcaactcgggagcaaatatgtgaagtggaagaaggagataagcccgacgtggacaaggctgtggaggctgcacaggttgccttccagaggggctcgccatggcgccggctggatgccctgagtcgtgggcggctgctgcaccagctggctgacctggtggagagggaccgcgccaccttggccgccctggagacgatggatacagggaagccatttcttcatgcttttttcatcgacctggagggctgtattagaaccctcagatactttgcagggtgggcagacaaaatccagggcaagaccatccccacagatgacaacgtcgtatgcttcaccaggcatgagcccattggtgtctgtggggccatcactccatggaacttccccctgctgatgctggtgtggaagctggcacccgccctctgctgtgggaacaccatggtcctgaagcctgcggagcagacacctctcaccgccctttatctcggctctctgatcaaagaggccgggttccctccaggagtggtgaacattgtgccaggattcgggcccacagtgggagcagcaatttcttctcaccctcagatcaacaagatcgccttcaccggctccacagaggttggaaaactggttaaagaagctgcgtcccggagcaatctgaagcgggtgacgctggagctgggggggaagaacccctgcatcgtgtgtgcggacgctgacttggacttggcagtggagtgtgcccatcagggagtgttcttcaaccaaggccagtgttgcacggcagcctccagggtgttcgtggaggagcaggtctactctgagtttgtcaggcggagcgtggagtatgccaagaaacggcccgtgggagaccccttcgatgtcaaaacagaacaggggcctcagattgatcaaaagcagttcgacaaaatcttagagctgatcgagagtgggaagaaggaaggggccaagctggaatgcgggggctcagccatggaagacaaggggctcttcatcaaacccactgtcttctcagaagtcacagacaacatgcggattgccaaagaggagattttcgggccagtgcaaccaatactgaagttcaaaagtatcgaagaagtgataaaaagagcgaatagcaccgactatggactcacagcagccgtgttcacaaaaaatctcgacaaagccctgaagttggcttctgccttagagtctggaacggtctggatcaactgctacaacgccctctatgcacaggctccatttggtggctttaaaatgtcaggaaatggcagagaactaggtgaatacgctttggccgaatacacagaagtgaaaactgtcaccatcaaacttggcgacaagaacccctgaaggaaaggcggggctccttcctcaaacatcggacggcggaatgtggcagatgaaatgtgctggaggaaaaaaatgacatttctgaccttcccgggacacattcttctggaggctttacatctactggagttgaatgattgctgttttcctctcactctcctgtttattcaccagactggggatgcctataggttgtctgtgaaatcgcagtcctgcctggggagggagctgttggccatttctgtgtttccctttaaaccagatcctggagacagtgagatactcagggcgttgttaacagggagtggtatttgaagtgtccagcagttgcttgaaatgctttgccgaatctgactccagtaagaatgtgggaaaaccccctgtgtgttctgcaagcagggctcttgcaccagcggtctcctcagggtggacctgcttacagagcaagccacgcctctttccgaggtgaaggtgggaccattccttgggaaaggattcacagtaaggttttttggtttttgttttttgttttcttgtttttaaaaaaaggatttcacagtgagaaagttttggttagtgcataccgtggaagggcgccagggtctttgtggattgcatgttgacattgaccgtgagattcggcttcaaaccaatactgcctttggaatatgacagaatcaatagcccagagagcttagtcaaagacgatatcacggtctaccttaaccaaggcactttcttaagcagaaaatattgttgaggttacctttgctgctaaagatccaatcttctaacgccacaacagcatagcaaatcctaggataattcacctcctcatttgacaaatcagagctgtaattcactttaacaaattacgcatttctatcacgttcactaacagcttatgataagtctgtgtagtcttccttttctccagttctgttacccaatttagattagtaaagcgtacacaactggaaagactgctgtaataacacagccttgttatttttaagtcctattttgatattaatttctgattagttagtaaataacacctggattctatggaggacctcggtcttcatccaagtggcctgagtatttcactggcaggttgtgaatttttcttttcctctttgggaatccaaatgatgatgtgcaatttcatgttttaacttgggaaactgaaagtgttcccatatagcttcaaaaacaaaaacaaatgtgttatccgacggatacttttatggttactaactagtactttcctaattgggaaagtagtgcttaagtttgcaaattaagttggggagggcaataataaaatgagggcccgtaacagaaccagtgtgtgtataacgaaaaccatgtataaaatgggcctatcacccttgtcagagatataaattaccacatttggcttcccttcatcagctaacacttatcacttatactaccaataacttgttaaatcaggatttggcttcatacactgaattttcagtattttatctcaagtagatatagacactaaccttgatagtgatacgttagagggttcctattcttccattgtacgataatgtctttaatatgaaatgctacattatttataattggtagagttattgtatctttttatagttgtaagtacacagaggtggtatatttaaacttctgtaatatactgtatttagaaatggaaatatatatagtgttaggtttcacttcttttaaggtttacccctgtggtgtggtttaaaaatctataggcctgggaattccgatcctagctgcagatcgcatcccacaatgcgagaatgataaaataaaattggatatttgaga

SEQ ID NO: 519 - DNA, 1574 bp, Homo sapiens
  ref <308>: DATABASE ACCESSION NUMBER: NM_000699
  ref <309>: DATABASE ENTRY DATE: 2001-06-18
acttcaaagcaaaatgaagttctttctgttgcttttcaccattgggttctgctgggctcagtattccccaaatacacaacaaggacggacatctattgttcatctgtttgaatggcgatgggttgatattgctcttgaatgtgagcgatatttagctccgaagggatttggaggggttcaggtctctccaccaaatgaaaatgttgcaatttacaaccctttcagaccttggtgggaaagataccaaccagttagctataaattatgcacaagatctggaaatgaagatgaatttagaaacatggtgactagatgtaacaatgttggggttcgtatttatgtggatgctgtaattaatcatatgtgtggtaacgctgtgagtgcaggaacaagcagtacctgtggaagttacttcaaccctggaagtagggactttccagcagtcccatattctggatgggatttcaatgatggtaaatgtaaaactggaagtggagatatcgagaattacaatgatgctactcaggtcagagattgtcgtctgactggtcttcttgatcttgcactggagaaggattacgtgcgttctaagattgccgaatatatgaaccatctcattgacattggtgttgcagggttcagacttgatgcttccaagcacatgtggcctggagacataaaggcaattttggacaaactgcataatctaaacagtaactggttccctgcaggaagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcgtaccttctgacagagcgcttgtctttgtggataaccatgacaatcaacgaggacatggggctggaggagcctctattcttaccttctgggatgctaggctgtacaaaatggcagttggatttatgcttgctcatccttacggatttacacgagtaatgtcaagctaccgttggccaagacagtttcaaaatggaaacgatgttaacgattgggttgggccaccaaataataatggagtaattaaagaagttactattaatccagacactacttgtggcaatgactgggtctgtgaacatcgatggcgccaaataaggaacatggttattttccgcaatgtagtggatggccagccttttacaaattggtatgataatgggagcaaccaagtggcttttgggagaggaaacagaggattcattgttttcaacaatgatgactggtcattttctttaactttgcaaactggtcttcctgctggcacatactgtgatgtcatttctggagataaaattaatggcaattgcacaggcattaaaatttacgtttctgatgatggcaaagctcatttttctattagtaactctgctgaagatccatttattgcaattcatgctgaatctaaattgtaaaatttaaaattaaatgcatgtcctc

SEQ ID NO: 520 - DNA, 1399 bp, Homo sapiens
  ref <308>: DATABASE ACCESSION NUMBER: NM_000700
  ref <309>: DATABASE ENTRY DATE: 2001-06-18
agtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacacttaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagac

SEQ ID NO: 521 - DNA, 1070 bp, Homo sapiens
  ref <308>: DATABASE ACCESSION NUMBER: NM_000712
  ref <309>: DATABASE ENTRY DATE: 2001-06-18
ggggtggcgcccggagctgcacggagagcgtgcccgtcagtgaccgaagaagagaccaagatgaatgcagagcccgagaggaagtttggcgtggtggtggttggtgttggccgagccggctccgtgcggatgagggacttgcggaatccacacccttcctcagcgttcctgaacctgattggcttcgtgtcgagaagggagctcgggagcattgatggagtccagcagatttctttggaggatgctctttccagccaagaggtggaggtcgcctatatctgcagtgagagctccagccatgaggactacatcaggcagttccttaatgctggcaagcacgtccttgtggaataccccatgacactgtcattggcggccgctcaggaactgtgggagctggctgagcagaaaggaaaagtcttgcacgaggagcatgttgaactcttgatggaggaattcgctttcctgaaaaaagaagtggtggggaaagacctgctgaaagggtcgctcctcttcacatctgacccgttggaagaagaccggtttggcttccctgcattcagcggcatctctcgactgacctggctggtctccctctttggggagctttctcttgtgtctgccactttggaagagcgaaaggaagatcagtatatgaaaatgacagtgtgtctggagacagagaagaaaagtccactgtcatggattgaagaaaaaggacctggtctaaaacgaaacagatatttaagcttccatttcaagtctgggtccttggagaatgtgccaaatgtaggagtgaataagaacatatttctgaaagatcaaaatatatttgtccagaaactcttgggccagttctctgagaaggaactggctgctgaaaagaaacgcatcctgcactgcctggggcttgcagaagaaatccagaaatattgctgttcaaggaagtaagaggaggaggtgatgtagcacttccaagatggcaccagcatttggttcttctcaagagttgaccattatctctattcttaaaattaaacatgttggggaaacaaaaaaaaaaaaaaaaa

SEQ ID NO: 522 - DNA, 1258 bp, Homo sapiens
  ref <308>: DATABASE ACCESSION NUMBER: NM_000727
  ref <309>: DATABASE ENTRY DATE: 2001-06-18
cggcttgtcacctgccctaggagacgcagccgccggaccctgcccagggcacccacgcctcggcgaccaccatgtcccagaccaaaatgctgaaggtccgcgtgaccctcttctgcatcctggcaggcatcgtgctggccatgacagccgtggtaaccgaccactgggctgtgctgagcccccacatggagcaccacaacactacctgcgaggcggcccacttcggcctctggcggatttgtaccaagcgcatccccatggacgacagcaagacctgcgggcccatcaccctgcccggggagaagaactgttcctacttcaggcattttaaccccggcgagagctcggagatcttcgaattcaccactcagaaggagtacagcatctcggcagccgccatcgccatcttcagccttggcttcatcatcctgggcagcctctgtgtcctcctgtccctcgggaagaagagggactatctgctgcgacccgcgtccatgttctatgcctttgcaggtctctgcatcctcgtctcggtggaggtcatgcggcagtcggtgaagcgcatgattgacagtgaggacaccgtctggatcgagtactattactcctggtcctttgcctgcgcctgtgccgccttcatcctcctctttctcggcggtctcgccctcctgctgttctccctgcctcgaatgccccggaacccatgggagtcctgcatggatgctgagcccgagcactaaccctctgcggccctagcgaccctcaggcttcttccccaggaagcggggtcttggcctggaaccttccagagaggaggcgggagcaattttagccccaccctgctcccatctgcccccctgcaacagctgcaggctgcttcctctctctgagttcctctgggctgcgcaggctcccctgggaatagagcaagacgtgagtcctaacctggccacagttgggggagcagagccagcaggtggacaggtgtttgcaggggcccaacttcccctggagctcagaggggggcccactgtaccagcctctgataagctgcctccagttgtcctttatgaacattgcagggacaacctgtgtttgccagctgggtgttccgtgtaaatagccagcctgtctctttctcggtgataaaacacacgcgctcctggagcccaggcctccccctccttggcttccaggagcctggaagcatttttaactgggtagaatctgactgtggcttgaaataaaaagctctcag

SEQ ID NO: 523 - DNA, 516 bp, Homo sapiens
  ref <308>: DATABASE ACCESSION NUMBER: NM_000732
  ref <309>: DATABASE ENTRY DATE: 2001-06-18
atggaacatagcacgtttctctctggcctggtactggctacccttctctcgcaagtgagccccttcaagatacctatagaggaacttgaggacagagtgtttgtgaattgcaataccagcatcacatgggtagagggaacggtgggaacactgctctcagacattacaagactggacctgggaaaacgcatcctggacccacgaggaatatataggtgtaatgggacagatatatacaaggacaaagaatctaccgtgcaagttcattatcgaatgtgccagagctgtgtggagctggatccagccaccgtggctggcatcattgtcactgatgtcattgccactctgctccttgctttgggagtcttctgctttgctggacatgagactggaaggctgtctggggctgccgacacacaagctctgttgaggaatgaccaggtctatcagcccctccgagatcgagatgatgctcagtacagccaccttggaggaaactgggctcggaacaagtga

SEQ ID NO: 524 - DNA, 1723 bp, Homo sapiens
  ref <308>: DATABASE ACCESSION NUMBER: NM_000734
  ref <309>: DATABASE ENTRY DATE: 2001-06-18
gggggagtgcgaatttcttggcctgtcggcaggtgctttctcaaaggccccacagtcctccacttcctggggaggtagctgcagaataaaaccagcagagactccttttctcctaaccgtcccggccaccgctgcctcagcctctgcctcccagcctctttctgagggaaaggacaagatgaagtggaaggcgcttttcaccgcggccatcctgcaggcacagttgccgattacagaggcacagagctttggcctgctggatcccaaactctgctacctgctggatggaatcctcttcatctatggtgtcattctcactgccttgttcctgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaacagccaggggatttcaccactcaaaggccagacctgcagacgcccagattatgagacacaggatgaagcatttacaacccggttcactcttctcagccactgaagtattcccctttatgtacaggatgctttggttatatttagctccaaaccttcacacacagactgttgtccctgcactctttaagggagtgtactcccagggcttacggccctgccttgggccctctggtttgccggtggtgcaggtagacctgtctcctggcggttcctcgttctccctgggaggcgggcgcactgcctctcacagctgagttgttgagtctgttttgtaaagtccccagagaaagcgcagatgctagcacatgccctaatgtctgtatcactctgtgtctgagtggcttcactcctgctgtaaatttggcttctgttgtcaccttcacctcctttcaaggtaactgtactgggccatgttgtgcctccctggtgagagggccgggcagaggggcagatggaaaggagcctaggccaggtgcaaccagggagctgcaggggcatgggaaggtgggcgggcaggggagggtcagccagggcctgcgagggcagcgggagcctccctgcctcaggcctctgtgccgcaccattgaactgtaccatgtgctacaggggccagaagatgaacagactgaccttgatgagctgtgcacaaagtggcataaaaaacagtgtggttacacagtgtgaataaagtgctgcggagcaagaggaggccgttgattcacttcacgctttcagcgaatgacaaaatcatctttgtgaaggcctcgcaggaagacgcaacacatgggacctataactgcccagcggacagtggcaggacaggaaaaacccgtcaatgtactagggtactgctgcgtcattacagggcacaggccatggatggaaaacgctctctgctctgctttttttctactgttttaatttatactggcatgctattgccttcctattttgcataataaatgcttcagtgaaaatgcagctttactctaa

SEQ ID NO: 525 - DNA, 3050 bp, Homo sapiens
  ref <308>: DATABASE ACCESSION NUMBER: NM_000767
  ref <309>: DATABASE ENTRY DATE: 2001-06-18
cagaccatggaactcagcgtcctcctcttccttgcactcctcacaggactcttgctactcctggttcagcgccaccctaacacccatgaccgcctcccaccagggccccgccctctgccccttttgggaaaccttctgcagatggatagaagaggcctactcaaatcctttctgaggttccgagagaaatatggggacgtcttcacggtacacctgggaccgaggcccgtggtcatgctgtgtggagtagaggccatacgggaggcccttgtggacaaggctgaggccttctctggccggggaaaaatcgccatggtcgacccattcttccggggatatggtgtgatctttgccaatggaaaccgctggaaggtgcttcggcgattctctgtgaccactatgagggacttcgggatgggaaagcggagtgtggaggagcggattcaggaggaggctcagtgtctgatagaggagcttcggaaatccaagggggccctcatggaccccaccttcctcttccagtccattaccgccaacatcatctgctccatcgtctttggaaaacgattccactaccaagatcaagagttcctgaagatgctgaacttgttctaccagactttttcactcatcagctctgtattcggccagctgtttgagctcttctctggcttcttgaaatactttcctggggcacacaggcaagtttacaaaaacctgcaggaaatcaatgcttacattggccacagtgtggagaagcaccgtgaaaccctggaccccagcgcccccaaggacctcatcgacacctacctgctccacatggaaaaagagaaatccaacgcacacagtgaattcagccaccagaacctcaacctcaacacgctctcgctcttctttgctggcactgagaccaccagcaccactctccgctacggcttcctgctcatgctcaaataccctcatgttgcagagagagtctacagggagattgaacaggtgattggcccacatcgccctccagagcttcatgaccgagccaaaatgccatacacagaggcagtcatctatgagattcagagattttccgaccttctccccatgggtgtgccccacattgtcacccaacacaccagcttccgagggtacatcatccccaaggacacagaagtatttctcatcctgagcactgctctccatgacccacactactttgaaaaaccagacgccttcaatcctgaccactttctggatgccaatggggcactgaaaaagactgaagcttttatccccttctccttagggaagcggatttgtcttggtgaaggcatcgcccgtgcggaattgttcctcttcttcaccaccatcctccagaacttctccatggccagccccgtggccccagaagacatcgatctgacaccccaggagtgtggtgtgggcaaaatacccccaacataccagatccgcttcctgccccgctgaaggggctgagggaagggggtcaaaggattccagggtcattcagtgtccccgcctctgtagacaatggctctgactccccgcaacttcctgcctctgagagacctgctacaagccagcttccttcccctccatggcaccagttgtctgaggtcacattgcaagtgagtgcaggagtgagattatcgaaaattataatatacaaaatcatatatatatatatgttcttgttttttgagacagagtctcacactgttgcccaggctggagtgcagtggcgtgatcttggctcactgcaacctccacccccggggatcaagcaactctcctgcctcagcctccctagaggctgggattacaggcatgcactaccacgcttggctaatttttgtatttttagtagagatggggtttcactgtgtaggccaggctggtctcgaactcctgaactcaagtgattcacccaccttagcctcccaaagtgctgggattacaggcgtgagtcaccgtgcccagccatgtatatatataattttaaaaattaagctgaaattcacataacataaaattagccgttttaaagtgtaaaatttagtggcgtgtggttcattcacaaagctgtacaaccaccaccatctagttccaaacattttctttttttctgagatggagtctcactctgtcacccaggttcgagttcagtggtgccatctctgtccactgcaacctccacatcctgggttcaagtgattctcctgcctcagcctctggaggagctggtatcacaggcgtcccccaccacgcctggctaaattttgtatttttaggtggtcttgaactcctgatgtcaggtgattctcctagctccaaatgttttcattatctctcccccaacaaaacccatacctatcaagctgtcactccccataccccattctctttttcatctcggcccctgtcaatctggtttttgtcactatggacttaccaattctgaatatttcccataaacagaatcatacaatatttgatttttttttttttttgaaactaagccttgctctgtctcccaggctggagtgctatggtgcaatttttgttcactgcaacctctgccttccaagatcaagagattctccagtctcagctcccaagtagctgggattacaggcatgtactaccatgcctggctaattttcttgtagttttagtagggacatgttggccaggctggtggtgagctcctggcctcaggtgatccacccacctcagtgttcctaagtgctgatattacaggcataatatgtgatcttttgtgtctggttgctttcatgttgaatgctatttttgaggttcgtgcctgttgtagaccacagtcacacactgctgtagtcttcccgagtcctcattcccagctgcctcttcctactgcttccgtctatcaaaaagcccccttggcccaggttccctgagctgtgggattctgcactggtgctttggattccctgatatgttccttcaaatctgctgagaattaaataaacatctctaaagcctgacctccccacgtc

SEQ ID NO: 526 - DNA, 2059 bp, Homo sapiens
  ref <308>: DATABASE ACCESSION NUMBER: NM_000784
  ref <309>: DATABASE ENTRY DATE: 2001-06-18
gtggatatccccgagtcaccgcgtccctctcctgcagctcccgcgtcgctgggaggagcgagggagcgagcgggaaggggtctagctggcctttgctcggccctccccagcgcccggctttgaacccgccctgcactgctgtctgggcgggtccggggactcagcactcgacccaaaggtgcaggcgcgcgagcacaacccatggctgcgctgggctgcgcgaggctgaggtgggcgctgcgaggggccggccgtggcctctgcccccacggggccagagccaaggccgcgatccctgccgccctcccctcggacaaggccaccggagctcccggagccgggcctggtgtccggcggcggcaacggagcttagaggagattccacgtctaggacagctgcgcttcttctttcagctgttcgttcaaggctatgccctgcaactgcaccagttacaggtgctttacaaggccaagtacggtccaatgtggatgtcctacttagggcctcagatgcacgtgaacctggccagtgccccgctcttggagcaagtgatgcggcaagagggaaagtacccagtacggaacgacatggagctatggaaggagcaccgggaccagcacgacctgacctatgggccgttcaccacggaaggacaccactggtaccagctgcgccaggctctgaaccagcggttgctgaagccagcggaagcagcgctctatacggatgctttcaatgaggtgattgatgactttatgactcgactggaccagctgcgggcagagagtgcttcggggaaccaggtgtcggacatggctcaactcttctactactttgccttggaagctatttgctacatcctgttcgagaaacgcattggctgcctgcagcgatccatccccgaggacaccgtgaccttcgtcagatccatcgggttaatgttccagaactcactctatgccaccttcctccccaagtggactcgccccgtgctgcctttctggaagcgatacctggatggttggaatgccatcttttcctttgggaagaagctgattgatgagaagctcgaagatatggaggcccaactgcaggcagcagggccagatggcatccaggtgtctggctacctgcacttcttactggccagtggacagctcagtcctcgggaggccatgggcagcctgcctgagctgctcatggctggagtggacacgacatccaacacgctgacatgggccctgtaccacctctcaaaggaccctgagatccaggaggccttgcacgaggaagtggtgggtgtggtgccagccgggcaagtgccccagcacaaggactttgcccacatgccgttgctcaaagctgtgcttaaggagactctgcgtctctaccctgtggtccccacaaactcccggatcatagaaaaggaaattgaagttgatggcttcctcttccccaagaacacccagtttgtgttctgccactatgtggtgtcccgggaccccactgccttctctgagcctgaaagcttccagccccaccgctggctgagaaacagccagcctgctacccccaggatccagcacccatttggctctgtgccctttggctatggggtccgggcctgcctgggccgcaggattgcagagctggagatgcagctactcctcgcaaggctgatccagaagtacaaggtggtcctggccccggagacgggggagttgaagagtgtggcccgcattgtcctggttcccaataagaaagtgggcctgcagttcctgcagagacagtgctgagctgagtctccgccttgctggggcttgtcctagaggctccagctctggcacagtggttcctggctgctgccatgtctcagatgaggagggagagaaggaggccgccagactcgagaggtgggaggaactccttgcacacaccctgagcttttgccacttctatcatttttgagcaactccctctcagctaaaaggccacccctttatcgcattgctgtccttgggtagaatataaaataaagggacttttatttcttattgg

SEQ ID NO: 527 - DNA, 2460 bp, Homo sapiens
  ref <308>: DATABASE ACCESSION NUMBER: NM_000788
  ref <309>: DATABASE ENTRY DATE: 2001-06-18
aaagtcaaaccccgacaccgcggcgggccggtgagctcactagctgacccggcaggtcaggatctggcttagcggcgccgcgagctccagtgcgcgcacccgtggccgcctcccagccctctttgccggacgagctctgggccgccacaagactaaggaatggccaccccgcccaagagaagctgcccgtctttctcagccagctctgaggggacccgcatcaagaaaatctccatcgaagggaacatcgctgcagggaagtcaacatttgtgaatatccttaaacaattgtgtgaagattgggaagtggttcctgaacctgttgccagatggtgcaatgttcaaagtactcaagatgaatttgaggaacttacaatgtctcagaaaaatggtgggaatgttcttcagatgatgtatgagaaacctgaacgatggtcttttaccttccaaacatatgcctgtctcagtcgaataagagctcagcttgcctctctgaatggcaagctcaaagatgcagagaaacctgtattattttttgaacgatctgtgtatagtgacaggtatatttttgcatctaatttgtatgaatctgaatgcatgaatgagacagagtggacaatttatcaagactggcatgactggatgaataaccaatttggccaaagccttgaattggatggaatcatttatcttcaagccactccagagacatgcttacatagaatatatttacggggaagaaatgaagagcaaggcattcctcttgaatatttagagaagcttcattataaacatgaaagctggctcctgcataggacactgaaaaccaacttcgattatcttcaagaggtgcctatcttaacactggatgttaatgaagactttaaagacaaatatgaaagtctggttgaaaaggtcaaagagtttttgagtactttgtgatcttgctgaagactacaggcagccaaatggttccagatacttcagctttgtgtatcttcgtaacttcatattaatataagtttctttagaaaacccaagtttttaatcgtttttgttttaaggaaaaaagatttttaaaatgaatcttatgcaaaactttttgatcagtttcttttcttttgttttttttttaaaaaagacatttaaagacaaagacattatttctcatagcaggaaatgtagaggtagatggttccagtatcagcatagtgactaaactacattataaaagatccagcttccttctgtcattcccctcttttgtcttcctcagcaggttggcttttttccctggtgcctctcacttcgttggtgaccagtttcttaaactgaaagctttaatgttacatagtaaatggtagtgtgtcctgtgtaaattagtgtacctattaaaagttgcaaagtggaattaaaggaatccctagaataaggattctgaagttttattttaaattattatcttcttaacagtttagtcccacctcttacttcctgcctcagtctgctttctctactgtctggattaattaggcagcctgctataaagttaaagtcacacatttctattttgcaaacactgtgattactctttgctttgtagtttgctttgctttgtagggttctgcttttaagtttttctctttttcagacaaattactgataaaaatgatattgctctatatgtaatatatcctgaaagcattattttttgttgaataggaaataaaattaatgaagacagaggctagaaagcatccattaattaatgagacacacttaactacttatctctaaaccatctatgtgaatatttgtaaaaataatgaatggactcatcttagttctgtatataaatatattttctttctagtttgtttagttaaggtgtgcagtgtttttcctgtgtattaaacctttccattttacgttttagaaaattttatgtattttaaaataaggggaagagtcattttcacctttaaactactatttttctttccaagtcatttttgtttttggtttcttattcaaagatgataatttagtggattaaccagtccagacgcactgatctttgcaaaggagacttaatttcaaatctgtaattaccatacataaactgtctcattatacgtatgcatttttttagtttgtttttgtttggtataaattaatttgttaattaaatatttcttaagtataaaccttatgaactacagtggagctacactcattgaaatgtaatttcagttctaaaaagatgtaataatcattttagaattaaaatttattctacttttaaataaattatgaatattaaaggtgaaaattgtataaattactttgattccattttaagtggagacatatttcagtgatttttagtaacctttaaaaatgtataatgacttttaaaatttgtagaattgaaaagacgctaataaaaatttattattt

SEQ ID NO: 528 - DNA, 944 bp, Homo sapiens
  ref <308>: DATABASE ACCESSION NUMBER: NM_000802
  ref <309>: DATABASE ENTRY DATE: 2001-06-18
tcaagattaaacgacaaggacagacatggctcagcggatgacaacacagctgctgctccttctagtgtgggtggctgtagtaggggaggctcagacaaggattgcatgggccaggactgagcttctcaatgtctgcatgaacgccaagcaccacaaggaaaagccaggccccgaggacaagttgcatgagcagtgtcgaccctggaggaagaatgcctgctgttctaccaacaccagccaggaagcccataaggatgtttcctacctatatagattcaactggaaccactgtggagagatggcacctgcctgcaaacggcatttcatccaggacacctgcctctacgagtgctcccccaacttggggccctggatccagcaggtggatcagagctggcgcaaagagcgggtactgaacgtgcccctgtgcaaagaggactgtgagcaatggtgggaagattgtcgcacctcctacacctgcaagagcaactggcacaagggctggaactggacttcagggtttaacaagtgcgcagtgggagctgcctgccaacctttccatttctacttccccacacccactgttctgtgcaatgaaatctggactcactcctacaaggtcagcaactacagccgagggagtggccgctgcatccagatgtggttcgacccagcccagggcaaccccaatgaggaggtggcgaggttctatgctgcagccatgagtggggctgggccctgggcagcctggcctttcctgcttagcctggccctaatgctgctgtggctgctcagctgacctccttttaccttctgatacctggaaatccctgccctgttcagccccacagctcccaactatttggttcctgctccatggtcgggcctctgacagccactttgaataaaccagacaccgcacatgtgtcttgagaattatttgg

SEQ ID NO: 529 - DNA, 2106 bp, Homo sapiens
  ref <308>: DATABASE ACCESSION NUMBER: NM_000824
  ref <309>: DATABASE ENTRY DATE: 2001-06-18
gagcctccacgatctcgcccggcgattgtgggcaggggcgcctccggatcgatcttctgaaattcaagttttcaagatgaagtttttattgacaactgcctttttaattttaatttccttgtgggtggaagaagcctattctaaggaaaagtcttcaaagaaagggaaggggaaaaagaagcagtatctatgcccatctcagcagtcagcagaggaccttgcccgagtacctgccaactccactagcaatatcttgaacaggttattggtcagttatgatcccaggataagaccaaacttcaaaggcattcctgttgatgtagtagtcaacatttttattaacagttttggatccattcaagaaacaacaatggactatagagttaacatcttcctgagacaaaaatggaatgaccccaggctgaagctccccagtgattttaggggttcagatgcactgacagtggatccaacaatgtacaagtgtttatggaaacctgatttattttttgcaaatgaaaaaagtgccaattttcatgatgtgacccaggaaaacatcctcctctttatttttcgtgatggagatgtccttgtcagcatgaggttatctattactctttcatgccctttggacttgacattgtttcccatggatacacaacgttgcaagatgcaactggagagctttggttacacaactgatgatttacgatttatctggcagtcaggagatcctgtgcaattagaaaaaattgccttgcctcaatttgatatcaaaaaggaagatattgaatatggtaactgtacaaaatactataaaggcacgggctactacacatgcgtggaagtcatcttcaccctgaggaggcaggtcggcttttacatgatgggggtctacgccccaaccctgctcattgttgttctctcctggctttccttctggatcaacccggacgcgagtgctgccagagtgcccctgggtatcttctcagtcctcagcttggcctctgagtgcacaacccttgccgctgagcttcccaaagtttcctatgtgaaggctcttgatgtttggcttattgcttgccttctctttgggtttgcttccctggtggagtatgcagttgtccaggtgatgctgaacaaccccaaaagggttgaagctgaaaaagccagaattgctaaggctgagcaagcagatggaaaaggtggaaatgtggctaaaaagaatactgtgaatggaacagggactcctgttcatattagcactttgcaggttggtgagaccagatgcaaaaaagtttgtacttctaagtctgatctgagatctaatgacttcagcattgttggaagcttaccaagagattttgaactatccaattatgactgctatggaaaacccattgaagttaacaacggacttgggaaatctcaggctaagaacaacaagaagcctccccctgcgaaacctgttattccaacagcagcaaagcgaattgatctttatgcaagagcattgtttcctttctgcttcttgttcttcaatgttatatattggtctatatatttatgataaatcttttccatttgtacaaaataaaattccatttcattgtgacctactcctttcataaatgccaatctgtgagaacttttgaattttcatagcaacattgcattttggatgccatttgattgtaataaaactgtggcaccttaattttgaatggcagcatgatcatgtaatatctgtgctctaataacgatgtatatatgtatagtgaacatattgcttagtaacaaatgaaggacaagcatactacataatataatccatacaattctcttcagttagtgtaaactgcaaatactacagataattctgataataaaatgatatgcacgctgaatcctgctatggtaccattctaatgtatgtagtatttcaaatttccttccttgtaactttcaaagaaagccatcttattcttgtaaaattttagatggtattatcacagatttaaaaaggttgtattacatattgtttaaactttgtaagtagaaatatatctgttataattatacaggctctgtggagaaataaagttc

SEQ ID NO: 530 - DNA, 1266 bp, Homo sapiens
  ref <308>: DATABASE ACCESSION NUMBER: NM_000849
  ref <309>: DATABASE ENTRY DATE: 2001-06-18
ctcggaagcccgtcaccatgtcgtgcgagtcgtctatggttctcgggtactgggatattcgtgggctggcgcacgccatccgcctgctcctggagttcacggatacctcttatgaggagaaacggtacacgtgcggggaagctcctgactatgatcgaagccaatggctggatgtgaaattcaagctagacctggactttcctaatctgccctacctcctggatgggaagaacaagatcacccagagcaatgccatcttgcgctacatcgctcgcaagcacaacatgtgtggtgagactgaagaagaaaagattcgagtggacatcatagagaaccaagtaatggatttccgcacacaactgataaggctctgttacagctctgaccacgaaaaactgaagcctcagtacttggaagagctacctggacaactgaaacaattctccatgtttctgtggaaattctcatggtttgccggggaaaagctcacctttgtggattttctcacctatgatatcttggatcagaaccgtatatttgaccccaagtgcctggatgagttcccaaacctgaaggctttcatgtgccgttttgaggctttggagaaaatcgctgcctacttacagtctgatcagttctgcaagatgcccatcaacaacaagatggcccagtggggcaacaagcctgtatgctgagcaggaggcagacttgcagagcttgttttgtttcatcctgtccgtaaggggtcagcgctcttgctttgctcttttcaatgaatagcacttatgttactggtgtccagctgagtttctcttgggtataaaggctaaaagggaaaaaggatatgtggagaatcatcaagatatgaattgaatcgctgcgatactgtggcatttccctactccccaactgagttcaagggctgtaggttcatgcccaagccctgagagtgggtactagaaaaaacgagattgcacagttggagagagcaggtgtgttaaatggactggagtccctgtgaagactgggtgaggataacacaagtaaaactgtggtactgatggacttaaccggagttcggaaaccgtcctgtgtacacatgggagtttagtgtgataaaggcagtatttcagactggtgggctagccaatagagttggcaattgcttattgaaactcattaaaaataatagagccccacttgacactattcactaaaattaatctggaatttaaggcccaacattaaacacaaagctgtattgat

SEQ ID NO: 531 - DNA, 737 bp, Homo sapiens
  ref <308>: DATABASE ACCESSION NUMBER: NM_000852
  ref <309>: DATABASE ENTRY DATE: 2001-06-18
ggagtttcgccgccgcagtcttcgccaccatgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacatctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagcgcccggcccaagctcaaggccttcctggcctcccctgagtacgtgaacctccccatcaatggcaacgggaaacagtgagggttggggggactctgagcgggaggcagagtttgccttcctttctccaggaccaataaaatttctaagagagct

SEQ ID NO: 532 - DNA, 1296 bp, Homo sapiens
  ref <308>: DATABASE ACCESSION NUMBER: NM_000874
  ref <309>: DATABASE ENTRY DATE: 2001-06-18
gcttttgtcccccgcccgccgcttctgtccgagaggccgcccgcgaggcgcatcctgaccgcgagcgtcgggtcccagagccgggcgcggctggggcccgaggctagcatctctcgggagccgcaaggcgagagctgcaaagtttaattagacacttcagaattttgatcacctaatgttgatttcagatgtaaaagtcaagagaagactctaaaaatagcaaagatgcttttgagccagaatgccttcatcgtcagatcacttaatttggttctcatggtgtatatcagcctcgtgtttggtatttcatatgattcgcctgattacacagatgaatcttgcactttcaagatatcattgcgaaatttccggtccatcttatcatgggaattaaaaaaccactccattgtaccaactcactatacattgctgtatacaatcatgagtaaaccagaagatttgaaggtggttaagaactgtgcaaataccacaagatcattttgtgacctcacagatgagtggagaagcacacacgaggcctatgtcaccgtcctagaaggattcagcgggaacacaacgttgttcagttgctcacacaatttctggctggccatagacatgtcttttgaaccaccagagtttgagattgttggttttaccaaccacattaatgtgatggtgaaatttccatctattgttgaggaagaattacagtttgatttatctctcgtcattgaagaacagtcagagggaattgttaagaagcataaacccgaaataaaaggaaacatgagtggaaatttcacctatatcattgacaagttaattccaaacacgaactactgtgtatctgtttatttagagcacagtgatgagcaagcagtaataaagtctcccttaaaatgcaccctccttccacctggccaggaatcagaatcagcagaatctgccaaaataggaggaataattactgtgtttttgatagcattggtcttgacaagcaccatagtgacactgaaatggattggttatatatgcttaagaaatagcctccccaaagtcttgaggcaaggtctcactaagggctggaatgcagtggctattcacaggtgcagtcataatgcactacagtctgaaactcctgagctcaaacagtcgtcctgcctaagcttccccagtagctgggattacaagcgtgcatccctgtgccccagtgattaagttttattatgtagaaaataaagagcaaacagttacaaaagaaaaaaaaaaaaaaaaaaaaaaaaaaaaaaaaaa

SEQ ID NO: 533 - DNA, 4034 bp, Homo sapiens
  ref <308>: DATABASE ACCESSION NUMBER: NM_000878
  ref <309>: DATABASE ENTRY DATE: 2001-06-18
gcagccagagctcagcagggccctggagagatggccacggtcccagcaccggggaggactggagagcgcgcgctgccaccgccccatgtctcagccagggcttccttcctcggctccaccctgtggatgtaatggcggcccctgctctgtcctggcgtctgcccctcctcatcctcctcctgcccctggctacctcttgggcatctgcagcggtgaatggcacttcccagttcacatgcttctacaactcgagagccaacatctcctgtgtctggagccaagatggggctctgcaggacacttcctgccaagtccatgcctggccggacagacggcggtggaaccaaacctgtgagctgctccccgtgagtcaagcatcctgggcctgcaacctgatcctcggagccccagattctcagaaactgaccacagttgacatcgtcaccctgagggtgctgtgccgtgagggggtgcgatggagggtgatggccatccaggacttcaagccctttgagaaccttcgcctgatggcccccatctccctccaagttgtccacgtggagacccacagatgcaacataagctgggaaatctcccaagcctcccactactttgaaagacacctggagttcgaggcccggacgctgtccccaggccacacctgggaggaggcccccctgctgactctcaagcagaagcaggaatggatctgcctggagacgctcaccccagacacccagtatgagtttcaggtgcgggtcaagcctctgcaaggcgagttcacgacctggagcccctggagccagcccctggccttcaggacaaagcctgcagcccttgggaaggacaccattccgtggctcggccacctcctcgtgggcctcagcggggcttttggcttcatcatcttagtgtacttgctgatcaactgcaggaacaccgggccatggctgaagaaggtcctgaagtgtaacaccccagacccctcgaagttcttttcccagctgagctcagagcatggaggagacgtccagaagtggctctcttcgcccttcccctcatcgtccttcagccctggcggcctggcacctgagatctcgccactagaagtgctggagagggacaaggtgacgcagctgctcctgcagcaggacaaggtgcctgagcccgcatccttaagcagcaaccactcgctgaccagctgcttcaccaaccagggttacttcttcttccacctcccggatgccttggagatagaggcctgccaggtgtactttacttacgacccctactcagaggaagaccctgatgagggtgtggccggggcacccacagggtcttccccccaacccctgcagcctctgtcaggggaggacgacgcctactgcaccttcccctccagggatgacctgctgctcttctcccccagtctcctcggtggccccagccccccaagcactgcccctgggggcagtggggccggtgaagagaggatgcccccttctttgcaagaaagagtccccagagactgggacccccagcccctggggcctcccaccccaggagtcccagacctggtggattttcagccaccccctgagctggtgctgcgagaggctggggaggaggtccctgacgctggccccagggagggagtcagtttcccctggtccaggcctcctgggcagggggagttcagggcccttaatgctcgcctgcccctgaacactgatgcctacttgtccctccaagaactccagggtcaggacccaactcacttggtgtagacagatggccagggtgggaggcaggcagctgcctgctctgcgccgagcctcagaaggaccctgttgagggtcctcagtccactgctgaggacactcagtgtccagttgcagctggacttctccacccggatggcccccacccagtcctgcacacttggtccatccatttccaaacctccactgctgctcccgggtcctgctgcccgagccaggaactgtgtgtgttgcaggggggcagtaactccccaactccctcgttaatcacaggatcccacgaatttaggctcagaagcatcgctcctctccagccctgcagctattcaccaatatcagtcctcgcggctctccagggctccctgccctgacctcttccctgggttttctgccccagcctcctccttccctcccctccccgtccacagggcagcctgagcgtgctttccaaaacccaaatatggccacgctccccctcggttcaaaaccttgcacaggtcccactgccctcagccccacttctcagcctggtacttgtacctccggtgtcgtgtggggacatccccttctgcaatcctccctaccgtcctcccgagccactcagagctccctcacaccccctctgttgcacatgctattccctggggctgctgtgcgctccccctcatctaggtgacaaacttccctgactcttcaagtgccggttttgcttctcctggagggaagcactgcctcccttaatctgccagaaacttctagcgtcagtgctggagggagaagctgtcagggacccagggcgcctggagaaagaggccctgttactattcctttgggatctctgaggcctcagagtgcttggctgctgtatctttaatgctggggcccaagtaagggcacagatccccccacaaagtggatgcctgctgcatcttcccacagtggcttcacagacccacaagagaagctgatggggagtaaaccctggagtccgaggcccaggcagcagccccgcctagtggtgggccctgatgctgccaggcctgggacctcccactgccccctccactggaggggtctcctctgcagctcagggactggcacactggcctccagaagggcagctccacagggcagggcctcattatttttcactgccccagacacagtgcccaacaccccgtcgtataccctggatgaacgaattaattacctggcaccacctcgtctgggctccctgcgcctgacattcacacagagaggcagagtcccgtgcccattaggtctggcatgccccctcctgcaaggggctcaaccccctaccccgacccctccacgtatctttcctaggcagatcacgttgcaatggctcaaacaacattccaccccagcaggacagtgaccccagtcccagctaactctgacctgggagccctcaggcacctgcacttacaggccttgctcacagctgattgggcacctgaccacacgcccccacaggctctgaccagcagcctatgagggggtttggcaccaagctctgtccaatcaggtaggctgggcctgaactagccaatcagatcaactctgtcttgggcgtttgaactcagggagggaggcccttgggagcaggtgcttgtggacaaggctccacaagcgttgagccttggaaaggtagacaagcgttgagccactaagcagaggaccttgggttcccaatacaaaaatacctactgctgagagggctgctgaccatttggtcaggattcctgttgcctttatatccaaaataaactcccctttcttgaggttgtctgagtcttgggtctatgccttgaaaaaagctgaattattggacagtctcacctcctgccatagggtcctgaatgtttcagaccacaaggggctccacacctttgctgtgtgttctggggcaacctactaatcctctctgcaagtcggtctccttatccccccaaatggaaattgtatttgccttctccactttgggaggctcccacttcttgggagggttacattttttaagtcttaatcatttgtgacatatgtatctatacatccgtatcttttaatgatccgtgtgtaccatctttgtgattatttccttaatattttttctttaagtcagttcattttcgttgaaatacatttataaagaaaaatctttgttactctgtaaatgaaaaaacccattttcgctataaataaaaggtaactgtacaaaataagtacaat

SEQ ID NO: 534 - DNA, 1654 bp, Homo sapiens
  ref <308>: DATABASE ACCESSION NUMBER: NM_000884
  ref <309>: DATABASE ENTRY DATE: 2001-06-18
gaattcgggcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctctgaccaagaaaatcactcttaagaccccactggtttcctctcccatggacacagtcacagaggctgggatggccatagcaatggcgcttacaggcggtattggcttcatccaccacaactgtacacctgaattccaggccaatgaagttcggaaagtgaagaaatatgaacagggattcatcacagaccctgtggtcctcagccccaaggatcgcgtgcgggatgtttttgaggccaaggcccggcatggtttctgcggtatcccaatcacagacacaggccggatggggagccgcttggtgggcatcatctcctccagggacattgattttctcaaagaggaggaacatgactgtttcttggaagagataatgacaaagagggaagacttggtggtagccccccgcagcatcacactgaaggaggcaaatgaaattctgcagcgcagcaagaagggaaagttgcccattgtaaatgaagatgatgagcttgtggccatcattgcccggacagacctgaagaagaatcgggactacccactagcctccaaagatgccaagaaacagctgctgtgtggggcagccattggcactcatgaggatgacaagtataggctggacttgctcgcccaggctggtgtggatgtagtggttttggactcttcccagggaaattccatcttccagatcaatatgatcaagtacatcaaagacaaataccctaatctccaagtcattggaggcaatgtggtcactgctgcccaggccaagaacctcattgatgcaggtgtggatgccctgcgggtgggcatgggaagtggctccatctgcattacgcaggaagtgctggcctgtgggcggccccaagcaacagcagtgtacaaggtgtcagagtatgcacggcgctttggtgttccggtcattgctgatggaggaatccaaaatgtgggtcatattgcgaaagccttggcccttggggcctccacagtcatgatgggctctctcctggctgccaccactgaggcccctggtgaatacttcttttccgatgggatccggctaaagaaatatcgcggtatgggttctctcgatgccatggacaagcacctcagcagccagaacagatatttcagtgaagctgacaaaatcaaagtggcccagggagtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcctcggtttttttttcaataaaagtttagaaagacccgaattc

SEQ ID NO: 535 - DNA, 2397 bp, Homo sapiens
  ref <308>: DATABASE ACCESSION NUMBER: NM_000888
  ref <309>: DATABASE ENTRY DATE: 2001-06-18
gcaagaactgaaacgaatggggattgaactgctttgcctgttctttctatttctaggaaggaatgatcacgtacaaggtggctgtgccctgggaggtgcagaaacctgtgaagactgcctgcttattggacctcagtgtgcctggtgtgctcaggagaattttactcatccatctggagttggcgaaaggtgtgataccccagcaaaccttttagctaaaggatgtcaattaaacttcatcgaaaaccctgtctcccaagtagaaatacttaaaaataagcctctcagtgtaggcagacagaaaaatagttctgacattgttcagattgcgcctcaaagcttgatccttaagttgagaccaggtggtgcgcagactctgcaggtgcatgtccgccagactgaggactacccggtggatttgtattacctcatggacctctccgcctccatggatgacgacctcaacacaataaaggagctgggctcccggctttccaaagagatgtctaaattaaccagcaactttagactgggcttcggatcttttgtggaaaaacctgtatcccctttcgtgaaaacaacaccagaagaaattgccaacccttgcagtagtattccatacttctgtttacctacatttggattcaagcacattttgccattgacaaatgatgctgaaagattcaatgaaattgtgaagaatcagaaaatttctgctaatattgacacacccgaaggtggatttgatgcaattatgcaagctgctgtgtgtaaggaaaaaattggctggcggaatgactccctccacctcctggtctttgtgagtgatgctgattctcattttggaatggacagcaaactagcaggcatcgtcattcctaatgacgggctctgtcacttggacagcaagaatgaatactccatgtcaactgtcttggaatatccaacaattggacaactcattgataaactggtacaaaacaacgtgttattgatcttcgctgtaacccaagaacaagttcatttatatgagaattacgcaaaacttattcctggagctacagtaggtctacttcagaaggactccggaaacattctccagctgatcatctcagcttatgaagaactgcggtctgaggtggaactggaagtattaggagacactgaaggactcaacttgtcatttacagccatctgtaacaacggtaccctcttccaacaccaaaagaaatgctctcacatgaaagtgggagacacagcttccttcagcgtgactgtgaatatcccacactgcgagagaagaagcaggcacattatcataaagcctgtggggctgggggatgccctggaattacttgtcagcccagaatgcaactgcgactgtcagaaagaagtggaagtgaacagctccaaatgtcaccacgggaacggctctttccagtgtggggtgtgtgcctgccaccctggccacatggggcctcgctgtgagtgtggcgaggacatgctgagcacagattcctgcaaggaggccccagatcatccctcctgcagcggaaggggtgactgctactgtgggcagtgtatctgccacttgtctccctatggaaacatttatgggccttattgccagtgtgacaatttctcctgcgtgagacacaaagggctgctctgcggaggtaacggcgactgtgactgtggtgaatgtgtgtgcaggagcggctggactggcgagtactgcaactgcaccaccagcacggactcctgcgtctctgaagatggagtgctctgcagcgggcgcggggactgtgtttgtggcaagtgtgtttgcacaaaccctggagcctcaggaccaacctgtgaacgatgtcctacctgtggtgacccctgtaactctaaacggagctgcattgagtgccacctgtcagcagctggccaagcccgagaagaatgtgtggacaagtgcaaactagctggtgcgaccatcagtgaagaagaagatttctcaaaggatggttctgtttcctgctctctgcaaggagaaaatgaatgtcttattacattcctaataactacagataatgaggggaaaaccatcattcacagcatcaatgaaaaagattgtccgaagcctccaaacattcccatgatcatgttaggggtttccctggctattcttctcatcggggttgtcctactgtgcatctggaagctactggtgtcatttcatgatcgtaaagaagttgccaaatttgaagcagaacgatcaaaagccaagtggcaaacgggaaccaatccactctacagaggatccacaagtacttttaaaaatgtaacttataaacacagggaaaaacaaaaggtagacctttccacagattgctagaactactttatgca

SEQ ID NO: 536 - DNA, 2447 bp, Homo sapiens
  ref <308>: DATABASE ACCESSION NUMBER: NM_000903
  ref <309>: DATABASE ENTRY DATE: 2001-06-18
cccggcaaccacgagcccagccaatcagcgccccggactgcaccagagccatggtcggcagaagagcactgatcgtactggctcactcagagaggacctccttcaactatgccatgaaggaggctgctgcagcggctttgaagaagaaaggatgggaggtggtggagtcggacctctatgccatgaacttcaatcccatcatttccagaaaggacatcacaggtaaactgaaggaccctgcgaactttcagtatcctgccgagtctgttctggcttataaagaaggccatctgagcccagatattgtggctgaacaaaagaagctggaagccgcagaccttgtgatattccagttccccctgcagtggtttggagtccctgccattctgaaaggctggtttgagcgagtgttcataggagagtttgcttacacttacgctgccatgtatgacaaaggacccttccggagtaagaaggcagtgctttccatcaccactggtggcagtggctccatgtactctctgcaagggatccacggggacatgaatgtcattctctggccaattcagagtggcattctgcatttctgtggcttccaagtcttagaacctcaactgacatatagcattgggcacactccagcagacgcccgaattcaaatcctggaaggatggaagaaacgcctggagaatatttgggatgagacaccactgtattttgctccaagcagcctctttgacctaaacttccaggcaggattcttaatgaaaaaagaggtacaggatgaggagaaaaacaagaaatttggcctttctgtgggccatcacttgggcaagtccatcccaactgacaaccagatcaaagctagaaaatgagattccttagcctggatttccttctaacatgttatcaaatctgggtatctttccaggcttccctgacttgctttagtttttaagatttgtgtttttctttttccacaaggaataaatgagagggaatcgaccgtattcgtgcatttttggatgcatttttaactgattcttatgattactatcatggcatataaccaaaatccgactgggctcaagaggccacttagggaaagatgtagaaagatgctagaaaaatgttctttaaaggcatctacacaatttaattcctctttttagggtcaaagtttagggtacagttggctaggtatcattcaactctccaatgttctattaatcacctctctgtagtttatggtcagaagggaattgctcagagaaggtaaaagactgaatctacctgcctaagggacttaacttgtttggtagttagccatctaatgcttgtttatgatatttcttgctttcaattacaaagcagttactaatatgcctagcacaagtaccactcttggtcagcttttgttgtttatatacagtacacagataccttgaaaggaagagctaataaatctcttctttgctgcagtcatctactttttttttaattaaaaaaaattttttttgaagcagtcttgctctgttacccaggctggagtgcagtggtgtgatctcggctcactgcaacctctgcctcccaggttccagcaattctcctgcctcagcctccctagtagctgggatgacaggcgcctgccatcatgcctgactaatttttgtatttttagtagagacggcgtttcaccatgttggccaggctggtctcaaactcctgacctcaggtgatccgcctacctcagcctcccaaagtgctgggattacaggcgtgatccaccacacctggcccttgcaatcttctactttaaggtttgcagagataaaccaataaatccacaccgtacatctgcaatatgaattccaagaaaggaaatagtaccttcaatacttaaaaatagtcttccacaaaaaatactttatttctgatctatacaaattttcagaaggttattttctttatcattgctaaactgatgacttaccatgggatggggtccagtcccatgaccttggggtacaattgtaaacctagagttttatcaactttggtgaacagttttggcataatagtcaatttctacttctggaagtcatctcattccactgttggtattatataattcaaggagaatatgataaaacactgccctcttgtggtgcattgaaagaagagatgagaaatgatgaaaaggttgcctgaaaaatgggagacagcctcttacttgccaagaaaatgaagggattggaccgagctggaaaacctcctttaccagatgctgactggcactggtggtttttgctctcgacatatccacaatagctgacggctgggtgtttcagtttgcaaaatattttgttgccttcatcttcactgcaattttgtgtaaatttctcaaagatctaattaaataaataaaattcatttctacagactca

SEQ ID NO: 537 - DNA, 1752 bp, Homo sapiens
  ref <308>: DATABASE ACCESSION NUMBER: NM_000908
  ref <309>: DATABASE ENTRY DATE: 2001-06-18
ggggggcagagggcgagtcggcggcggcgagggcaagctctttcttgcggcacgatgccgtctctgctggtgctcactttctccccgtgcgtactactcggctgggcgttgctggccggcggcaccggtggcggtggcgttggcggcggcggcggtggcgcgggcataggcggcggacgccaggagagagaggcgctgccgccacagaagatcgaggtgctggtgttactgccccaggatgactcgtacttgttttcactcacccgggtgcggccggccatcgagtatgctctgcgcagcgtggagggcaacgggactgggaggcggcttctgccgccgggcactcgcttccaggtggcttacgaggattcagactgtgggaaccgtgcgctcttcagcttggtggaccgcgtggcggcggcgcggggcgccaagccagaccttatcctggggccagtgtgcgagtatgcagcagcgccagtggcccggcttgcatcgcactgggacctgcccatgctgtcggctggggcgctggccgctggcttccagcacaaggactctgagtactcgcacctcacgcgcgtggcgcccgcctacgccaagatgggcgagatgatgctcgccctgttccgccaccaccactggagccgcgctgcactggtctacagcgacgacaagctggagcggaactgctacttcaccctcgagggggtccacgaggtcttccaggaggagggtttgcacacgtccatctacagtttcgacgagaccaaagacttggatctggaagacatcgtgcgcaatatccaggccagtgagagagtggtgatcatgtgtgcgagcagtgacaccatccggagcatcatgctggtggcgcacaggcatggcatgaccagtggagactacgccttcttcaacattgagctcttcaacagctcttcctatggagatggctcatggaagagaggagacaaacacgactttgaagctaagcaagcatactcgtccctccagacagtcactctactgaggacagtgaaacctgagtttgagaagttttccatggaggtgaaaagttcagttgagaaacaagggctcaatatggaggattacgttaacatgtttgttgaaggattccacgatgccatcctcctctacgtcttggctctacatgaagtactcagagctggttacagcaaaaaggatggagggaaaattatacagcagacttggaacagaacatttgaaggtatcgccgggcaggtgtccatagatgccaacggagaccgatatggggatttctctgtgattgccatgactgatgtggaggcgggcacccaggaggttattggtgattattttggaaaagaaggtcgttttgaaatgcggccgaatgtcaaatatccttggggccctttaaaactgagaatagatgaaaaccgaattgtagagcatacaaacagctctccctgcaaatcatgtggcctagaagaatcggcagtgacaggaattgtcgtgggggctttactaggagctggcttgctaatggccttctactttttcaggaagaaatacagaataaccattgagaggcgaacccagcaagaagaaagtaaccttggaaaacatcgggaattacgggaagattccatcagatcccatttttcagtagcttaaaggaagccccccacttttttttttctgcctgagattctttaaggagatagacgggttgaaagacatcaatgaaac

SEQ ID NO: 538 - DNA, 2752 bp, Homo sapiens
  ref <308>: DATABASE ACCESSION NUMBER: NM_000909
  ref <309>: DATABASE ENTRY DATE: 2001-06-18
cattcccacccttccttctttaataagcaggagcgaaaaagacaaattccaaagaggattgttcagttcaagggaatgaagaattcagaataattttggtaaatggattccaatatcgggaataagaataagctgaacagttgacctgctttgaagaaacatactgtccatttgtctaaaataatctataacaaccaaaccaatcaaaatgaattcaacattattttcccaggttgaaaatcattcagtccactctaatttctcagagaagaatgcccagcttctggcttttgaaaatgatgattgtcatctgcccttggccatgatatttaccttagctcttgcttatggagctgtgatcattcttggtgtctctggaaacctggccttgatcataatcatcttgaaacaaaaggagatgagaaatgttaccaacatcctgattgtgaacctttccttctcagacttgcttgttgccatcatgtgtctcccctttacatttgtctacacattaatggaccactgggtctttggtgaggcgatgtgtaagttgaatccttttgtgcaatgtgtttcaatcactgtgtccattttctctctggttctcattgctgtggaacgacatcagctgataatcaaccctcgagggtggagaccaaataatagacatgcttatgtaggtattgctgtgatttgggtccttgctgtggcttcttctttgcctttcctgatctaccaagtaatgactgatgagccgttccaaaatgtaacacttgatgcgtacaaagacaaatacgtgtgctttgatcaatttccatcggactctcataggttgtcttataccactctcctcttggtgctgcagtattttggtccactttgttttatatttatttgctacttcaagatatatatacgcctaaaaaggagaaacaacatgatggacaagatgagagacaataagtacaggtccagtgaaaccaaaagaatcaatatcatgctgctctccattgtggtagcatttgcagtctgctggctccctcttaccatctttaacactgtgtttgattggaatcatcagatcattgctacctgcaaccacaatctgttattcctgctctgccacctcacagcaatgatatccacttgtgtcaaccccatattttatgggttcctgaacaaaaacttccagagagacttgcagttcttcttcaacttttgtgatttccggtctcgggatgatgattatgaaacaatagccatgtccacgatgcacacagatgtttccaaaacttctttgaagcaagcaagcccagtcgcatttaaaaaaatcaacaacaatgatgataatgaaaaaatctgaaactacttatagcctatggtcccggatgacatctgtttaaaaacaagcacaacctgcaacatactttgattacctgttctcccaaggaatggggttgaaatcatttgaaaatgactaagattttcttgtcttgctttttactgcttttgttgtagttgtcataattacatttggaacaaaaggtgtgggctttggggtcttctggaaatagttttgaccagacatctttgaagtgctttttgtgaatttatgcatataatataaagacttttatactgtacttattggaatgaaatttctttaaagtattacgatgcgctgacttcagaagtacctgccatccaatacggtcattagattgggtcatcttgattagattagattagattagattgtcaacagattgggccatccttactttatgataggcatcattttagtgtgttacaatagtaacagtatgcaaaagcagcattcaggagccgaaagatagtcttgaagtcattcagaagtggtttgaggtttctgttttttggtggtttttgtttgttttttttttttttcaccttaagggaggctttcatttcctcccgactgattgtcacttaaatcaaaatttaaaaatgaataaaaagacatacttctcagctgcaaatattatggagaattgggcacccacaggaatgaagagagaaagcagctccccaacttcaaaaccattttggtacctgacaacaagagcattttagagtaattaatttaataaagtaaattagtattgctgcaaatagctaaattatatttatttgaattgatggtcaagagattttccattttttttacagactgttcagtgtttgtcaagcttctggtctaatatgtactcgaaagactttccgcttacaatttgtagaaacacaaatatcgttttccatacagcagtgcctatatagtgactgattttaactttcaatgtccatctttcaaaggaagtaacaccaaggtacaatgttaaaggaatattcactttacctagcagggaaaaatacacaaaaactgcagatacttcatatagcccattttaacttgtataaactgtgtgacttgtggcgtcttataaataatgcactgtaaagattactgaatagttgtgtcatgttaatgtgcctaatttcatgtatcttgtaatcatgattgagcctcagaatcatttggagaaactatattttaaagaacaagacatacttcaatgtattatacagataaagtattacatgtgtttgattttaaaagggcggacattttattaaaatcaatattgtttttgctttttctgaggagtctctttcagtttcattttttctcatcccatgacttccctccgatggt

SEQ ID NO: 539 - DNA, 3014 bp, Homo sapiens
  ref <308>: DATABASE ACCESSION NUMBER: NM_000926
  ref <309>: DATABASE ENTRY DATE: 2001-06-18
ctgaccagcgccgccctcccccgcccccgacccaggaggtggagatccctccggtccagccacattcaacacccactttctcctccctctgcccctatattcccgaaaccccctcctccttcccttttccctcctccctggagacgggggaggagaaaaggggagtccagtcgtcatgactgagctgaaggcaaagggtccccgggctccccacgtggcgggcggcccgccctcccccgaggtcggatccccactgctgtgtcgcccagccgcaggtccgttcccggggagccagacctcggacaccttgcctgaagtttcggccatacctatctccctggacgggctactcttccctcggccctgccagggacaggacccctccgacgaaaagacgcaggaccagcagtcgctgtcggacgtggagggcgcatattccagagctgaagctacaaggggtgctggaggcagcagttctagtcccccagaaaaggacagcggactgctggacagtgtcttggacactctgttggcgccctcaggtcccgggcagagccaacccagccctcccgcctgcgaggtcaccagctcttggtgcctgtttggccccgaacttcccgaagatccaccggctgcccccgccacccagcgggtgttgtccccgctcatgagccggtccgggtgcaaggttggagacagctccgggacggcagctgcccataaagtgctgccccggggcctgtcaccagcccggcagctgctgctcccggcctctgagagccctcactggtccggggccccagtgaagccgtctccgcaggccgctgcggtggaggttgaggaggaggatggctctgagtccgaggagtctgcgggtccgcttctgaagggcaaacctcgggctctgggtggcgcggcggctggaggaggagccgcggctgtcccgccgggggcggcagcaggaggcgtcgccctggtccccaaggaagattcccgcttctcagcgcccagggtcgccctggtggagcaggacgcgccgatggcgcccgggcgctccccgctggccaccacggtgatggatttcatccacgtgcctatcctgcctctcaatcacgccttattggcagcccgcactcggcagctgctggaagacgaaagttacgacggcggggccggggctgccagcgcctttgccccgccgcggagttcaccctgtgcctcgtccaccccggtcgctgtaggcgacttccccgactgcgcgtacccgcccgacgccgagcccaaggacgacgcgtaccctctctatagcgacttccagccgcccgctctaaagataaaggaggaggaggaaggcgcggaggcctccgcgcgctccccgcgttcctaccttgtggccggtgccaaccccgcagccttcccggatttcccgttggggccaccgcccccgctgccgccgcgagcgaccccatccagacccggggaagcggcggtgacggccgcacccgccagtgcctcagtctcgtctgcgtcctcctcggggtcgaccctggagtgcatcctgtacaaagcggagggcgcgccgccccagcagggcccgttcgcgccgccgccctgcaaggcgccgggcgcgagcggctgcctgctcccgcgggacggcctgccctccacctccgcctctgccgccgccgccggggcggcccccgcgctctaccctgcactcggcctcaacgggctcccgcagctcggctaccaggccgccgtgctcaaggagggcctgccgcaggtctacccgccctatctcaactacctgaggccggattcagaagccagccagagcccacaatacagcttcgagtcattacctcagaagatttgtttaatctgtggggatgaagcatcaggctgtcattatggtgtccttacctgtgggagctgtaaggtcttctttaagagggcaatggaagggcagcacaactacttatgtgctggaagaaatgactgcatcgttgataaaatccgcagaaaaaactgcccagcatgtcgccttagaaagtgctgtcaggctggcatggtccttggaggtcgaaaatttaaaaagttcaataaagtcagagttgtgagagcactggatgctgttgctctcccacagccagtgggcgttccaaatgaaagccaagccctaagccagagattcactttttcaccaggtcaagacatacagttgattccaccactgatcaacctgttaatgagcattgaaccagatgtgatctatgcaggacatgacaacacaaaacctgacacctccagttctttgctgacaagtcttaatcaactaggcgagaggcaacttctttcagtagtcaagtggtctaaatcattgccaggttttcgaaacttacatattgatgaccagataactctcattcagtattcttggatgagcttaatggtgtttggtctaggatggagatcctacaaacacgtcagtgggcagatgctgtattttgcacctgatctaatactaaatgaacagcggatgaaagaatcatcattctattcattatgccttaccatgtggcagatcccacaggagtttgtcaagcttcaagttagccaagaagagttcctctgtatgaaagtattgttacttcttaatacaattcctttggaagggctacgaagtcaaacccagtttgaggagatgaggtcaagctacattagagagctcatcaaggcaattggtttgaggcaaaaaggagttgtgtcgagctcacagcgtttctatcaacttacaaaacttcttgataacttgcatgatcttgtcaaacaacttcatctgtactgcttgaatacatttatccagtcccgggcactgagtgttgaatttccagaaatgatgtctgaagttattgctgcacaattacccaagatattggcagggatggtgaaaccccttctctttcataaaaagtgaatgtcatctttttcttttaaagaattaaattttgtgg

SEQ ID NO: 540 - DNA, 2519 bp, Homo sapiens
  ref <308>: DATABASE ACCESSION NUMBER: NM_000930
  ref <309>: DATABASE ENTRY DATE: 2001-06-18
acagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttcc

SEQ ID NO: 541 - DNA, 2461 bp, Homo sapiens
  ref <308>: DATABASE ACCESSION NUMBER: NM_000931
  ref <309>: DATABASE ENTRY DATE: 2001-06-18
ctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtggcattttcccagatacttcccattttggaagatttcaggacttggtctgatttcaggatactctgtcagatgggaagacatgaatgcacactagcctctccaggaatgcctcctccctgggcagaaatggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagcggctcaaagttggggcaggctggctggcccgtcatgttcctcaaaagagcccttgacgtcaagtctccttcccctttccccactccctggctctcagaaggtattccttttgtgtacagtgtgtaaagtgtaaatcctttttctttataaactttagagtagcatcgagagaattgtatcatttgaacaactaggcttcagcaatatttatagcaatccatagttagtttttacttttcgttgccacaaccctgttttatactgtacttaataaattcagatatatttttcacagtttttcc

SEQ ID NO: 542 - DNA, 2306 bp, Homo sapiens
  ref <308>: DATABASE ACCESSION NUMBER: NM_000947
  ref <309>: DATABASE ENTRY DATE: 2001-06-18
ggtttcatatgaactctcccgccacccgggaacagctggctgccaccgtttgtgttttccgagtttgtattcttgcaggtgaccaagatggagttttctggaagaaagcggaggaagctgaggttggcaggtgaccagaggaatgcttcctaccctcattgccttcagttttacttgcagccaccttctgaaaacatatctttaacagaatttgaaaacttggctattgatagagttaaattgttaaaatcagttgaaaatcttggagtgagctatgtgaaaggaactgaacaataccagagtaagttggagagtgagcttcggaagctcaagttttcctacagagagaagctagaagatgaatatgaaccacgaagaagagatcatatttctcattttattttgcggcttgcttattgccagtctgaagaacttagacgctggttcattcaacaagaaatggatctccttcgatttagatttagtattttacccaaggataaaattcaggatttcttaaaggatagccaattgcagtttgaggctataagtgatgaagagaagactcttcgagaacaggagattgttgcctcatcaccaagtttaagtggacttaagttggggttcgagtccatttataagatcccttttgctgatgctctggatttgtttcgaggaaggaaagtctatttggaagatggctttgcttacgtaccacttaaggacattgtggcaatcatcctgaatgaatttagagccaaactgtccaaggctttggcattaacagccaggtccttgcctgctgtgcagtctgatgaaagacttcagcctctgctcaatcacctcagtcattcctacactggccaagattacagtacccagggaaatgttgggaagatttctttagatcagattgatttgctttctaccaaatccttcccaccttgcatgcgtcagttacataaagccttgcgggaaaatcaccatcttcgtcatggaggccgaatgcagtatggcctatttctgaagggcattggtttaactttggaacaggcattgcagttctggaagcaagaatttatcaaaggaaagatggatccagacaagtttgataaaggttactcttacaacatccgtcacagctttggaaaggaaggcaagaggacagactatacacctttcagttgcctgaagattattctgtccaatccaccaagccaaggggattatcatgggtgcccattccgtcacagtgatccagagctgctgaagcaaaagttgcagtcatacaagatctctcctggagggataagccagattttggatttagtaaaggggacacattaccaggtagcctgtcaaaaatactttgagatgatacacaatgtggatgattgtggcttttctttgaatcatcctaatcagttcttttgtgagagccaacgtattctaaatggtggtaaagacataaagaaggaacctatccaaccagaaactcctcaacccaaaccaagtgtccagaaaaccaaggatgcatcatctgctctggcctctttaaattcctctctggaaatggatatggaaggactagaagattactttagtgaagattcttaggcagttttataaccctttttcctcaatagcctgtttcctgtttttaagattttgcctttgttgttgaaaaagggtttcactgtcaccaaggcttagtgcagtgacacaattacagctgattgcagccttgaccttcccagctcaagtgatcctcctacctcagcctcccaagtagttaggacacacaggtgtgcacctcatatccagataatttttttcaatttttttttgtagaggtggggggtctccctatgttgcccaggcagatctcagactcctgggctcaagcgatcctcacacctcagcgtcccagagtgctgggattacagttgtgagccactgtgcctggcctttttttttttttaaccttttcgtttaacttctctcttcactgcatcccaatccatctacaggcatgcacacttattaggaaaggaggtttgaggtaacaacagagactttcactatattttgctttgacagaaggaaagaggaggagtttctattaaaatctgtcacttgagtgatgtcatttaagtcctattttaggagataaaaacagctttggggactggttaaagtcccccagaaactacaataaagaacaacttttgttttaactcttaatcactttgtaattttgactcaatccttttctggaccatttttgttaataaatatcaaagtgt

SEQ ID NO: 543 - DNA, 2723 bp, Homo sapiens
  ref <308>: DATABASE ACCESSION NUMBER: NM_000949
  ref <309>: DATABASE ENTRY DATE: 2001-06-18
ggaggctgaaatccccagacgccggttttctgggctgggctttctgcttactcactccttctccctctttctggattttaccgaccgttcgcgaaacagctttccacacaatggagcttcatgtcctcgtgcaggaagtactcatcgactgatgtggcagactttgctccctgacaaaactaaagaactctcctattcatggaggcgaacactgaggatgctttccacatgaaccctgaagtgaacttctgatacatttcctgcagcaagagaaggcagccaacatgaaggaaaatgtggcatctgcaaccgttttcactctgctactttttctcaacacctgccttctgaatggacagttacctcctggaaaacctgagatctttaaatgtcgttctcccaataaggaaacattcacctgctggtggaggcctgggacagatggaggacttcctaccaattattcactgacttaccacagggaaggagagacactcatgcatgaatgtccagactacataaccggtggccccaactcctgccactttggcaagcagtacacctccatgtggaggacatacatcatgatggtcaatgccactaaccagatgggaagcagtttctcggatgaactttatgtggacgtgacttacatagttcagccagaccctcctttggagctggctgtggaagtaaaacagccagaagacagaaaaccctacctgtggattaaatggtctccacctaccctgattgacttaaaaactggttggttcacgctcctgtatgaaattcgattaaaacccgagaaagcagctgagtgggagatccattttgctgggcagcaaacagagtttaagattctcagcctacatccaggacagaaataccttgtccaggttcgctgcaaaccagaccatggatactggagtgcatggagtccagcgaccttcattcagatacctagtgacttcaccatgaatgatacaaccgtgtggatctctgtggctgtcctttctgctgtcatctgtttgattattgtctgggcagtggctttgaagggctatagcatggtgacctgcatctttccgccagttcctgggccaaaaataaaaggatttgatgctcatctgttggagaagggcaagtctgaagaactactgagtgccttgggatgccaagactttcctcccacttctgactatgaggacttgctggtggagtatttagaagtagatgatagtgaggaccagcatctaatgtcagtccattcaaaagaacacccaagtcaaggtatgaaacccacatacctggatcctgacactgactcaggccgggggagctgtgacagcccttcccttttgtctgaaaagtgtgaggaaccccaggccaatccctccacattctatgatcctgaggtcattgagaagccagagaatcctgaaacaacccacacctgggacccccagtgcataagcatggaaggcaaaatcccctattttcatgctggtggatccaaatgttcaacatggcccttaccacagcccagccagcacaaccccagatcctcttaccacaatattactgatgtgtgtgagctggctgtgggccctgcaggtgcaccggccactctgttgaatgaagcaggtaaagatgctttaaaatcctctcaaaccattaagtctagagaagagggaaaggcaacccagcagagggaggtagaaagcttccattctgagactgaccaggatacgccctggctgctgccccaggagaaaaccccctttggctccgctaaacccttggattatgtggagattcacaaggtcaacaaagatggtgcattatcattgctaccaaaacagagagagaacagcggcaagcccaagaagcccgggactcctgagaacaataaggagtatgccaaggtgtccggggtcatggataacaacatcctggtgttggtgccagatccacatgctaaaaacgtggcttgctttgaagaatcagccaaagaggccccaccatcacttgaacagaatcaagctgagaaagccctggccaacttcactgcaacatcaagcaagtgcaggctccagctgggtggtttggattacctggatcccgcatgttttacacactcctttcactgatagcttgactaatggaatgattggttaaaatgtgatttttcttcaggtaacactacagagtacgtgaaatgctcaagaatgtagtcagactgacactactaaagctcccagctcctttcatgctccatttttaaccacttgcctctttctccagcagctgattccagaacaaatcattatgtttcctaactgtgatttgtagatttactttttgctgttagttataaaactatgtgttcaatgaaataaaagcacactgcttagtattcttgagggacaatgccaataggtatatcctctggaaaaggctttcatgatttggcatgggacagacggaaatgaaattgtcaaaattgtttaccatagaaagatgacaaaagaaaattttccacataggaaaatgccatgaaaattgcttttgaaaaacaactgcataacctttacactcctcgtccattttattaggattacccaaatataaccatttaaagaaagaatgcattccagaacaaattgtttacataagttcctataccttactgacacattgctgatatgcaagtaagaaat

SEQ ID NO: 544 - DNA, 4490 bp, Homo sapiens
  ref <308>: DATABASE ACCESSION NUMBER: NM_000950
  ref <309>: DATABASE ENTRY DATE: 2001-06-18
cacgcgtccgcgagtagcggagcgggacccgctgatgctcaccccatttagagaaagaaatccacctccccaaccccaatcaagaacctgctattgtatatcatcatagagccagattacctagggaatcatcatccagggacgtgccagaaaccacaagaaaacatggggagggttttcctcacgggagaaaaagccaattccatattaaaacgctacccaagagctaatgggttttttgaagaaataagacagggcaacattgagcgtgagtgcaaagaagaattctgtacatttgaagaagcaagagaagcttttgaaaataatgaaaaaactaaggagttttggagcacctacacaaaagcgcaacaaggggagagtaaccgaggaagtgactggtttcagttttaccttacctttccgttaatctttggcctcttcattatcctccttgtcattttcctaatctggagatgcttcctaagaaacaaaactcgtagacagacagtgactgaaggccacattcctttccctcagcaccttaatattatcaccccaccccccccaccagatgaagtgtttgacagcagtggattgtctccaggctttctgggatatgtagttgggcgctcagattccgtctctactcgcctgtccaattgtgatcccccgccaacctatgaggaagccactggccaagtgaacctgcagaggagtgaaacagaacctcatttagacccacccccagagtatgaggacatagtcaactccaactcagccagtgccattcctatggtgcctgtggtcaccaccatcaaatgaagctgcaaacttctttttactctaatcatttttaaaatactaatggaagaactttctagcactttaccactacataaatgttcattgacttattttattggactcttaccgcataccacttcacacttgttttattttctttagttttgtttcttgttatagaatcattatccatgctcatttttgctaggggaaatatatgaagagggaaaacatactaatgggggtctttctgtgatgtgatgagacatacatgtaagtgtatatatgtgtgtataggcatatatacgtgtgtatgcatcaacacagtatatgtaaaactgtcttaaaaatccattaacttctacctaaatcacctggaaggagagcattactcaccaaaattgcaaaacaagggtatcaagaatttgtgtaatagccagtgacatgctgtagatttttgcaaactggatgtacttagcatgttttctaattctgactggcttttgttaacttgataattcttcatctaccttaaaaagaaaaaaattacacatagtcattcttgatgttataaatagagaaaaagtgtgtgtgagcaataatgcataagctactgataacttgcttacagcagatagcaataaggtatttggtggcattcggcttgttttgtaatagggattttttttttggttgaccactcccccacacttccaaaattaaacagtgttttcttagcatcttgaatatctcctgcggtgtatattaacatcttgatgagacagatttccaggcaacaaaataatttctaaaatggatatatgtgtggattaatgacaggcagtaaatacccattactcctttactcatagctggtaaaattattcccactgttttattgccttttactgtacgttctacactctgtcctactcccacagaattttcaagcccttaagagtttagttaaaataaaatttttgaaattattgtcttaatatttttatataggctgatgtctttgcctcaagattgttaggaggtaattttccattgaattatcaactgtgatttttatattgccctccaagtggtagaagaagattgcaaagtccatgttatgctaggtgcacaataaatctagtaatagccccacacagatctcatcattgttgctacttccttttgtattttcatcaggtatttttttaactgtagggtttttacttttttcttggagcagagagaacaggctgtaaatgggttgccaacataagctggctgagaaataaaagaaaacaagacagttgttcataaagtttcattttgtatgcactgatggcaaattcattaggtcagttaagggaaatatttgtaccacttccaaacttttcagcgttggataaaatgattgatgaggcaggcagaaggaatgtaggtttcaggtgtgtcatttcctgctgcttccagctccatccctacagactcctccccgagtcctgccctggaaccaaaggaaggaggaacactgaggggaatcctgaagtaggagtcagatgacctgaactcagatctccctctatcacatgcttgccaccactgtaccttgagcaagaatcatatctgaccctcaacctcctcaactctaaaatggggataacatcatttgtcctgcacttctctaagggctttacaaggatcaaataagatggtgtgtatgtaagaaatttgtaaaatgtgaagagctatctacactaagttcgtaatgttattattattgtgcttcatggagaattttcccctctgttttcctaaattgtatgagagctttcacacagtgagaaatagagcaggctgccccataaatgggtaacatattcctaatctgagtgtgtgggctgttagagaacccctgccatgctctggtctgttctgaaactgtgccaactgaaagatgatagtccacacagcacaaacaggtttaagcaaatgatagaaagggaagtaaggcgtgtgtgctagttaataggtttagtagcttttatggactaaaaatgattgattgtatcttgaccctggtctcagaaatgacatttttacttttgccatgagtacacatcagatatctttggcttctatttaaagctaaaggtagaagtgtttgatccagtgaactgtgtatgtatgtgtggggtttttttctttatttttaaatgaaaattaagacaccttttgtgtggacatgtttttgtctttaatgtcaggctttagattagaccagcagttttcaaagtatggccaatggacccctgggttccttgagagcctttcaggggggactatgagatcaaaatatttttattataatgtgaagacattgtcttttcactctatctcaaaaaaagtgttgcaaatgtaaaacattgccatcttctcacaaatctctttttttgtttttgaaaatatggccatttttcataaaatgttatttgtgttagcatgtaatgggtttactatgtttaaataagttaatactttaaaaattttcaggtttttttagtatggtgaatattgatagatataaacctcatgaacaaaagtactttggcatccagattctcaataaatgttaagagcgtaagtgtaagggggtccagagaccaaaagttttagagctacaggattagacataggagcaggatattctgttagtgtgatttcttgcaactttattttatattttaaactgctgatattggatataatgctgctttttagagacacctaaattgcagtatcagaatgaatgttgatgtttgaagccaaaaagccaaatgcttaaactgatcaatgactgtagctttttagactgttggtcaaagaacattctacttcacagtaatagctctatcagccacagatctcatggtggctgttgcatgataatgataggataaacaaaataccactgtcttcaagaaacattatcttaggtttgtttgtttggtttgagtttgatttggcttttatattttttaaaatcccttttgctaccccatctggttttataaactgagtttcttagcattcgttaaaattaaggggtttgtttggaataatatatattttttatgcttttgtctttcttacctgattgatattacattcacctttgattgttttttaaaagtttatttttacagaatatatttagtacctttcttaaggagtaactgaattgaatcaaccagtttgcatttaaataaaagaacaggctcagtggtcttcctgtagaatggtttacatgcctgcatgtgcagtagttgtgtctggaatcctagaattggcactttctgcctccttgctctaaatgtcacaaaaaattatacttccttaaagtaaatgtaatgatttcttcttttcctattgaccagtacagatagatatgttgtgtttgcttcatttttaatgatgacttcaagattgatgatgtgatccaataactgtggaggtagctttaacttggttctgtgtaaatagtatgtattttattataatatttctcattttaagatgcttggtttacattaaattatggtatttaactatttttatgtttatactaggtagggtctttcttatgtttctgtgtttttggtatgctaaataaagctatttttaaaccc

SEQ ID NO: 545 - DNA, 647 bp, Homo sapiens
  ref <308>: DATABASE ACCESSION NUMBER: NM_000954
  ref <309>: DATABASE ENTRY DATE: 2001-06-18
gctcctcctgcacacctccctcgctctcccacaccactgcaccaggccccggacacccgctctgctgcaggagaatggctactcatcacacgctgtggatgggactggccctgctgggggtgctgggcgacctgcaggcagcaccggaggcccaggtctccgtgcagcccaacttccagcaggacaagttcctggggcgctggttcagcgcgggcctcgcctccaactcgagctggctccgggagaagaaggcggcgttgtccatgtgcaagtctgtggtggcccctgccacggatggtggcctcaacctgacctccaccttcctcaggaaaaaccagtgtgagacccgaaccatgctgctgcagcccgcggggtccctcggctcctacagctaccggagtccccactggggcagcacctactccgtgtcagtggtggagaccgactacgaccagtacgcgctgctgtacagccagggcagcaagggccctggcgaggacttccgcatggccaccctctacagccgaacccagacccccagggctgagttaaaggagaaattcaccgccttctgcaaggcccagggcttcacagaggataccattgtcttcctgccccaaaccgataagtgcatgacggaacaatag

SEQ ID NO: 546 - DNA, 2907 bp, Homo sapiens
  ref <308>: DATABASE ACCESSION NUMBER: NM_000964
  ref <309>: DATABASE ENTRY DATE: 2001-06-18
gccatctgggcccaggccccatgccccgaggaggggtggtctgaagcccaccagagccccctgccagactgtctgcctcccttctgactgtggccgcttggcatggccagcaacagcagctcctgcccgacacctgggggcgggcacctcaatgggtacccggtgcctccctacgccttcttcttcccccctatgctgggtggactctccccgccaggcgctctgaccactctccagcaccagcttccagttagtggatatagcacaccatccccagccaccattgagacccagagcagcagttctgaagagatagtgcccagccctccctcgccaccccctctaccccgcatctacaagccttgctttgtctgtcaggacaagtcctcaggctaccactatggggtcagcgcctgtgagggctgcaagggcttcttccgccgcagcatccagaagaacatggtgtacacgtgtcaccgggacaagaactgcatcatcaacaaggtgacccggaaccgctgccagtactgccgactgcagaagtgctttgaagtgggcatgtccaaggagtctgtgagaaacgaccgaaacaagaagaagaaggaggtgcccaagcccgagtgctctgagagctacacgctgacgccggaggtgggggagctcattgagaaggtgcgcaaagcgcaccaggaaaccttccctgccctctgccagctgggcaaatacactacgaacaacagctcagaacaacgtgtctctctggacattgacctctgggacaagttcagtgaactctccaccaagtgcatcattaagactgtggagttcgccaagcagctgcccggcttcaccaccctcaccatcgccgaccagatcaccctcctcaaggctgcctgcctggacatcctgatcctgcggatctgcacgcggtacacgcccgagcaggacaccatgaccttctcggacgggctgaccctgaaccggacccagatgcacaacgctggcttcggccccctcaccgacctggtctttgccttcgccaaccagctgctgcccctggagatggatgatgcggagacggggctgctcagcgccatctgcctcatctgcggagaccgccaggacctggagcagccggaccgggtggacatgctgcaggagccgctgctggaggcgctaaaggtctacgtgcggaagcggaggcccagccgcccccacatgttccccaagatgctaatgaagattactgacctgcgaagcatcagcgccaagggggctgagcgggtgatcacgctgaagatggagatcccgggctccatgccgcctctcatccaggaaatgttggagaactcagagggcctggacactctgagcggacagccggggggtggggggcgggacgggggtggcctggcccccccgccaggcagctgtagccccagcctcagccccagctccaacagaagcagcccggccacccactccccgtgaccgcccacgccacatggacacagccctcgccctccgccccggcttttctctgcctttctaccgaccatgtgaccccgcaccagccctgcccccacctgccctcccgggcagtactggggaccttccctgggggacggggagggaggaggcagcgactccttggacagaggcctgggccctcagtggactgcctgctcccacagcctgggctgacgtcagaggccgaggccaggaactgagtgaggcccctggtcctgggtctcaggatgggtcctgggggcctcgtgttcatcaagacacccctctgcccagctcaccacatcttcatcaccagcaaacgccaggacttggctcccccatcctcagaactcacaagccattgctccccagctggggaacctcaacctcccccctgcctcggttggtgacagagggggtgggacaggggcggggggttccccctgtacataccctgccataccaaccccaggtattaattctcgctggttttgtttttattttaatttttttgttttgatttttttaataagaattttcattttaagcacatttatactgaaggaatttgtgctgtgtattggggggagctggatccagagctggagggggtgggtccgggggagggagtggctcggaaggggcccccactctcctttcatgtccctgtgccccccagttctcctcctcagccttttcctcctcagttttctctttaaaactgtgaagtactaactttccaaggcctgccttcccctccctcccactggagaagccgccagcccctttctccctctgcctgaccactgggtgtggacggtgtggggcagccctgaaaggacaggctcctggccttggcacttgcctgcacccaccatgaggcatggagcagggcagagcaagggccccgggacagagttttcccagacctggctcctcggcagagctgcctcccgtcagggcccacatcatctaggctccccagcccccactgtgaaggggctggccaggggcccgagctgcccccacccccggcctcagccaccagcacccccatagggcccccagacaccacacacatgcgcgtgcgcacacacacaaacacacacacactggacagtagatgggccgacacacacttggcccgagttcctccatttccctggcctgccccccacccccaacctgtcccacccccgtgccccctccttaccccgcaggacgggcctacaggggggtctcccctcacccctgcacccccagctgggggagctggctctgccccgacctccttcaccaggggttggggccccttcccctggagcccgtgggtgcacctgttactgttgggctttccactgagatctactggataaagaataaagttctatttattct

SEQ ID NO: 547 - DNA, 987 bp, Homo sapiens
  ref <308>: DATABASE ACCESSION NUMBER: NM_000969
  ref <309>: DATABASE ENTRY DATE: 2001-06-18
gagcagcggacgccggtctctgttccgcagatggggtttgttaaagttgttaagaataaggcctactttaagagataccaagtgaaatttagaagacgacgagagggtaaaactgattattatgctcggaaacgcttggtgatacaagataaaaataaatacaacacacccaaatacaggatgatagttcgtgtgacaaacagagatatcatttgtcagattgcttatgcccgtatagagggggatatgatagtctgcgcacgttatgcacacgaactgccaaaatatggtgtgaaggttggcctgacaaattatgctgcagcatattgtactggcctgctgctggcccgcaggcttctcaataggtttggcatggacaagatctatgaaggccaagtggaggtgactggtgatgaatacaatgtggaaagcattgatggtcagccaggtgccttcacctgctatttggatgcaggccttgccagaactaccactggcaataaagtttttggtgccctgaagggagctgtggatggaggcttgtctatccctcacagtaccaaacgattccctggttatgattctgaaagcaaggaatttaatgcagaagtacatcggaagcacatcatgggccagaatgttgcagattacatgcgctacttaatggaagaagatgaagatgcttacaagaaacagttctctcaatacataaagaacagcgtaactccagacatgatggaggagatgtataagaaagctcatgctgctatacgagagaatccagtctatgaaaagaagcccaagaaagaagttaaaaagaagaggtggaaccgtcccaaaatgtcccttgctcagaagaaggatcgggtagctcaaaagaaggcaagcttcctcagagctcaggagcgggctgctgagagctaaacccagcaattttctatgattttttcagatatagataataaacttatgaacagcaactaaaaa

SEQ ID NO: 548 - DNA, 578 bp, Homo sapiens
  ref <308>: DATABASE ACCESSION NUMBER: NM_000984
  ref <309>: DATABASE ENTRY DATE: 2001-06-18
cggacgcgtgggcttttcacaaaatggcgccgaaagcgaagaaggaagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaaaagcgctcccaggagaaacaagcttgaccactatgctatcatcaattttccgctgaccactgagtctgccatgaagaagatagaagacaacaacacacttgtgttcattgtggatgttaaagccaacaagcaccagattagtcaggctgtgaagaagctgtatgacattgatgtggccaaggtcaacaccctgattcggcctgatggagagaagaaggcatatgttcgactggctcctgattacgatgctttggatgttgccaacaaaattgggatcatctaaactgagtccagctgcctaattctgaatatatatatatatatatcttttcaccataaaaaaaaaaaaaaaaaaaaaaaaaaaaaa

SEQ ID NO: 549 - DNA, 512 bp, Homo sapiens
  ref <308>: DATABASE ACCESSION NUMBER: NM_001003
  ref <309>: DATABASE ENTRY DATE: 2001-06-18
cttttcctcagctgccgccaaggtgctcggtccttccgaggaagctaaggctgcgttggggtgaggccctcacttcatccggcgactagcaccgcgtccggcagcgccagccctacactcgcccgcgccatggcctctgtctccgagctcgcctgcatctactcggccctcattctgcacgacgatgaggtgacagtcacggaggataagatcaatgccctcattaaagcagccggtgtaaatgttgagcctttttggcctggcttgtttgcaaaggccctggccaacgtcaacattgggagcctcatctgcaatgtaggggccggtggacctgctccagcagctggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaacttt

SEQ ID NO: 550 - DNA, 888 bp, Homo sapiens
  ref <308>: DATABASE ACCESSION NUMBER: NM_001007
  ref <309>: DATABASE ENTRY DATE: 2001-06-18
aagacggaggtcctctttccttgcctaacgcagccatggctcgtggtcccaagaagcatctgaagcgggtggcagctccaaagcattggatgctggataaattgaccggtgtgtttgctcctcgtccatccaccggtccccacaagttgagagagtgtctccccctcatcattttcctgaggaacagacttaagtatgccctgacaggagatgaagtaaagaagatttgcatgcagcggttcattaaaatcgatggcaaggtccgaactgatataacctaccctgctggattcatggatgtcatcagcattgacaagacgggagagaatttccgtctgatctatgacaccaagggtcgctttgctgtacatcgtattacacctgaggaggccaagtacaagttgtgcaaagtgagaaagatctttgtgggcacaaaaggaatccctcatctggtgactcatgatgcccgcaccatccgctaccccgatcccctcatcaaggtgaatgataccattcagattgatttggagactggcaagattactgatttcatcaagttcgacactggtaacctgtgtatggtgactggaggtgctaacctaggaagaattggtgtgatcaccaacagagagaggcaccctggatcttttgacgtggttcacgtgaaagatgccaatggcaacagctttgccactcgactttccaacatttttgttattggcaagggcaacaaaccatggatttctcttccccgaggaaagggtatccgcctcaccattgctgaagagagagacaaaagactggcggccaaacagagcagtgggtgaaatgggtccctgggtgacatgtcagatctttgtacgtaattaaaaatattgtggcaggatt

SEQ ID NO: 551 - DNA, 534 bp, Homo sapiens
  ref <308>: DATABASE ACCESSION NUMBER: NM_001016
  ref <309>: DATABASE ENTRY DATE: 2001-06-18
ctttccctgccgccgccgagtcgcgcggaggcggaggcttgggtgcgttcaagattcagcttcacccgtaacccaccgccatggccgaggaaggcattgctgctggaggtgtaatggacgttaatactgctttacaagaggttctgaagactgccctcatccacgatggcctagcacgtggaattcgcgaagctgccaaagccttagacaagcgccaagcccatctttgtgtgcttgcatccaactgtgatgagcctatgtatgtcaagttggtggaggccctttgtgctgaacaccaaatcaacctaattaaggttgatgacaacaagaaactaggagaatgggtaggcctttgtaaaattgacagagaggggaaaccccgtaaagtggttggttgcagttgtgtagtagttaaggactatggcaaggagtctcaggccaaggatgtcattgaagagtatttcaaatgcaagaaatgaagaaataaatctttggctcacaaaaaaaaaaaaaaaaaaaaaaaaaaaaaaaaaa

SEQ ID NO: 552 - DNA, 620 bp, Homo sapiens
  ref <308>: DATABASE ACCESSION NUMBER: NM_001026
  ref <309>: DATABASE ENTRY DATE: 2001-06-18
gggtttatcggaaaatgtgtttattgagatggtttcccactcatcttgactcagagtgcttttagtgctgcttcctcctgaaggaacatccttctgtaagccttgcttttcctccttggctgtctgaagatagatcgccatcatgaacgacaccgtaactatccgcactagaaagttcatgaccaaccgactacttcagaggaaacaaatggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagacatggcctgtatgagaagaaaaagacctcaagaaagcaacgaaaggaacgcaagaacagaatgaagaaagtcagggggactgcaaaggccaatgttggtgctggcaaaaagccgaaggagtaaaggtgctgcaatgatgttagctgtggccactgtggatttttcgcaagaacattaataaactaaaaacttcatgtgt

SEQ ID NO: 553 - DNA, 2222 bp, Homo sapiens
  ref <308>: DATABASE ACCESSION NUMBER: NM_001047
  ref <309>: DATABASE ENTRY DATE: 2001-06-18
gagtcccggcagtgcgggactccggtagccgcccctccggtagccgcccctcctccccccgcgccgccgccctatatgttgcccgccgcggcctctggggcatggagcacgctgcccagccctggcgatggcaacggcgacgggggtggcggaggagcgcctgctggccgcgctcgcctacctgcagtgcgccgtgggctgcgcggtcttcgcgcggaatcgtcagacgaactcagtgtacggccgccacgcgctgcccagccacaggctccgagtgccggcgcgggccgcctgggtggtgcaggagctgccctcgctggccctgccgctctaccagtacgccagcgagtccgccccgcgtctccgcagcgcgcccaactgcatcctcctggccatgttcctcgtccactacgggcatcggtgcttaatttacccgtttctgatgcgaggaggaaagcctatgccactgttggcatgtacaatggcgattatgttctgtacctgtaacggctatttgcaaagcagatacttgagccattgtgcagtgtatgctgatgactgggtaacagatccccgttttctaataggttttggcttgtggttaacaggcatgttgataaacatccattcagatcatatcctaaggaatctcagaaaaccaggagatactggatacaaaataccaaggggaggcttatttgaatacgtaactgcagccaactattttggagaaatcatggagtggtgtggctatgccctggccagctggtctgtccaaggcgcggcttttgctttcttcacgttttgttttttatctggtagagcaaaagagcatcatgagtggtacctccggaaatttgaagagtatccaaagttcagaaaaattataattccatttttgttttaagtgcgtttttcatgaaattatcttcaacttgaagctttccaatggcgcttctctatggactttgtaaataagttatatctttgtaattttcctgctactttatcattttcaagatgtcctctaggaattttttttctagtaattttgcaatctacctaataagtacctaaatacgctgaaatggaggttgaatatcctactgtgtaacaggtcagaatttcaagctctgggtaataactgctgatattttttctaatttcaaatttacctcttttggctatgtcttgccaagtgtgtatgagactagactttacaactgtctttgatggcattttcagaacaataaatgtcacaatcccttctatagccccctacagtgatctcttcaaggtcaactgcagtgttgcttccctccccctatagggctggaatctgtctaggagccctctctcggaggccatagaggctgggggtagccattgtgcagtcatggcccgggggaaacttgccaaccttcgtgtcaggtgctgtgtataagtggagaacttggggatagaggaggaagctcctcgtggcccttccaaggtgaggcaaaggcatctggacttgttccagcccagcccaccgggtgacatcaccgggcagggaggggtgctggtggtggttcatacggagtaagctgctctgcctgtgtgagtggctcctgggccctaaacaggcacctttaggccatgggtcactcaccgtgagccatcaatgtgctctggtctgacatggtttctctctgtcttctagtctagacctagtttttttgttctgttccccacgtatggatatagtagagattgttgtctgtgaaatttctcttttgtagattttgagttttcccttgtagtgtaaagaatgatcactttctgtaacaataacaagaccactttttaagatttatcctgtttgttctttgttgattgaaacataataattgttaaaattctctacagccttctttttcttccatagctaatcttccttctaatagtttttgctttctgttttgctgttgttgctttgcaaagctttcccctcatagcctgtacctgttatcaatataaaataatcttcctgttgaatgcttcatgacttgaattctactttgataaaaacattgccatactgctttttatcttgatgaattcatctggcattgctttgccttatcatctcatctggagtttttaaatgccatttgtttcagttgtctttaacaacataataaatagactttgccatttaaaaaaaaaaaaaaaaaaaaaaa

SEQ ID NO: 554 - DNA, 1396 bp, Homo sapiens
  ref <308>: DATABASE ACCESSION NUMBER: NM_001054
  ref <309>: DATABASE ENTRY DATE: 2001-06-18
gcattccccacacaacacccacactcagccactgcgggcgaggagggcacgaggccaggttcccaagagctcaggtttgtcctggaacccagatggactgtggccgggcaagtggatcacaggcctggccagcctaggagttgccacatgtgaggggccgaggggctcaaggaggggaacatcggggagaggagcctactgggtggaggctgggggtcccagcaggaaatggtgagacaaagggcgctggctggcaggaagacagcacaggaaggtcctagaggttcctcagtgcagctggactctcctggagaccttcacacaccctgacatctgggccccgttccacgagggtgctttcactggtctgcaccatggcccaggccctgggattttgaacagctccgcaggtgaatgaaaggaacatggagctgatccaggacatctctcgcccgccactggagtacgtgaagggggtcccgctcatcaagtactttgcagaggcactggggcccctgcagagcttccaggcccggcctgatgacctgctcatcagcacctaccccaagtccggcaccacctgggtgagccagattctggacatgatctaccagggcggtgacctggaaaagtgtcaccgagctcccatcttcatgcgggtgcccttccttgagttcaaagtcccagggattccctcagggatggagactctgaaaaacacaccagccccacgactcctgaagacacacctgcccctggctctgctcccccagactctgttggatcagaaggtcaaggtggtctatgttgcccgcaacgcaaaggatgtggcggtttcctactaccacttctaccacatggccaaagtgtaccctcaccctgggacctgggaaagcttcctggagaagttcatggctggagaagtgtcctatgggtcctggtaccagcacgtgcaagagtggtgggagctgagccgcacccaccctgttctctacctcttctatgaagacatgaaggagaaccccaaaagggagattcaaaagatcctggagtttgtggggcgctccctgccagaggagactgtggacctcatggttgagcacacgtcgttcaaggagatgaagaagaaccctatgaccaactacaccaccgtccgccgggagttcatggaccacagcatctcccccttcatgaggaaaggcatggctggggactggaagaccaccttcaccgtggcgcagaatgagcgcttcgatgcggactatgcggagaagatggcaggctgcagcctcagcttccgctctgagctgtgagaggggttcctggagtcactgcagagggagtgtgcgaatcaagcctgaccaagaggctccagaataaagtatgatttgtgttc

SEQ ID NO: 555 - DNA, 3683 bp, Homo sapiens
  ref <308>: DATABASE ACCESSION NUMBER: NM_001066
  ref <309>: DATABASE ENTRY DATE: 2001-06-18
gcgagcgcagcggagcctggagagaaggcgctgggctgcgagggcgcgagggcgcgagggcagggggcaaccggaccccgcccgcacccatggcgcccgtcgccgtctgggccgcgctggccgtcggactggagctctgggctgcggcgcacgccttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttggactgattgtgggtgtgacagccttgggtctactaataataggagtggtgaactgtgtcatcatgacccaggtgaaaaagaagcccttgtgcctgcagagagaagccaaggtgcctcacttgcctgccgataaggcccggggtacacagggccccgagcagcagcacctgctgatcacagcgccgagctccagcagcagctccctggagagctcggccagtgcgttggacagaagggcgcccactcggaaccagccacaggcaccaggcgtggaggccagtggggccggggaggcccgggccagcaccgggagctcagattcttcccctggtggccatgggacccaggtcaatgtcacctgcatcgtgaacgtctgtagcagctctgaccacagctcacagtgctcctcccaagccagctccacaatgggagacacagattccagcccctcggagtccccgaaggacgagcaggtccccttctccaaggaggaatgtgcctttcggtcacagctggagacgccagagaccctgctggggagcaccgaagagaagcccctgccccttggagtgcctgatgctgggatgaagcccagttaaccaggccggtgtgggctgtgtcgtagccaaggtgggctgagccctggcaggatgaccctgcgaaggggccctggtccttccaggcccccaccactaggactctgaggctctttctgggccaagttcctctagtgccctccacagccgcagcctccctctgacctgcaggccaagagcagaggcagcgagttggggaaagcctctgctgccatggtgtgtccctctcggaaggctggctgggcatggacgttcggggcatgctggggcaagtccctgactctctgtgacctgccccgcccagctgcacctgccagcctggcttctggagcccttgggttttttgtttgtttgtttgtttgtttgtttgtttctccccctgggctctgcccagctctggcttccagaaaaccccagcatccttttctgcagaggggctttctggagaggagggatgctgcctgagtcacccatgaagacaggacagtgcttcagcctgaggctgagactgcgggatggtcctggggctctgtgtagggaggaggtggcagccctgtagggaacggggtccttcaagttagctcaggaggcttggaaagcatcacctcaggccaggtgcagtggctcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactccagcctgggcgacagagcgagagtctgtctcaaaagaaaaaaaaaaaagcaccgcctccaaatgctaacttgtccttttgtaccatggtgtgaaagtcagatgcccagagggcccaggcaggccaccatattcagtgctgtggcctgggcaagataacgcacttctaactagaaatctgccaattttttaaaaaagtaagtaccactcaggccaacaagccaacgacaaagccaaactctgccagccacatccaaccccccacctgccatttgcaccctccgccttcactccggtgtgcctgcagccccgcgcctccttccttgctgtcctaggccacaccatctcctttcagggaatttcaggaactagagatgactgagtcctcgtagccatctctctactcctacctcagcctagaccctcctcctcccccagaggggtgggttcctcttccccactccccaccttcaattcctgggccccaaacgggctgccctgccactttggtacatggccagtgtgatcccaagtgccagtcttgtgtctgcgtctgtgttgcgtgtcgtgggtgtgtgtagccaaggtcggtaagttgaatggcctgccttgaagccactgaagctgggattcctccccattagagtcagccttccccctcccagggccagggccctgcagaggggaaaccagtgtagccttgcccggattctgggaggaagcaggttgaggggctcctggaaaggctcagtctcaggagcatggggataaaggagaaggcatgaaattgtctagcagagcaggggcagggtgataaattgttgataaattccactggacttgagcttggcagctgaactattggagggtgggagagcccagccattaccatggagacaagaagggttttccaccctggaatcaagatgtcagactggctggctgcagtgacgtgcacctgtactcaggaggctgaggggaggatcactggagcccaggagtttgaggctgcagcgagctatgatcgcgccactacactccagcctgagcaacagagtgagaccctgtctcttaaagaaaaaaaaagtcagactgctgggactggccaggtttctgcccacattggacccacatgaggacatgatggagcgcacctgccccctggtggacagtcctgggagaacctcaggcttccttggcatcacagggcagagccgggaagcgatgaatttggagactctgtggggccttggttcccttgtgtgtgtgtgttgatcccaagacaatgaaagtttgcactgtatgctggacggcattcctgcttatcaataaacctgtttgttttaaaaaaaa

SEQ ID NO: 556 - DNA, 1536 bp, Homo sapiens
  ref <308>: DATABASE ACCESSION NUMBER: NM_001071
  ref <309>: DATABASE ENTRY DATE: 2001-06-18
ggggggggggggaccacttggcctgcctccgtcccgccgcgccacttggcctgcctccgtcccgccgcgccacttcgcctgcctccgtcccccgcccgccgcgccatgcctgtggccggctcggagctgccgcgccggcccttgccccccgccgcacaggagcgggacgccgagccgcgtccgccgcacggggagctgcagtacctggggcagatccaacacatcctccgctgcggcgtcaggaaggacgaccgcacgggcaccggcaccctgtcggtattcggcatgcaggcgcgctacagcctgagagatgaattccctctgctgacaaccaaacgtgtgttctggaagggtgttttggaggagttgctgtggtttatcaagggatccacaaatgctaaagagctgtcttccaagggagtgaaaatctgggatgccaatggatcccgagactttttggacagcctgggattctccaccagagaagaaggggacttgggcccagtttatggcttccagtggaggcattttggggcagaatacagagatatggaatcagattattcaggacagggagttgaccaactgcaaagagtgattgacaccatcaaaaccaaccctgacgacagaagaatcatcatgtgcgcttggaatccaagagatcttcctctgatggcgctgcctccatgccatgccctctgccagttctatgtggtgaacagtgagctgtcctgccagctgtaccagagatcgggagacatgggcctcggtgtgcctttcaacatcgccagctacgccctgctcacgtacatgattgcgcacatcacgggcctgaagccaggtgactttatacacactttgggagatgcacatatttacctgaatcacatcgagccactgaaaattcagcttcagcgagaacccagacctttcccaaagctcaggattcttcgaaaagttgagaaaattgatgacttcaaagctgaagactttcagattgaagggtacaatccgcatccaactattaaaatggaaatggctgtttagggtgctttcaaaggagcttgaaggatattgtcagtctttaggggttgggctggatgccgaggtaaaagttctttttgctctaaaagaaaaaggaactaggtcaaaaatctgtccgtgacctatcagttattaatttttaaggatgttgccactggcaaatgtaactgtgccagttctttccataataaaaggctttgagttaactcactgagggtatctgacaatgctgaggttatgaacaaagtgaggagaatgaaatgtatgtgctcttagcaaaaacatgtatgtgcatttcaatcccacgtacttataaagaaggttggtgaatttcacaagctatttttggaatatttttagaatattttaagaatttcacaagctattccctcaaatctgagggagctgagtaacaccatcgatcatgatgtagagtgtggttatgaactttatagttgttttatatgttgctataataaagaagtgttctgc

SEQ ID NO: 557 - DNA, 3103 bp, Homo sapiens
  ref <308>: DATABASE ACCESSION NUMBER: NM_001078
  ref <309>: DATABASE ENTRY DATE: 2001-06-18
actccgcggtatctgcatcgggcctcactggcttcaggagctgaataccctcccaggcacacacaggtgggacacaaataagggttttggaaccactattttctcatcacgacagcaacttaaaatgcctgggaagatggtcgtgatccttggagcctcaaatatactttggataatgtttgcagcttctcaagcttttaaaatcgagaccaccccagaatctagatatcttgctcagattggtgactccgtctcattgacttgcagcaccacaggctgtgagtccccatttttctcttggagaacccagatagatagtccactgaatgggaaggtgacgaatgaggggaccacatctacgctgacaatgaatcctgttagttttgggaacgaacactcttacctgtgcacagcaacttgtgaatctaggaaattggaaaaaggaatccaggtggagatctactcttttcctaaggatccagagattcatttgagtggccctctggaggctgggaagccgatcacagtcaagtgttcagttgctgatgtatacccatttgacaggctggagatagacttactgaaaggagatcatctcatgaagagtcaggaatttctggaggatgcagacaggaagtccctggaaaccaagagtttggaagtaacctttactcctgtcattgaggatattggaaaagttcttgtttgccgagctaaattacacattgatgaaatggattctgtgcccacagtaaggcaggctgtaaaagaattgcaagtctacatatcacccaagaatacagttatttctgtgaatccatccacaaagctgcaagaaggtggctctgtgaccatgacctgttccagcgagggtctaccagctccagagattttctggagtaagaaattagataatgggaatctacagcacctttctggaaatgcaactctcaccttaattgctatgaggatggaagattctggaatttatgtgtgtgaaggagttaatttgattgggaaaaacagaaaagaggtggaattaattgttcaagagaaaccatttactgttgagatctcccctggaccccggattgctgctcagattggagactcagtcatgttgacatgtagtgtcatgggctgtgaatccccatctttctcctggagaacccagatagacagccctctgagcgggaaggtgaggagtgaggggaccaattccacgctgaccctgagccctgtgagttttgagaacgaacactcttatctgtgcacagtgacttgtggacataagaaactggaaaagggaatccaggtggagctctactcattccctagagatccagaaatcgagatgagtggtggcctcgtgaatgggagctctgtcactgtaagctgcaaggttcctagcgtgtacccccttgaccggctggagattgaattacttaagggggagactattctggagaatatagagtttttggaggatacggatatgaaatctctagagaacaaaagtttggaaatgaccttcatccctaccattgaagatactggaaaagctcttgtttgtcaggctaagttacatattgatgacatggaattcgaacccaaacaaaggcagagtacgcaaacactttatgtcaatgttgcccccagagatacaaccgtcttggtcagcccttcctccatcctggaggaaggcagttctgtgaatatgacatgcttgagccagggctttcctgctccgaaaatcctgtggagcaggcagctccctaacggggagctacagcctctttctgagaatgcaactctcaccttaatttctacaaaaatggaagattctggggtttatttatgtgaaggaattaaccaggctggaagaagcagaaaggaagtggaattaattatccaagttactccaaaagacataaaacttacagcttttccttctgagagtgtcaaagaaggagacactgtcatcatctcttgtacatgtggaaatgttccagaaacatggataatcctgaagaaaaaagcggagacaggagacacagtactaaaatctatagatggcgcctataccatccgaaaggcccagttgaaggatgcgggagtatatgaatgtgaatctaaaaacaaagttggctcacaattaagaagtttaacacttgatgttcaaggaagagaaaacaacaaagactatttttctcctgagcttctcgtgctctattttgcatcctccttaataatacctgccattggaatgataatttactttgcaagaaaagccaacatgaaggggtcatatagtcttgtagaagcacagaaatcaaaagtgtagctaatgcttgatatgttcaactggagacactatttatctgtgcaaatccttgatactgctcatcattccttgagaaaaacaatgagctgagaggcagacttccctgaatgtattgaacttggaaagaaatgcccatctatgtcccttgctgtgagcaagaagtcaaagtaaaacttgctgcctgaagaacagtaactgccatcaagatgagagaactggaggagttccttgatctgtatatacaataacataatttgtacatatgtaaaataaaattatgccatagcaagattgcttaaaatagcaacactctatatttagattgttaaaataactagtgttgcttggactattataatttaatgcatgttaggaaaatttcacattaatatttgctgacagctgacctttgtcatctttcttctattttattccctttcacaaaattttattcctatatagtttattgacaataatttcaggttttgtaaagatgccgggttttatatttttatagacaaataataagcaaagggagcactgggttgactttcaggtactaaatacctcaacctatggtataatggttgactgggtttctctgtatagtactggcatggtacggagatgtttcacgaagtttgttcatcagactcctgtgcaactttcccaatgtggcctaaaaatgcaacttctttttattttcttttgtaaatgtttaggtttttttgtatagtaaagtgataatttctggaatta

SEQ ID NO: 558 - DNA, 1534 bp, Homo sapiens
  ref <308>: DATABASE ACCESSION NUMBER: NM_001085
  ref <309>: DATABASE ENTRY DATE: 2001-06-18
ggaattccctggagcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccttgataagaatgtcatcttctccccactgagcatctccaccgccttggccttcctgtctctgggggcccataataccaccctgacagagattctcaaggcctcgagttcacctcacggagacttactgaggcagaaattcactcagagcttccagcacctccgcgcaccctcaatcagttccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccccgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggtcgtgtctgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccagcaagcctagagcttgcatcaagcagtggggctctcagtaaggaacttggaatgcaagctggatgcctgggtctctgggcacagctggcccctgtgcaccgtagtggccatggcatgtgtggccctgtctgcttatccttggaaggtgacagcgattccctgtgaagctctcacacgcacaggggcccatggactcttcagtctggagggtcctggcctcctgacagcaataaataatttcgttggcc

SEQ ID NO: 559 - DNA, 6491 bp, Homo sapiens
  ref <308>: DATABASE ACCESSION NUMBER: NM_001089
  ref <309>: DATABASE ENTRY DATE: 2001-06-18
ccgccccggcgcccaggctcggtgctggagagtcatgcctgtgagccctgggcacctcctgatgtcctgcgaggtcacggtgttcccaaacctcagggttgccctgccccactccagaggctctcaggccccaccccggagccctctgtgcggagccgcctcctcctggccagttccccagtagtcctgaagggagacctgctgtgtggagcctcttctgggacccagccatgagtgtggagctgagcaactgaacctgaaactcttccactgtgagtcaaggaggcttttccgcacatgaaggacgctgagcgggaaggactcctctctgcctgcagttgtagcgagtggaccagcaccaggggctctctagactgcccctcctccatcgccttccctgcctctccaggacagagcagccacgtctgcacacctcgccctctttacactcagttttcagagcacgtttctcctatttcctgcgggttgcagcgcctacttgaacttactcagaccacctacttctctagcagcactgggcgtccctttcagcaagacgatggctgtgctcaggcagctggcgctcctcctctggaagaactacaccctgcagaagcggaaggtcctggtgacggtcctggaactcttcctgccattgctgtttcctgggatcctcatctggctccgcttgaagattcagtcggaaaatgtgcccaacgccaccatctacccgggccagtccatccaggagctgcctctgttcttcaccttccctccgccaggagacacctgggagcttgcctacatcccttctcacagtgacgctgccaagaccgtcactgagacagtgcgcagggcacttgtgatcaacatgcgagtgcgcggctttccctccgagaaggactttgaggactacattaggtacgacaactgctcgtccagcgtgctggccgccgtggtcttcgagcaccccttcaaccacagcaaggagcccctgccgctggcggtgaaatatcacctacggttcagttacacacggagaaattacatgtggacccaaacaggctcctttttcctgaaagagacagaaggctggcacactacttcccttttcccgcttttcccaaacccaggaccaagggaactaacatcccctgatggcggagaacctgggtacatccgggaaggcttcctggccgtgcagcatgctgtggaccgggccatcatggagtaccatgccgatgccgccacacgccagctgttccagagactgacggtgaccatcaagaggttcccgtacccgccgttcatcgcagaccccttcctcgtggccatccagtaccagctgcccctgctgctgctgctcagcttcacctacaccgcgctcaccattgcccgtgctgtcgtgcaggagaaggaaaggaggctgaaggagtacatgcgcatgatggggctcagcagctggctgcactggagtgcctggttcctcttgttcttcctcttcctcctcatcgccgcctccttcatgaccctgctcttctgtgtcaaggtgaagccaaatgtagccgtgctgtcccgcagcgacccctccctggtgctcgccttcctgctgtgcttcgccatctctaccatctccttcagcttcatggtcagcaccttcttcagcaaagccaacatggcagcagccttcggaggcttcctctacttcttcacctacatcccctacttcttcgtggcccctcggtacaactggatgactctgagccagaagctctgctcctgcctcctgtctaatgtcgccatggcaatgggagcccagctcattgggaaatttgaggcgaaaggcatgggcatccagtggcgagacctcctgagtcccgtcaacgtggacgacgacttctgcttcgggcaggtgctggggatgctgctgctggactctgtgctctatggcctggtgacctggtacatggaggccgtcttcccagggcagttcggcgtgcctcagccctggtacttcttcatcatgccctcctattggtgtgggaagccaagggcggttgcagggaaggaggaagaagacagtgaccccgagaaagcactcagaaacgagtactttgaagccgagccagaggacctggtggcggggatcaagatcaagcacctgtccaaggtgttcagggtgggaaataaggacagggcggccgtcagagacctgaacctcaacctgtacgagggacagatcaccgtcctgctgggccacaacggtgccgggaagaccaccaccctctccatgctcacaggtctctttccccccaccagtggacgggcatacatcagcgggtatgaaatttcccaggacatggttcagatccggaagagcctgggcctgtgcccgcagcacgacatcctgtttgacaacttgacagtcgcagagcacctttatttctacgcccagctgaagggcctgtcacgtcagaagtgccctgaagaagtcaagcagatgctgcacatcatcggcctggaggacaagtggaactcacggagccgcttcctgagcgggggcatgaggcgcaagctctccatcggcatcgccctcatcgcaggctccaaggtgctgatactggacgagcccacctcgggcatggacgccatctccaggagggccatctgggatcttcttcagcggcagaaaagtgaccgcaccatcgtgctgaccacccacttcatggacgaggctgacctgctgggagaccgcatcgccatcatggccaagggggagctgcagtgctgcgggtcctcgctgttcctcaagcagaaatacggtgccggctatcacatgacgctggtgaaggagccgcactgcaacccggaagacatctcccagctggtccaccaccacgtgcccaacgccacgctggagagcagcgctggggccgagctgtctttcatccttcccagagagagcacgcacaggtttgaaggtctctttgctaaactggagaagaagcagaaagagctgggcattgccagctttggggcatccatcaccaccatggaggaagtcttccttcgggtcgggaagctggtggacagcagtatggacatccaggccatccagctccctgccctgcagtaccagcacgagaggcgcgccagcgactgggctgtggacagcaacctctgtggggccatggacccctccgacggcattggagccctcatcgaggaggagcgcaccgctgtcaagctcaacactgggctcgccctgcactgccagcaattctgggccatgttcctgaagaaggccgcatacagctggcgcgagtggaaaatggtggcggcacaggtcctggtgcctctgacctgcgtcaccctggccctcctggccatcaactactcctcggagctcttcgacgaccccatgctgaggctgaccttgggcgagtacggcagaaccgtcgtgcccttctcagttcccgggacctcccagctgggtcagcagctgtcagagcatctgaaagacgcactgcaggctgagggacaggagccccgcgaggtgctcggtgacctggaggagttcttgatcttcagggcttctgtggaggggggcggctttaatgagcggtgccttgtggcagcgtccttcagagatgtgggagagcgcacggtcgtcaacgccttgttcaacaaccaggcgtaccactctccagccactgccctggccgtcgtggacaaccttctgttcaagctgctgtgcgggcctcacgcctccattgtggtctccaacttcccccagccccggagcgccctgcaggctgccaaggaccagtttaacgagggccggaagggattcgacattgccctcaacctgctcttcgccatggcattcttggccagcacgttctccatcctggcggtcagcgagagggccgtgcaggccaagcatgtgcagtttgtgagtggagtccacgtggccagtttctggctctctgctctgctgtgggacctcatctccttcctcatccccagtctgctgctgctggtggtgtttaaggccttcgacgtgcgtgccttcacgcgggacggccacatggctgacaccctgctgctgctcctgctctacggctgggccatcatccccctcatgtacctgatgaacttcttcttcttgggggcggccactgcctacacgaggctgaccatcttcaacatcctgtcaggcatcgccaccttcctgatggtcaccatcatgcgcatcccagctgtaaaactggaagaactttccaaaaccctggatcacgtgttcctggtgctgcccaaccactgtctggggatggcagtcagcagtttctacgagaactacgagacgcggaggtactgcacctcctccgaggtcgccgcccactactgcaagaaatataacatccagtaccaggagaacttctatgcctggagcgccccgggggtcggccggtttgtggcctccatggccgcctcagggtgcgcctacctcatcctgctcttcctcatcgagaccaacctgcttcagagactcaggggcatcctctgcgccctccggaggaggcggacactgacagaattatacacccggatgcctgtgcttcctgaggaccaagatgtagcggacgagaggacccgcatcctggcccccagcccggactccctgctccacacacctctgattatcaaggagctctccaaggtgtacgagcagcgggtgcccctcctggccgtggacaggctctccctcgcggtgcagaaaggggagtgcttcggcctgctgggcttcaatggagccgggaagaccacgactttcaaaatgctgaccggggaggagagcctcacttctggggatgcctttgtcgggggtcacagaatcagctctgatgtcggaaaggtgcggcagcggatcggctactgcccgcagtttgatgccttgctggaccacatgacaggccgggagatgctggtcatgtacgctcggctccggggcatccctgagcgccacatcggggcctgcgtggagaacactctgcggggcctgctgctggagccacatgccaacaagctggtcaggacgtacagtggtggtaacaagcggaagctgagcaccggcatcgccctgatcggagagcctgctgtcatcttcctggacgagccgtccactggcatggaccccgtggcccggcgcctgctttgggacaccgtggcacgagcccgagagtctggcaaggccatcatcatcacctcccacagcatggaggagtgtgaggccctgtgcacccggctggccatcatggtgcaggggcagttcaagtgcctgggcagcccccagcacctcaagagcaagttcggcagcggctactccctgcgggccaaggtgcagagtgaagggcaacaggaggcgctggaggagttcaaggccttcgtggacctgacctttccaggcagcgtcctggaagatgagcaccaaggcatggtccattaccacctgccgggccgtgacctcagctgggcgaaggttttcggtattctggagaaagccaaggaaaagtacggcgtggacgactactccgtgagccagatctcgctggaacaggtcttcctgagcttcgcccacctgcagccgcccaccgcagaggaggggcgatgaggggtggcggctgtctcgccatcaggcagggacaggacgggcaagcagggcccatcttacatcctctctctccaagtttatctcatcctttatttttaatcacttttttctatgatggatatgaaaaattcaaggcagtatgcacagaatggacgagtgcagcccagccctcatgcccaggatcagcatgcgcatctccatgtctgcatactctggagttcactttcccagagctggggcaggccgggcagtctgcgggcaagctccggggtctctgggtggagagctgacccaggaagggctgcagctgagctgggggttgaatttctccaggcactccctggagagaggacccagtgacttgtccaagtttacacacgacactaatctcccctggggaggaagcgggaagccagccaggttgaactgtagcgaggcccccaggccgccaggaatggaccatgcagatcactgtcagtggagggaagctgctgactgtgattaggtgctggggtcttagcgtccagcgcagcccgggggcatcctggaggctctgctcccttagggcatggtagtcaccgcgaagccgggcaccgtcccacagcatctcctagaagcagccggcacaggagggaaggtggccaggctcgaagcagtctctgtttccagcactgcaccctcaggaagtcgcccgccccaggacacgcagggaccaccctaagggctgggtggctgtctcaaggacacattgaatacgttgtgaccatccagaaaataaatgctgaggggacacaaaaaaaaaaaaaaaaaaaaaaaa

SEQ ID NO: 560 - DNA, 3236 bp, Homo sapiens
  ref <308>: DATABASE ACCESSION NUMBER: NM_001109
  ref <309>: DATABASE ENTRY DATE: 2001-06-18
gacccggccatgcgcggcctcgggctctggctgctgggcgcgatgatgctgcctgcgattgcccccagccggccctgggccctcatggagcagtatgaggtcgtgttgccgcggcgtctgccaggcccccgagtccgccgagctctgccctcccacttgggcctgcacccagagagggtgagctacgtccttggggccacagggcacaacttcaccctccacctgcggaagaacagggacctgctgggttccggctacacagagacctatacggctgccaatggctccgaggtgacggagcagcctcgcgggcaggaccactgcttataccagggccacgtagaggggtacccggactcagccgccagcctcagcacctgtgccggcctcaggggtttcttccaggtggggtcagacctgcacctgatcgagcccctggatgaaggtggcgagggcggacggcacgccgtgtaccaggctgagcacctgctgcagacggccgggacctgcggggtcagcgacgacagcctgggcagcctcctgggaccccggacggcagccgtcttcaggcctcggcccggggactctctgccatcccgagagacccgctacgtggagctgtatgtggtcgtggacaatgcagagttccagatgctggggagcgaagcagccgtgcgtcatcgggtgctggaggtggtgaatcacgtggacaagctatatcagaaactcaacttccgtgtggtcctggtgggcctggagatttggaatagtcaggacaggttccacgtcagccccgaccccagtgtcacactggagaacctcctgacctggcaggcacggcaacggacacggcggcacctgcatgacaacgtacagctcatcacgggtgtcgacttcaccgggactactgtggggtttgccagggtgtccgccatgtgctcccacagctcaggggctgtgaaccaggaccacagcaagaaccccgtgggcgtggcctgcaccatggcccatgagatgggccacaacctgggcatggaccatgatgagaacgtccagggctgccgctgccaggaacgcttcgaggccggccgctgcatcatggcaggcagcattggctccagtttccccaggatgttcagtgactgcagccaggcctacctggagagctttttggagcggccgcagtcggtgtgcctcgccaacgcccctgacctcagccacctggtgggcggccccgtgtgtgggaacctgtttgtggagcgtggggagcagtgcgactgcggcccccccgaggactgccggaaccgctgctgcaactctaccacctgccagctggctgagggggcccagtgtgcgcacggtacctgctgccaggagtgcaaggtgaagccggctggtgagctgtgccgtcccaagaaggacatgtgtgacctcgaggagttctgtgacggccggcaccctgagtgcccggaagacgccttccaggagaacggcacgccctgctccgggggctactgctacaacggggcctgtcccacactggcccagcagtgccaggccttctgggggccaggtgggcaggctgccgaggagtcctgcttctcctatgacatcctaccaggctgcaaggccagccggtacagggctgacatgtgtggcgttctgcagtgcaagggtgggcagcagcccctggggcgtgccatctgcatcgtggatgtgtgccacgcgctcaccacagaggatggcactgcgtatgaaccagtgcccgagggcacccggtgtggaccagagaaggtttgctggaaaggacgttgccaggacttacacgtttacagatccagcaactgctctgcccagtgccacaaccatggggtgtgcaaccacaagcaggagtgccactgccacgcgggctgggccccgccccactgcgcgaagctgctgactgaggtgcacgcagcgtccgggagcctccccgtcctcgtggtggtggttctggtgctcctggcagttgtgctggtcaccctggcaggcatcatcgtctaccgcaaagcccggagccgcatcctgagcaggaacgtggctcccaagaccacaatggggcgctccaaccccctgttccaccaggctgccagccgcgtgccggccaagggcggggctccagccccatccaggggcccccaagagctggtccccaccacccacccgggccagcccgcccgacacccggcctcctcggtggctctgaagaggccgccccctgctcctccggtcactgtgtccagcccacccttcccagttcctgtctacacccggcaggcaccaaagcaggtcatcaagccaacgttcgcacccccagtgcccccagtcaaacccggggctggtgcggccaaccctggtccagctgagggtgctgttggcccaaaggttgccctgaagccccccatccagaggaagcaaggagccggagctcccacagcaccctaggggggcacctgcgcctgtgtggaaatttggagaagttgcggcagagaagccatgcgttccagccttccacggtccagctagtgccgctcagccctagaccctgactttgcaggctcagctgctgttctaacctcagtaatgcatctacctgagaggctcctgctgtccacgccctcagccaattccttctccccgccttggccacgtgtagccccagctgtctgcaggcaccaggctgggatgagctgtgtgcttgcgggtgcgtgtgtgtgtacgtgtctccaggtggccgctggtctcccgctgtgttcaggaggccacatatacagcccctcccagccacacctgcccctgctctggggcctgctgagccggctgccctgggcacccggttccaggcagcacagacgtggggcatccccagaaagactccatcccaggaccaggttcccctccgtgctcttcgagagggtgtcagtgagcagactgcaccccaagctcccgactccaggtcccctgatcttgggcctgtttcccatgggattcaagagggacagccccagctttgtgtgtgtttaagcttaggaatgccctttatggaaagggctatgtgggagagtcagctatcttgtctggttttcttgagacctcagatgtgtgttcagcagggctgaaagcttttattctttaataatgagaaatgtatattttactaataaattattgaccgagttctgtagattcttgttaga

SEQ ID NO: 561 - DNA, 1314 bp, Homo sapiens
  ref <308>: DATABASE ACCESSION NUMBER: NM_001122
  ref <309>: DATABASE ENTRY DATE: 2001-06-18
atggcatccgttgcagttgatccacaaccgagtgtggtgactcgggtggtcaacctgcccttggtgagctccacgtatgacctcatgtcctcagcctatctcagtacaaaggaccagtatccctacctgaagtctgtgtgtgagatggcagagaacggtgtgaagaccatcacctccgtggccatgaccagtgctctgcccatcatccagaagctagagccgcaaattgcagttgccaatacctatgcctgtaaggggctagacaggattgaggagagactgcctattctgaatcagccatcaactcagattgttgccaatgccaaaggcgctgtgactggggcaaaagatgctgtgacgactactgtgactggggccaaggattctgtggccagcacgatcacaggggtgatggacaagaccaaaggggcagtgactggcagtgtggagaagaccaagtctgtggtcagtggcagcattaacacagtcttggggagtcggatgatgcagctcgtgagcagtggcgtagaaaatgcactcaccaaatcagagctgttggtagaacagtacctccctctcactgaggaagaactagaaaaagaagcaaaaaaagttgaaggatttgatctggttcagaagccaagttattatgttagactgggatccctgtctaccaagcttcactcccgtgcctaccagcaggctctcagcagggttaaagaagctaagcaaaaaagccaacagaccatttctcagctccattctactgttcacctgattgaatttgccaggaagaatgtgtatagtgccaatcagaaaattcaggatgctcaggataagctctacctctcatgggtagagtggaaaaggagcattggatatgatgatactgatgagtcccactgtgctgagcaatttgagtcacgtactcttgcaattgcccgcaacctgactcagcagctccagaccacgtgccacaccctcctgtccaacatccaaggtgtaccacagaacatccaagatcaagccaagcacatgggggtgatggcaggcgacatctactcagtgttccgcaatgctgcctcctttaaagaagtgtctgacagcctcctcacttctagcaaggggcagctgcagaaaatgaaggaatctttagatgacgtgatggattatcttgttaacaacacgcccctcaactggctggtaggtcccttttatcctcagctgactgagtctcagaatgctcaggaccaaggtgcagagatggacaagagcagccaggagacccagcgatctgagcataaaactcattaa

SEQ ID NO: 562 - DNA, 1449 bp, Homo sapiens
  ref <308>: DATABASE ACCESSION NUMBER: NM_001124
  ref <309>: DATABASE ENTRY DATE: 2001-06-18
ctggatagaacagctcaagccttgccacttcgggcttctcactgcagctgggcttggacttcggagttttgccattgccagtgggacgtctgagactttctccttcaagtacttggcagatcactctcttagcagggtctgcgcttcgcagccgggatgaagctggtttccgtcgccctgatgtacctgggttcgctcgccttcctaggcgctgacaccgctcggttggatgtcgcgtcggagtttcgaaagaagtggaataagtgggctctgagtcgtgggaagagggaactgcggatgtccagcagctaccccaccgggctcgctgacgtgaaggccgggcctgcccagacccttattcggccccaggacatgaagggtgcctctcgaagccccgaagacagcagtccggatgccgcccgcatccgagtcaagcgctaccgccagagcatgaacaacttccagggcctccggagctttggctgccgcttcgggacgtgcacggtgcagaagctggcacaccagatctaccagttcacagataaggacaaggacaacgtcgcccccaggagcaagatcagcccccagggctacggccgccggcgccggcgctccctgcccgaggccggcccgggtcggactctggtgtcttctaagccacaagcacacggggctccagcccccccgagtggaagtgctccccactttctttaggatttaggcgcccatggtacaaggaatagtcgcgcaagcatcccgctggtgcctcccgggacgaaggacttcccgagcggtgtggggaccgggctctgacagccctgcggagaccctgagtccgggaggcaccgtccggcggcgagctctggctttgcaagggcccctccttctgggggcttcgcttccttagccttgctcaggtgcaagtgccccagggggcggggtgcagaagaatccgagtgtttgccaggcttaaggagaggagaaactgagaaatgaatgctgagacccccggagcaggggtctgagccacagccgtgctcgcccacaaactgatttctcacggcgtgtcaccccaccagggcgcaagcctcactattacttgaactttccaaaacctaaagaggaaaagtgcaatgcgtgttgtacatacagaggtaactatcaatatttaagtttgttgctgtcaagattttttttgtaacttcaaatatagagatatttttgtacgttatatattgtattaagggcattttaaaagcaattatattgtcctcccctattttaagacgtgaatgtctcagcgaggtgtaaagttgttcgccgcgtggaatgtgagtgtgtttgtgtgcatgaaagagaaagactgattacctcctgtgtggaagaaggaaacaccgagtctctgtataatctatttacataaaatgggtgatatgcgaacagcaaacc

SEQ ID NO: 563 - DNA, 877 bp, Homo sapiens
  ref <308>: DATABASE ACCESSION NUMBER: NM_001161
  ref <309>: DATABASE ENTRY DATE: 2001-06-18
cctcctacctccttctgcttcggtgcgtttgcttctgaggttctccagtgtcacaacaaacacatgccagccctgttttacagggagccctggaggagttgggatagaggccacattgactgagggtagttgccagggtcctgcagttatacacaaagtccttaggataagaccatggccttgagagcatgtggcttgatcatcttccgaagatgcctcattcccaaagtggacaacaatgcaattgagtttttactgctgcaggcatcagatggcattcatcactggactcctcccaaaggccatgtggaaccaggagaggatgacttggaaacagccctgagggagacccaagaggaagcaggcatagaagcaggccagctgaccattattgaggggttcaaaagggaactcaattatgtggccaggaacaagcctaaaacagtcatttactggctggcggaggtgaaggactatgacgtggagatccgcctctcccatgagcaccaagcctaccgctggctggggctggaggaggcctgccagttggctcagttcaaggagatgaaggcagcgctccaagaaggacaccagtttctttgctccatagaggcctgagctgactggagcagagtcatttgcttcagcaggatccttgtgggccttctaagatgaagccaccctcaggtccagggaaggttgtgctggtatttggctcatgacagccaagagcagatttgtgaaatcggctcaactcccaggtgagagcaagcaaaaatcttggctgggtggaaaggaaggcaaaagagtaaaaattaaaaaggccaggcccaagtaagtgtaccttgtactttataaataaacctcaagcagctca

SEQ ID NO: 564 - DNA, 3165 bp, Homo sapiens
  ref <308>: DATABASE ACCESSION NUMBER: NM_001165
  ref <309>: DATABASE ENTRY DATE: 2001-06-18
gaattcaaaatgtcttcagttgtaaatcttaccattattttacgtacctctaagaaataaaagtgcttctaattaaaatatgatgtcattaattatgaaatacttcttgataacagaagttttaaaatagccatcttagaatcagtgaaatatggtaatgtattattttcctcctttgagttaggtcttgtgcttttttttcctggccactaaatttcacaatttccaaaaagcaaaataaacatattctgaatatttttgctgtgaaacacttgacagcagagctttccaccatgaaaagaagcttcatgagtcacacattacatctttgggttgattgaatgccactgaaacattctagtagcctggagaagttgacctacctgtggagatgcctgccattaaatggcatcctgatggcttaatacacatcactcttctgtgaagggttttaattttcaacacagcttactctgtagcatcatgtttacattgtatgtataaagattatacaaaggtgcaattgtgtatttcttccttaaaatgtatcagtataggatttagaatctccatgttgaaactctaaatgcatagaaataaaaataataaaaaatttttcattttggcttttcagcctagtattaaaactgataaaagcaaagccatgcacaaaactacctccctagagaaaggctagtcccttttcttccccattcatttcattatgaacatagtagaaaacagcatattcttatcaaatttgatgaaaagcgccaacacgtttgaactgaaatacgacttgtcatgtgaactgtaccgaatgtctacgtattccacttttcctgctggggtccctgtctcagaaaggagtcttgctcgcgctggtttctattacactggtgtgaatgacaaggtcaaatgcttctgttgtggcctgatgctggataactggaaaagaggagacagtcctactgaaaagcataaaaagttgtatcctagctgcagattcgttcagagtctaaattccgttaacaacttggaagctacctctcagcctacttttccttcttcagtaacaaattccacacactcattacttccgggtacagaaaacagtggatatttccgtggctcttattcaaactctccatcaaatcctgtaaactccagagcaaatcaagatttttctgccttgatgagaagttcctaccactgtgcaatgaataacgaaaatgccagattacttacttttcagacatggccattgacttttctgtcgccaacagatctggcaaaagcaggcttttactacataggacctggagacagagtggcttgctttgcctgtggtggaaaattgagcaattgggaaccgaaggataatgctatgtcagaacacctgagacattttcccaaatgcccatttatagaaaatcagcttcaagacacttcaagatacacagtttctaatctgagcatgcagacacatgcagcccgctttaaaacattctttaactggccctctagtgttctagttaatcctgagcagcttgcaagtgcgggtttttattatgtgggtaacagtgatgatgtcaaatgcttttgctgtgatggtggactcaggtgttgggaatctggagatgatccatgggttcaacatgccaagtggtttccaaggtgtgagtacttgataagaattaaaggacaggagttcatccgtcaagttcaagccagttaccctcatctacttgaacagctgctatccacatcagacagcccaggagatgaaaatgcagagtcatcaattatccattttgaacctggagaagaccattcagaagatgcaatcatgatgaatactcctgtgattaatgctgccgtggaaatgggctttagtagaagcctggtaaaacagacagttcagagaaaaatcctagcaactggagagaattatagactagtcaatgatcttgtgttagacttactcaatgcagaagatgaaataagggaagaggagagagaaagagcaactgaggaaaaagaatcaaatgatttattattaatccggaagaatagaatggcactttttcaacatttgacttgtgtaattccaatcctggatagtctactaactgccggaattattaatgaacaagaacatgatgttattaaacagaagacacagacgtctttacaagcaagagaactgattgatacgattttagtaaaaggaaatattgcagccactgtattcagaaactctctgcaagaagctgaagctgtgttatatgagcatttatttgtgcaacaggacataaaatatattcccacagaagatgtttcagatctaccagtggaagaacaattgcggagactacaagaagaaagaacatgtaaagtgtgtatggacaaagaagtgtccatagtgtttattccttgtggtcatctagtagtatgcaaagattgtgctccttctttaagaaagtgtcctatttgtaggagtacaatcaagggtacagttcgtacatttctttcatgaagaagaaccaaaacatcatctaaactttagaattaatttattaaatgtattataactttaactttcatcctaatttggtttccttaaaatttttatttatttacaactcaacaaacattgttttgtgtaacatatttaatatatgtatctaaaccatatgaacatatattttttagaaactaagagaatgataggcttttgttcttatgaacgaaaaagaggtagcactacaaacacaatattcaatcaaaatttcagcattattgaaattgtaagtgaagtaaaacttaagatatttgagttaacctttaagaattttaaatattttggcattgtactaataccgggaacatgaagccaggtgtggtggtatgtgcctgtagtcccaggctgaggcaagagaattacttgagcccaggagtttgaatccatcctgggcagcatactgagaccctgcctttaaaaacaaacagaacaaaaacaaaacaccagggacacatttctctgtcttttttgatcagtgtcctatacatcgaaggtgtgcatatatgttgaatgacattttagggacatggtgtttttataaagaattctgtgagaaaaaatttaataaaaccccccaaatt

SEQ ID NO: 565 - DNA, 3496 bp, Homo sapiens
  ref <308>: DATABASE ACCESSION NUMBER: NM_001166
  ref <309>: DATABASE ENTRY DATE: 2001-06-18
gaattctatggagtgtaattttgtgtatgaattatatttttaaaacattgaagagttttcagaaagaaggctagtagagttgattactgatactttatgctaagcagtacttttttggtagtacaatattttgttaggcgtttctgataacactagaaaggacaagttttatcttgtgataaattgattaatgtttacaacatgactgataattatagctgaatagtccttaaatgatgaacaggttatttagtttttaaatgcagtgtaaaaagtgtgctgtggaaattttatggctaactaagtttatggagaaaataccttcagttgatcaagaataatagtggtatacaaagttaggaagaaagtcaacatgatgctgcaggaaatggaaacaaatacaaatgatatttaacaaagatagagtttacagtttttgaactttaagccaaattcatttgacatcaagcactatagcaggcacaggttcaacaaagcttgtgggtattgacttcccccaaaagttgtcagctgaagtaatttagcccacttaagtaaatactatgatgataagctgtgtgaacttagcttttaaatagtgtgaccatatgaaggttttaattacttttgtttattggaataaaatgagattttttgggttgtcatgttaaagtgcttatagggaaagaagcctgcatataattttttaccttgtggcataatcagtaattggtctgttattcaggcttcatagcttgtaaccaaatataaataaaaggcataatttaggtattctatagttgcttagaattttgttaatataaatctctgtgaaaaatcaaggagttttaatattttcagaagtgcatccacctttcagggctttaagttagtattactcaagattatgaacaaatagcacttaggttacctgaaagagttactacaaccccaaagagttgtgttctaagtagtatcttggaaattcagagagatactcatcctacctgaatataaactgagataaatccagtaaagaaagtgtagtaaattctacataagagtctatcattgatttcttttggtggtaaaaatcttagttcatgtgaagaaatttcatgtgaatgttttagctatcaaacagcactgtcacctactcatgcacaaaactgcctcccaaagacttttcccaggtccctcgtatcaaaacattaagagtataatggaagatagcacgatcttgtcagattggacaaacagcaacaaacaaaaaatgaagtatgacttttcctgtgaactctacagaatgtctacatattcaactttccccgccggggtgcctgtctcagaaaggagtcttgctcgtgctggtttttattatactggtgtgaatgacaaggtcaaatgcttctgttgtggcctgatgctggataactggaaactaggagacagtcctattcaaaagcataaacagctatatcctagctgtagctttattcagaatctggtttcagctagtctgggatccacctctaagaatacgtctccaatgagaaacagttttgcacattcattatctcccaccttggaacatagtagcttgttcagtggttcttactccagcctttctccaaaccctcttaattctagagcagttgaagacatctcttcatcgaggactaacccctacagttatgcaatgagtactgaagaagccagatttcttacctaccatatgtggccattaacttttttgtcaccatcagaattggcaagagctggtttttattatataggacctggagatagggtagcctgctttgcctgtggtgggaagctcagtaactgggaaccaaaggatgatgctatgtcagaacaccggaggcattttcccaactgtccatttttggaaaattctctagaaactctgaggtttagcatttcaaatctgagcatgcagacacatgcagctcgaatgagaacatttatgtactggccatctagtgttccagttcagcctgagcagcttgcaagtgctggtttttattatgtgggtcgcaatgatgatgtcaaatgcttttgttgtgatggtggcttgaggtgttgggaatctggagatgatccatgggtagaacatgccaagtggtttccaaggtgtgagttcttgatacgaatgaaaggccaagagtttgttgatgagattcaaggtagatatcctcatcttcttgaacagctgttgtcaacttcagataccactggagaagaaaatgctgacccaccaattattcattttggacctggagaaagttcttcagaagatgctgtcatgatgaatacacctgtggttaaatctgccttggaaatgggctttaatagagacctggtgaaacaaacagttcaaagtaaaatcctgacaactggagagaactataaaacagttaatgatattgtgtcagcacttctaaatgctgaagatgaaaaaagagaggaggagaaggaaaaacaagctgaagaaatggcatcagatgatttgtcattaattcggaagaacagaatggctctctttcaacaattgacatgtgtgcttcctatcctggataatcttttaaaggccaatgtaattaataaacaggaacatgatattattaaacaaaaaacacagatacctttacaagcgagagaactgattgataccattttggttaaaggaaatgctgcggccaacatcttcaaaaactgtctaaaagaaattgactctacattgtataagaacttatttgtggataagaatatgaagtatattccaacagaagatgtttcaggtctgtcactggaagaacaattgaggaggttgcaagaagaacgaacttgtaaagtgtgtatggacaaagaagtttctgttgtatttattccttgtggtcatctggtagtatgccaggaatgtgccccttctctaagaaaatgccctatttgcaggggtataatcaagggtactgttcgtacatttctctcttaaagaaaaatagtctatattttaacctgcataaaaaggtctttaaaatattgttgaacacttgaagccatctaaagtaaaaagggaattatgagtttttcaattagtaacattcatgttctagtctgctttggtactaataatcttgtttctgaaaagatggtatcatatatttaatcttaatctgtttatttacaagggaagatttatgtttggtgaactatattagtatgtatgtgtacctaagggagtagtgtcactgcttgttatgcatcatttcaggagttactggatttgttgttctttcagaaagctttgaatactaaattatagtgtagaaaagaactggaaaccaggaactctggagttcatcagagttatggtgccgaattgtctttggtgcttttcacttgtgttttaaaataaggatttttctcttatttctccccctagtttgtgagaaacatctcaataaagtgcttt

SEQ ID NO: 566 - DNA, 1619 bp, Homo sapiens
  ref <308>: DATABASE ACCESSION NUMBER: NM_001168
  ref <309>: DATABASE ENTRY DATE: 2001-06-18
ccgccagatttgaatcgcgggacccgttggcagaggtggcggcggcggcatgggtgccccgacgttgccccctgcctggcagccctttctcaaggaccaccgcatctctacattcaagaactggcccttcttggagggctgcgcctgcaccccggagcggatggccgaggctggcttcatccactgccccactgagaacgagccagacttggcccagtgtttcttctgcttcaaggagctggaaggctgggagccagatgacgaccccatagaggaacataaaaagcattcgtccggttgcgctttcctttctgtcaagaagcagtttgaagaattaacccttggtgaatttttgaaactggacagagaaagagccaagaacaaaattgcaaaggaaaccaacaataagaagaaagaatttgaggaaactgcgaagaaagtgcgccgtgccatcgagcagctggctgccatggattgaggcctctggccggagctgcctggtcccagagtggctgcaccacttccagggtttattccctggtgccaccagccttcctgtgggccccttagcaatgtcttaggaaaggagatcaacattttcaaattagatgtttcaactgtgctcctgttttgtcttgaaagtggcaccagaggtgcttctgcctgtgcagcgggtgctgctggtaacagtggctgcttctctctctctctctcttttttgggggctcatttttgctgttttgattcccgggcttaccaggtgagaagtgagggaggaagaaggcagtgtcccttttgctagagctgacagctttgttcgcgtgggcagagccttccacagtgaatgtgtctggacctcatgttgttgaggctgtcacagtcctgagtgtggacttggcaggtgcctgttgaatctgagctgcaggttccttatctgtcacacctgtgcctcctcagaggacagtttttttgttgttgtgtttttttgttttttttttttggtagatgcatgacttgtgtgtgatgagagaatggagacagagtccctggctcctctactgtttaacaacatggctttcttattttgtttgaattgttaattcacagaatagcacaaactacaattaaaactaagcacaaagccattctaagtcattggggaaacggggtgaacttcaggtggatgaggagacagaatagagtgataggaagcgtctggcagatactccttttgccactgctgtgtgattagacaggcccagtgagccgcggggcacatgctggccgctcctccctcagaaaaaggcagtggcctaaatcctttttaaatgacttggctcgatgctgtgggggactggctgggctgctgcaggccgtgtgtctgtcagcccaaccttcacatctgtcacgttctccacacgggggagagacgcagtccgcccaggtccccgctttctttggaggcagcagctcccgcagggctgaagtctggcgtaagatgatggatttgattcgccctcctccctgtcatagagctgcagggtggattgttacagcttcgctggaaacctctggaggtcatctcggctgttcctgagaaataaaaagcctgtcatttc

SEQ ID NO: 567 - DNA, 1104 bp, Homo sapiens
  ref <308>: DATABASE ACCESSION NUMBER: NM_001179
  ref <309>: DATABASE ENTRY DATE: 2001-06-18
atgaagacgggacattttgaaatagtcaccatgctgctggcaaccatgattctagtggacattttccaggtgaaggctgaagtgttagacatggcagataatgcatttgatgatgaatacctgaaatgtacggacaggatggaaattaaatacgttccccaactgctaaaggaggaaaaagcaagccaccagcaattagatactgtgtgggaaaatgcaaaagccaaatgggcagcccgaaagactcaaatctttctccctatgaattttaaggataaccatggaatagccctgatggcatatatttccgaagctcaagagcaaactcccttttaccatctgttcagtgaagctgtgaagatggctggccaatctcgagaagattatatctatggcttccagttcaaagctttccacttttacctcacaagagccctgcagttgctgagaaaaccttgtgaggccagttccaaaactgtggtatatagaacaagccagggcacttcatttacatttggagggctaaaccaagccaggtttggccattttaccttggcatattcagccaaacctcaggctgctaatgaccagctcactgtgttatccatctacacatgccttggagttgacattgaaaattttcttgataaagaaagtgaaagaattactttaatacctctgaatgaggtttttcaagtgtcacaggagggggctggcaataaccttatccttcaaagcataaacaagacctgcagccattatgagtgtgcatttctaggtggactaaaaaccgaaaactgtattgagaacctagaatattttcaacccatctatgtctacaaccctggtgagaaaaaccagaagcttgaagaccatagtgagaaaaactggaagcttgaagaccatggtgagaaaaaccagaagcttgaagaccatggtgtgaaaatccttgaacccacccaaatacctgctccaggtccagttcctgttccaggtcccaaatgccatccttctgcatcctcgggcaaactgctgcttccacagtttgggatggtcatcattttaatcagtgtttctgctataaatctctttgttgctctgtag

SEQ ID NO: 568 - DNA, 8239 bp, Homo sapiens
  ref <308>: DATABASE ACCESSION NUMBER: NM_001184
  ref <309>: DATABASE ENTRY DATE: 2001-06-18
gcgctcttccggcagcggtacgtttggagacgccgggaacccgcgttggcgtggttgactagtgcctcgcagcctcagcatgggggaacatggcctggagctggcttccatgatccccgccctgcgggagctgggcagtgccacaccagaggaatataatacagttgtacagaagccaagacaaattctgtgtcaattcattgaccggatacttacagatgtaaatgttgttgctgtagaacttgtaaagaaaactgactctcagccaacctccgtgatgttgcttgatttcatccagcatatcatgaaatcctccccacttatgtttgtaaatgtgagtggaagccatgagcgcaaaggcagttgtattgaattcagtaattggatcataacgagacttctgcggattgcagcaactccctcctgtcatttgttacacaagaaaatctgtgaagtcatctgttcattattatttctttttaaaagcaagagtcctgctatttttggggtactcacaaaagaattattacaactttttgaagacttggtttacctccatagaagaaatgtgatgggtcatgctgtggaatggccagtggtcatgagccgatttttaagtcaattagatgaacacatgggatatttacaatcagctcctttgcagttgatgagtatgcaaaatttagaatttattgaagtcactttattaatggttcttactcgtattattgcaattgtgttttttagaaggcaagaactcttactttggcagataggttgtgttctgctagagtatggtagtccaaaaattaaatccctagcaattagctttttaacagaactttttcagcttggaggactaccagcacaaccagctagcacttttttcagctcatttttggaattattaaaacaccttgtagaaatggatactgaccaattgaaactctatgaagagccattatcaaagctgataaagacactatttccctttgaagcagaagcttatagaaatattgaacctgtctatttaaatatgctgctggaaaaactctgtgtcatgtttgaagacggtgtgctcatgcggcttaagtctgatttgctaaaagcagctttgtgccatttactgcagtatttccttaaatttgtgccagctgggtatgaatctgctttacaagtcaggaaggtctatgtgagaaatatttgtaaagctcttttggatgtgcttggaattgaggtagatgcagagtacttgttgggcccactttatgcagctttgaaaatggaaagtatggaaatcattgaggagattcaatgccaaactcaacaggaaaacctcagcagtaatagtgatggaatatcacccaaaaggcgtcgtctcagctcgtctctaaacccttctaaaagagcaccaaaacagactgaggaaattaaacatgtggacatgaaccaaaagagcatattatggagtgcactgaaacagaaagctgaatcccttcagatttcccttgaatacagtggcctaaagaatcctgttattgagatgttagaaggaattgctgttgtcttacaactgactgctctgtgtactgttcattgttctcatcaaaacatgaactgccgtactttcaaggactgtcaacataaatccaagaagaaaccttctgtagtgataacttggatgtcattggatttttacacaaaagtgcttaagagctgtagaagtttgttagaatctgttcagaaactggacctggaggcaaccattgataaggtggtgaaaatttatgatgctttgatttatatgcaagtaaacagttcatttgaagatcatatcctggaagatttatgtggtatgctctcacttccatggatttattcccattctgatgatggctgtttaaagttgaccacatttgccgctaatcttctaacattaagctgtaggatttcagatagctattcaccacaggcacaatcacgatgtgtgtttcttctgactctgtttccaagaagaatattccttgagtggagaacagcagtttacaactgggccctgcagagctcccatgaagtaatccgggctagttgtgttagtggattttttatcttattgcagcagcagaattcttgtaacagagttcccaagattcttatagataaagtcaaagatgattctgacattgtcaagaaagaatttgcttctatacttggtcaacttgtctgtactcttcacggcatgttttatctgacaagttctttaacagaacctttctctgaacacggacatgtggacctcttctgtaggaacttgaaagccacttctcaacatgaatgttcatcttctcaactaaaagcttctgtctgcaagccattccttttcctactgaaaaaaaaaatacctagtccagtaaaacttgctttcatagataatctacatcatctttgtaagcatcttgattttagagaagatgaaacagatgtaaaagcagttcttggaactttattaaatttaatggaagatccagacaaagatgttagagtggcttttagtggaaatatcaagcacatattggaatccttggactctgaagatggatttataaaggagctttttgtcttaagaatgaaggaagcatatacacatgcccaaatatcaagaaataatgagctgaaggataccttgattcttacaacaggggatattggaagggccgcaaaaggagatttggtaccatttgcactcttacacttattgcattgtttgttatccaagtcagcatctgtctctggagcagcatacacagaaattagagctctggttgcagctaaaagtgttaaactgcaaagttttttcagccagtataagaaacccatctgtcagtttttggtagaatcccttcactctagtcagatgacagcacttccgaatactccatgccagaatgctgacgtgcgaaaacaagatgtggctcaccagagagaaatggctttaaatacgttgtctgaaattgccaacgttttcgactttcctgatcttaatcgttttcttactaggacattacaagttctactacctgatcttgctgccaaagcaagccctgcagcttctgctctcattcgaactttaggaaaacaattaaatgtcaatcgtagagagattttaataaacaacttcaaatatattttttctcatttggtctgttcttgttccaaagatgaattagaacgtgcccttcattatctgaagaatgaaacagaaattgaactggggagcctgttgagacaagatttccaaggattgcataatgaattattgctgcgtattggagaacactatcaacaggtttttaatggtttgtcaatacttgcctcatttgcatccagtgatgatccatatcagggcccgagagatatcatatcacctgaactgatggctgattatttacaacccaaattgttgggcattttggctttttttaacatgcagttactgagctctagtgttggcattgaagataagaaaatggccttgaacagtttgatgtctttgatgaagttaatgggacccaaacatgtcagttctgtgagggtgaagatgatgaccacactgagaactggccttcgattcaaggatgattttcctgaattgtgttgcagagcttgggactgctttgttcgctgcctggatcatgcttgtctgggctcccttctcagtcatgtaatagtagctttgttacctcttatacacatccagcctaaagaaactgcagctatcttccactacctcataattgaaaacagggatgctgtgcaagattttcttcatgaaatatattttttacctgatcatccagaattaaaaaagataaaagccgttctccaggaatacagaaaggagacctctgagagcactgatcttcagacaactcttcagctctctatgaaggccattcaacatgaaaatgtcgatgttcgtattcatgctcttacaagcttgaaggaaaccttgtataaaaatcaggaaaaactgataaagtatgcaacagacagtgaaacagtagaacctattatctcacagttggtgacagtgcttttgaaaggttgccaagatgcaaactctcaagctcggttgctctgtggggaatgtttaggggaattgggggcgatagatccaggtcgattagatttctcaacaactgaaactcaaggaaaagattttacatttgtgactggagtagaagattcaagctttgcctatggattattgatggagctaacaagagcttaccttgcgtatgctgataatagccgagctcaagattcagctgcctatgccattcaggagttgctttctatttatgactgtagagagatggagaccaacggcccaggtcaccaattgtggaggagatttcctgagcatgttcgggaaatactagaacctcatctaaataccagatacaagagttctcagaagtcaaccgattggtctggagtaaagaagccaatttacttaagtaaattgggtagtaactttgcagaatggtcagcatcttgggcaggttatcttattacaaaggttcgacatgatcttgccagtaaaattttcacctgctgtagcattatgatgaagcatgatttcaaagtgaccatctatcttcttccacatattctggtgtatgtcttactgggttgtaatcaagaagatcagcaggaggtttatgcagaaattatggcagttctaaagcatgacgatcagcataccataaatacccaagacattgcatctgatctgtgtcaactcagtacacagactgtgttctccatgcttgaccatctcacacagtgggcaaggcacaaatttcaggcactgaaagctgagaaatgtccacacagcaaatcaaacagaaataaggtagactcaatggtatctactgtggattatgaagactatcagagtgtaacccgttttctagacctcataccccaggatactctggcagtagcttcctttcgctccaaagcatacacacgagctgtaatgcactttgaatcatttattacagaaaagaagcaaaatattcaggaacatcttggatttttacagaaattgtatgctgctatgcatgaacctgatggagtggccggagtcagtgcaattagaaaggcagaaccatctctaaaagaacagatccttgaacatgaaagccttggcttgctgagggatgccactgcttgttatgacagggctattcagctagaaccagaccagatcattcattatcatggtgtagtaaagtccatgttaggtcttggtcagctgtctactgttatcactcaggtgaatggagtgcatgctaacaggtccgagtggacagatgaattaaacacgtacagagtggaagcagcttggaaattgtcacagtgggatttggtggaaaactatttggcagcagatggaaaatctacaacatggagtgtcagactgggacagctattattatcagccaaaaaaagagatatcacagctttttatgactcactgaaactagtgagagcagaacaaattgtacctctttcagctgcaagctttgaaagaggctcctaccaacgaggatatgaatatattgtgagattgcacatgttatgtgagttggagcatagcatcaaaccacttttccagcattctccaggtgacagttctcaagaagattctctaaactgggtagctcgactagaaatgacccagaattcctacagagccaaggagcctatcctggctctccggagggctttactaagcctcaacaaaagaccagattacaatgaaatggttggagaatgctggctgcagagtgccagggtagctagaaaggctggtcaccaccagacagcctacaatgctctccttaatgcaggggaatcacgactcgctgaactgtacgtggaaagggcaaagtggctctggtccaagggtgatgttcaccaggcactaattgttcttcaaaaaggtgttgaattatgttttcctgaaaatgaaaccccacctgagggtaagaacatgttaatccatggtcgagctatgctactagtgggccgatttatggaagaaacagctaactttgaaagcaatgcaattatgaaaaaatataaggatgtgaccgcgtgcctgccagaatgggaggatgggcatttttaccttgccaagtactatgacaaattgatgcccatggtcacagacaacaaaatggaaaagcaaggtgatctcatccggtatatagttcttcattttggcagatctctacaatatggaaatcagttcatatatcagtcaatgccacgaatgttaactctatggcttgattatggtacaaaggcatatgaatgggaaaaagctggccgctccgatcgtgtacaaatgaggaatgatttgggtaaaataaacaaggttatcacagagcatacaaactatttagctccatatcaatttttgactgctttttcacaattgatctctcgaatttgtcattctcacgatgaagtttttgttgtcttgatggaaataatagccaaagtatttctagcctatcctcaacaagcaatgtggatgatgacagctgtgtcaaagtcatcttatcccatgcgtgtgaacagatgcaaggaaatcctcaataaagctattcatatgaaaaaatccttagagaagtttgttggagatgcaactcgcctaacagataagcttctagaattgtgcaataaaccggttgatggaagtagttccacattaagcatgagcactcattttaaaatgcttaaaaagctggtagaagaagcaacatttagtgaaatcctcattcctctacaatcagtcatgatacctacacttccatcaattctgggtacccatgctaaccatgctagccatgaaccatttcctggacattgggcctatattgcagggtttgatgatatggtggaaattcttgcttctcttcagaaaccaaagaagatttctttaaaaggctcagatggaaagttctacatcatgatgtgtaagccaaaagatgacctgagaaaggattgtagactaatggaattcaattccttgattaataagtgcttaagaaaagatgcagagtctcgtagaagagaacttcatattcgaacatatgcagttattccactaaatgatgaatgtgggattattgaatgggtgaacaacactgctggtttgagacctattctgaccaaactatataaagaaaagggagtgtatatgacaggaaaagaacttcgccagtgtatgctaccaaagtcagcagctttatctgaaaaactcaaagtattccgagaatttctcctgcccaggcatcctcctatttttcatgagtggtttctgagaacattccctgatcctacatcatggtacagtagtagatcagcttactgccgttccactgcagtaatgtcaatggttggttatattctggggcttggagaccgtcatggtgaaaatattctctttgattctttgactggtgaatgcgtacatgtagatttcaattgtcttttcaataagggagaaacctttgaagttccagaaattgtgccatttcgcctgactcataatatggttaatggaatgggtcctatgggaacagagggtctttttcgaagagcatgtgaagttacaatgaggctgatgcgtgatcagcgagagcctttaatgagtgtcttaaagacttttctacatgatcctcttgtggaatggagtaaaccagtgaaagggcattccaaagcgccactgaatgaaactggagaagttgtcaatgaaaaggccaagacccatgttcttgacattgagcagcgactacaaggtgtaatcaagactcgaaatagagtgacaggactgccgttatctattgaaggacatgtgcattaccttatacaagaagctactgatgaaaacttactatgccagatgtatcttggttggactccatatatgtgaaatgaaattatgtaaaagaatatgttaataatctaaaagtaatgcatttggtatgaatctgtggttgtatctgttcaattctaaagtacaacataaatttacgttctcagcaactgttatttctctctgatcattaattatatgtaaaataatatacattcagttattaagaaataaactgctttcttaataaaaaaaaaaaaaaaaaaaaaaaaaaaaaaaaaa

SEQ ID NO: 569 - DNA, 897 bp, Homo sapiens
  ref <308>: DATABASE ACCESSION NUMBER: NM_001185
  ref <309>: DATABASE ENTRY DATE: 2001-06-18
atggtaagaatggtgcctgtcctgctgtctctgctgctgcttctgggtcctgctgtcccccaggagaaccaagatggtcgttactctctgacctatatctacactgggctgtccaagcatgttgaagacgtccccgcgtttcaggcccttggctcactcaatgacctccagttctttagatacaacagtaaagacaggaagtctcagcccatgggactctggagacaggtggaaggaatggaggattggaagcaggacagccaacttcagaaggccagggaggacatctttatggagaccctgaaagacattgtggagtattacaacgacagtaacgggtctcacgtattgcagggaaggtttggttgtgagatcgagaataacagaagcagcggagcattctggaaatattactatgatggaaaggactacattgaattcaacaaagaaatcccagcctgggtccccttcgacccagcagcccagataaccaagcagaagtgggaggcagaaccagtctacgtgcagcgggccaaggcttacctggaggaggagtgccctgcgactctgcggaaatacctgaaatacagcaaaaatatcctggaccggcaagatcctccctctgtggtggtcaccagccaccaggccccaggagaaaagaagaaactgaagtgcctggcctacgacttctacccagggaaaattgatgtgcactggactcgggccggcgaggtgcaggagcctgagttacggggagatgttcttcacaatggaaatggcacttaccagtcctgggtggtggtggcagtgcccccgcaggacacagccccctactcctgccacgtgcagcacagcagcctggcccagcccctcgtggtgccctgggaggccagctag

SEQ ID NO: 570 - DNA, 2032 bp, Homo sapiens
  ref <308>: DATABASE ACCESSION NUMBER: NM_001203
  ref <309>: DATABASE ENTRY DATE: 2001-06-18
cgcggggcgcggagtcggcggggcctcgcgggacgcgggcagtgcggagaccgcggcgctgaggacgcgggagccgggagcgcacgcgcggggtggagttcagcctactctttcttagatgtgaaaggaaaggaagatcatttcatgccttgttgataaaggttcagacttctgctgattcataaccatttggctctgagctatgacaagagaggaaacaaaaagttaaacttacaagcctgccataagtgagaagcaaacttccttgataacatgcttttgcgaagtgcaggaaaattaaatgtgggcaccaagaaagaggatggtgagagtacagcccccaccccccgtccaaaggtcttgcgttgtaaatgccaccaccattgtccagaagactcagtcaacaatatttgcagcacagacggatattgtttcacgatgatagaagaggatgactctgggttgcctgtggtcacttctggttgcctaggactagaaggctcagattttcagtgtcgggacactcccattcctcatcaaagaagatcaattgaatgctgcacagaaaggaacgaatgtaataaagacctacaccctacactgcctccattgaaaaacagagattttgttgatggacctatacaccacagggctttacttatatctgtgactgtctgtagtttgctcttggtccttatcatattattttgttacttccggtataaaagacaagaaaccagacctcgatacagcattgggttagaacaggatgaaacttacattcctcctggagaatccctgagagacttaattgagcagtctcagagctcaggaagtggatcaggcctccctctgctggtccaaaggactatagctaagcagattcagatggtgaaacagattggaaaaggtcgctatggggaagtttggatgggaaagtggcgtggcgaaaaggtagctgtgaaagtgttcttcaccacagaggaagccagctggttcagagagacagaaatatatcagacagtgttgatgaggcatgaaaacattttgggtttcattgctgcagatatcaaagggacagggtcctggacccagttgtacctaatcacagactatcatgaaaatggttccctttatgattatctgaagtccaccaccctagacgctaaatcaatgctgaagttagcctactcttctgtcagtggcttatgtcatttacacacagaaatctttagtactcaaggcaaaccagcaattgcccatcgagatctgaaaagtaaaaacattctggtgaagaaaaatggaacttgctgtattgctgacctgggcctggctgttaaatttattagtgatacaaatgaagttgacataccacctaacactcgagttggcaccaaacgctatatgcctccagaagtgttggacgagagcttgaacagaaatcacttccagtcttacatcatggctgacatgtatagttttggcctcatcctttgggaggttgctaggagatgtgtatcaggaggtatagtggaagaataccagcttccttatcatgacctagtgcccagtgacccctcttatgaggacatgagggagattgtgtgcatcaagaagttacgcccctcattcccaaaccggtggagcagtgatgagtgtctaaggcagatgggaaaactcatgacagaatgctgggctcacaatcctgcatcaaggctgacagccctgcgggttaagaaaacacttgccaaaatgtcagagtcccaggacattaaactctgataggagaggaaaagtaagcatctctgcagaaagccaacaggtactcttctgtttgtgggcagagcaaaagacatcaaataagcatccacagtacaagccttgaacatcgtcctgcttcccagtgggttcagacctcacctttcagggagcgacctgggcaaagacagagaagctcccagaaggagagattgatccgtgtctgtttgtaggcggagaaaccgttgggtaacttgttcaagatatgatgcat

SEQ ID NO: 571 - DNA, 3898 bp, Homo sapiens
  ref <308>: DATABASE ACCESSION NUMBER: NM_001204
  ref <309>: DATABASE ENTRY DATE: 2001-06-18
cgccccccgaccccggatcgaatccccgccctccgcaccctggatatgttttctcccagacctggatatttttttgatatcgtgaaactacgagggaaataatttgggggatttcttcttggctccctgctttccccacagacataccttccgtttggagggccgcggcaccccgtccgaggcgaaggaacccccccatccgcgagggagagaaatgaagggaatttctgcagcggcatgaaagctctgcagctaggtcctctcatcagccatttgtcctttcaaactgtattgtgatacgggcaggatcagtccacgggagagaagacgagcctcccggctgtttctccgccggtctacttcccatatttcttttctttgccctcctgattcttggctggcccagggatgacttcctcgctgcagcggccctggcgggtgccctggctaccatggaccatcctgctggtcagcactgcggctgcttcgcagaatcaagaacggctatgtgcgtttaaagatccgtatcagcaagaccttgggataggtgagagtagaatctctcatgaaaatgggacaatattatgctcgaaaggtagcacctgctatggcctttgggagaaatcaaaaggggacataaatcttgtaaaacaaggatgttggtctcacattggagatccccaagagtgtcactatgaagaatgtgtagtaactaccactcctccctcaattcagaatggaacataccgtttctgctgttgtagcacagatttatgtaatgtcaactttactgagaattttccacctcctgacacaacaccactcagtccacctcattcatttaaccgagatgagacaataatcattgctttggcatcagtctctgtattagctgttttgatagttgccttatgctttggatacagaatgttgacaggagaccgtaaacaaggtcttcacagtatgaacatgatggaggcagcagcatccgaaccctctcttgatctagataatctgaaactgttggagctgattggccgaggtcgatatggagcagtatataaaggctccttggatgagcgtccagttgctgtaaaagtgttttcctttgcaaaccgtcagaattttatcaacgaaaagaacatttacagagtgcctttgatggaacatgacaacattgcccgctttatagttggagatgagagagtcactgcagatggacgcatggaatatttgcttgtgatggagtactatcccaatggatctttatgcaagtatttaagtctccacacaagtgactgggtaagctcttgccgtcttgctcattctgttactagaggactggcttatcttcacacagaattaccacgaggagatcattataaacctgcaatttcccatcgagatttaaacagcagaaatgtcctagtgaaaaatgatggaacctgtgttattagtgactttggactgtccatgaggctgactggaaatagactggtgcgcccaggggaggaagataatgcagccataagcgaggttggcactatcagatatatggcaccagaagtgctagaaggagctgtgaacttgagggactgtgaatcagctttgaaacaagtagacatgtatgctcttggactaatctattgggagatatttatgagatgtacagacctcttcccaggggaatccgtaccagagtaccagatggcttttcagacagaggttggaaaccatcccacttttgaggatatgcaggttctcgtgtctagggaaaaacagagacccaagttcccagaagcctggaaagaaaatagcctggcagtgaggtcactcaaggagacaatcgaagactgttgggaccaggatgcagaggctcggcttactgcacagtgtgctgaggaaaggatggctgaacttatgatgatttgggaaagaaacaaatctgtgagcccaacagtcaatccaatgtctactgctatgcagaatgaacgcaacctgtcacataataggcgtgtgccaaaaattggtccttatccagattattcttcctcctcatacattgaagactctatccatcatactgacagcatcgtgaagaatatttcctctgagcattctatgtccagcacacctttgactataggggaaaaaaaccgaaattcaattaactatgaacgacagcaagcacaagctcgaatccccagccctgaaacaagtgtcaccagcctctccaccaacacaacaaccacaaacaccacaggactcacgccaagtactggcatgactactatatctgagatgccatacccagatgaaacaaatctgcataccacaaatgttgcacagtcaattgggccaacccctgtctgcttacagctgacagaagaagacttggaaaccaacaagctagacccaaaagaagttgataagaacctcaaggaaagctctgatgagaatctcatggagcactctcttaaacagttcagtggcccagacccactgagcagtactagttctagcttgctttacccactcataaaacttgcagtagaagcaactggacagcaggacttcacacagactgcaaatggccaagcatgtttgattcctgatgttctgcctactcagatctatcctctccccaagcagcagaaccttcccaagagacctactagtttgcctttgaacaccaaaaattcaacaaaagagccccggctaaaatttggcagcaagcacaaatcaaacttgaaacaagtcgaaactggagttgccaagatgaatacaatcaatgcagcagaacctcatgtggtgacagtcaccatgaatggtgtggcaggtagaaaccacagtgttaactcccatgctgccacaacccaatatgccaataggacagtactatctggccaaacaaccaacatagtgacacatagggcccaagaaatgttgcagaatcagtttattggtgaggacacccggctgaatattaattccagtcctgatgagcatgagcctttactgagacgagagcaacaagctggccatgatgaaggtgttctggatcgtcttgtggacaggagggaacggccactagaaggtggccgaactaattccaataacaacaacagcaatccatgttcagaacaagatgttcttgcacagggtgttccaagcacagcagcagatcctgggccatcaaagcccagaagagcacagaggcctaattctctggatctttcagccacaaatgtcctggatggcagcagtatacagataggtgagtcaacacaagatggcaaatcaggatcaggtgaaaagatcaagaaacgtgtgaaaactccctattctcttaagcggtggcgcccctccacctgggtcatctccactgaatcgctggactgtgaagtcaacaataatggcagtaacagggcagttcattccaaatccagcactgctgtttaccttgcagaaggaggcactgctacaaccatggtgtctaaagatataggaatgaactgtctgtgaaatgttttcaagcctatggagtgaaattattttttgcatcatttaaacatgcagaagatgtttaccgggcggggtgacaggagagagcgtcagcggcaagctgtggaggatggggctcagaatgcagacctgggctggccgcatggcctctccctgagccctgatttgtggtagggaagcagtatgggtgcagtcccctcctaggcctccctctggggtcccccgatcctatcccacctcttcagggtgagccagcctcacctcttcctagtcctgagggtgagggcaggctgaggcaacgagtgggaggttcaaacaagagtgggctggagccaagggaaaatagagatgatgtaatttctttccggaattc

SEQ ID NO: 572 - DNA, 4859 bp, Homo sapiens
  ref <308>: DATABASE ACCESSION NUMBER: NM_001206
  ref <309>: DATABASE ENTRY DATE: 2001-06-18
cacgttgggtgacataatggggtttttttaattatagattcacactgcatttattcatcacccctgtcctctcatccataactcaaatttactaccagcaacacaaaatacaaagatgtgtccagtttcactacagctcttcgcgtttacaagtgtcgagcgcttgctttcggaacgcccttgtgattggccgagccaatgccagtgacatcaaccaacttacttttgattggaaggctggttgctgggactgtagcgtttgcaggaagtcacttaactgtttgggagctggaaaaccgaagctgaagttctcttttgccataggaacgagcgcaactgactaggaaagatgtgtcccaaagctccgcaagctggaacgtgagccaggaggcccggaccggccacgggaccgcgaggcactccgaaagtgtgcggctgccccttccctgcctcccagctgttacccttttaaatgtcagtgttcgaggctgtaggggtagcacgaggcagcgaaacggaacagtcggattggccgcacgcctcagttctagacgcacctctccaccgaagccgttctgactggcagggggagaaagtaaacagagttgaatcaccctccccactggccaattggagggggtttggtttgtgacgtgatgggattctgcgaaattgttactgagcaagagaatgccggaacgtgcggaccggccggagcaggggttcagaagccgtcagtggactcgggaaaaagtgtctcttagacctggcgctcggcggggccctcgccacccgcgtcggggtgatcgggtgaatgtcctggggctttggctcgacggcgaggcggccgagggcgtgcacctctcttgcagtttcctctcccagcgcctcgggggcgttttcagtcgaataaacttgcgaccgccacgtgtggcatctttccaagggagccggctcagaggggccggcgcgcccgtcgggggatcgcggccggcgcggggcaggggcggcggctagaggcggcggcgcggcggagcccggggccgtggatgctgcgtgcggaggcgctgccggttacgtaaagatgaggggctgaggtcgcctcggcgctcctgcgagtcggaagcgccccgcgcccccgcccccttggccgccgcgccgtgccgggcgggcgggtcgtcgtccgaggccagggagggcgagccgaacctccgcagccaccgccaagtttgtccgcgccgcctgggctgccgtcgcccgcaccatgtccgcggccgcctacatggacttcgtggctgcccagtgtctggtttccatttcgaaccgcgctgcggtgccggagcatggggtcgctccggacgccgagcggctgcgactacctgagcgcgaggtgaccaaggagcacggtgacccgggggacacctggaaggattactgcacactggtcaccatcgccaagagcttgttggacctgaacaagtaccgacccatccagaccccctccgtgtgcagcgacagtctggaaagtccagatgaggatatgggatccgacagcgacgtgaccaccgaatctgggtcgagtccttcccacagcccggaggagagacaggatcctggcagcgcgcccagcccgctctccctcctccatcctggagtggctgcgaaggggaaacacgcctccgaaaagaggcacaagtgcccctacagtggctgtgggaaagtctatggaaaatcctcccatctcaaagcccattacagagtgcatacaggtgaacggcccttcccctgcacgtggccagactgccttaaaaagttctcccgctcagacgagctgacccgccactaccggacccacactggggaaaagcagttccgctgtccgctgtgtgagaagcgcttcatgaggagtgaccacctcacaaagcacgcccggcggcacaccgagttccaccccagcatgatcaagcgatcgaaaaaggcgctggccaacgctttgtgaggtgctgcccgtggaagccagggagggatggaccccgaaaggacaaaagtactcccaggaaacagacgcgtgaaaactgagccccagaagaggcacacttgacggcacaggaagtcactgctctttggtcaatattctgattttcctctccctgcattgtttttaaaaagcacattgtagcctaagatcaaagtcaacaacactcggtccccttgaagaggcaactctctgaacccgtctctgactgttggagggaaggcaaatgcttttgggttttttggtttttgtttttgtttttttttctccttttatttttttgcgggggagggtagggagtgggtgggggggagggggtaaggccaagactgggtagattttaaagattcaacactggtgtacatatgtccgctgggtgagttgacctgtggcctcgcacagtgattctaggccctttatgcttgctgtctctcagaattgttttcttaccttttaatgtaatgacgagtgtgcttcagtttgtttagcaaaaccactctcttgaatcacgttaacttttgagattaaaaaaaaaaacgccatagcacagctgtctttatgcaagcaagagcacatctactccagcatgatctgtcatctaaagacttgaaaacaaaaaacagttacttatagtcaatgggtaagcagagtctgaatttatactaatcaagacaaacctttgaaaggttacactaagtacagaacttttaaaccttgctttgtatgagttgtactttttgaacataagctgcacttttattttctaatgcagaggatgaataagttaaatacatgctttgaggatagaagcagatgttctgtttggcaccacgttataatctgcttattttacaatatacacgtttccctaagaaatcatgcgcagagatgtgagggcagaatatacacaacagatgctgaaggagaaggagggtagtgttttgcaaaagaaaaagaaaagaaccaacagaattttaactctattaacttttccaaattttcctatgcttttagttaacatcattattgtatcctaatgccactaggggagagagcttttgactctgttgggttttatttgaatgtgtgcataacagtaatgagatctggaaacacctattttttggggaaaaaggtttgttggtctccttcctgtgttcctacaaaactcccactctcaggtgcaagagttatgtagaaggaaagggagctgaaataggaacagaaaaatcaacccctataactagtgaacaccaagggaaaataccacaatgatttcagaggagactctgcaaaatcgtcccttgtggagaatgcaggcaacatggaatactacgaatgaaatcacatcactgtatcttttacatcaatagcctcaccactaatatatcttgtatctaggtgtctataatggctgaaaccactacatccatctatgccatttacctgaaaacttaactgtggcctttatgaggccagaaaagtgaactgagttttgtagttaagacctcaaatgaggggagtcagcagtgatcatgggggaaatgtttacattttttttttcttcagaagtaacgctttctgatgattttatctgatatttaaaacagggagctatggtgcactctagtttatacttgcgctctgaaatgtgtaaacatagggtgcctacctatttcacctgacccatactcgtttctgattcagaatcagtgtgggctcctgcagtgggcgcgggtcacggctgactccaacttccaatacaacagccatcactagcacagtgtttttttgtttaaccaacgtagtgttattagtagttctataaagagaactgcttttaacattagggactgggagcagtccatgggataaaaaggaaagtgttttctcacgagaaaacatgtcaggaaaaataaagaacactttctacctctgtttcagatttttgaaacacttattttaaaccaaattttaatttctgtgtccaaaataagttttaaggacatctgttcttccatacgaaataggttaggctgcctatttctcactgagctcatggaatggttctgcttatgatactctgcacgctgccttttagtgagtgaggagtttggggttgcctagcacttgctaacttgtaaaaagtcatctttccctcacagaaagaaacgaaagaaagcaaagcaaagtcagtgaaagacaatctttatagtttcaggagtaaatctaaatgtggcttttgtcaagcacttagatggatataaatgcagcaacttgttttaaaaaaatgcacatttacttcccaaaaaagttgttacttgccttttcaagtgtgacaaactcacatttgatattctcttatatgttatagtaatgtaacgtataaactcaagcctttttattctttgtgattaaatcctgttttaaaatgtcacaaaacaggaaccagcattctaattagatttactatatcaagatatggttcaaataggactactagagttcattgaacactaaaactatgaaacaattactttttatattaaaaagaccatggatttaacttatgaaaatccaaatgcaggatagtaatttttgtttacttttttaaccaaactgaatttttgaaagactattgcaggtgtttaaaaagaaagaaaagttgttttatctaatactgtaagtagttgtcatattctggaaaatttaatagttttagagttaagatatctcctctctttggttagggaagaagaaagcccttcaccattgtggaatgatgccctggctttaaggtttagctccacatcatgcttctctt

SEQ ID NO: 573 - DNA, 477 bp, Homo sapiens
  ref <308>: DATABASE ACCESSION NUMBER: NM_001207
  ref <309>: DATABASE ENTRY DATE: 2001-06-18
atgcgacggacaggcgcacccgctcaggctgactctcgggggcgaggtcgagccaggggcggctgccctgggggcgaggcgacgctgtctcaacctccacctcgcggcggaacccgaggagaggagcctcagatgaaagaaacaatcatgaaccaggaaaaactcgccaaactgcaggcacaagtgcgcattggtgggaaagtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccaggaggcttccaagaatga

SEQ ID NO: 574 - DNA, 1552 bp, Homo sapiens
  ref <308>: DATABASE ACCESSION NUMBER: NM_001216
  ref <309>: DATABASE ENTRY DATE: 2001-06-18
gcccgtacacaccgtgtgctgggacaccccacagtcagccgcatggctcccctgtgccccagcccctggctccctctgttgatcccggcccctgctccaggcctcactgtgcaactgctgctgtcactgctgcttctgatgcctgtccatccccagaggttgccccggatgcaggaggattcccccttgggaggaggctcttctggggaagatgacccactgggcgaggaggatctgcccagtgaagaggattcacccagagaggaggatccacccggagaggaggatctacctggagaggaggatctacctggagaggaggatctacctgaagttaagcctaaatcagaagaagagggctccctgaagttagaggatctacctactgttgaggctcctggagatcctcaagaaccccagaataatgcccacagggacaaagaaggggatgaccagagtcattggcgctatggaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtgtgcaactgaccctgcctcctgggctagagatggctctgggtcccgggcgggagtaccgggctctgcagctgcatctgcactggggggctgcaggtcgtccgggctcggagcacactgtggaaggccaccgtttccctgccgagatccacgtggttcacctcagcaccgcctttgccagagttgacgaggccttggggcgcccgggaggcctggccgtgttggccgcctttctggaggagggcccggaagaaaacagtgcctatgagcagttgctgtctcgcttggaagaaatcgctgaggaaggctcagagactcaggtcccaggactggacatatctgcactcctgccctctgacttcagccgctacttccaatatgaggggtctctgactacaccgccctgtgcccagggtgtcatctggactgtgtttaaccagacagtgatgctgagtgctaagcagctccacaccctctctgacaccctgtggggacctggtgactctcggctacagctgaacttccgagcgacgcagcctttgaatgggcgagtgattgaggcctccttccctgctggagtggacagcagtcctcgggctgctgagccagtccagctgaattcctgcctggctgctggtgacatcctagccctggtttttggcctcctttttgctgtcaccagcgtcgcgttccttgtgcagatgagaaggcagcacagaaggggaaccaaagggggtgtgagctaccgcccagcagaggtagccgagactggagcctagaggctggatcttggagaatgtgagaagccagccagaggcatctgagggggagccggtaactgtcctgtcctgctcattatgccacttccttttaactgccaagaaattttttaaaataaatatttataat

SEQ ID NO: 575 - DNA, 2775 bp, Homo sapiens
  ref <308>: DATABASE ACCESSION NUMBER: NM_001218
  ref <309>: DATABASE ENTRY DATE: 2001-06-18
gtactcgccacggcacccaggctgcgcgcacgcggtcccggtgtgcagctggagagcgagcggccaccgggagcccccggcacagcccgcgcccgccccgcaggagcccgcgaagatgccccggcgcagcctgcacgcggcggccgtgctcctgctggtgatcttaaaggaacagccttccagcccggccccagtgaacggttccaagtggacttattttggtcctgatggggagaatagctggtccaagaagtacccgtcgtgtgggggcctgctgcagtcccccatagacctgcacagtgacatcctccagtatgacgccagcctcacgcccctcgagttccaaggctacaatctgtctgccaacaagcagtttctcctgaccaacaatggccattcagtgaagctgaacctgccctcggacatgcacatccagggcctccagtctcgctacagtgccacgcagctgcacctgcactgggggaacccgaatgacccgcacggctctgagcacaccgtcagcggacagcacttcgccgccgagctgcacattgtccattataactcagacctttatcctgacgccagcactgccagcaacaagtcagaaggcctcgctgtcctggctgttctcattgagatgggctccttcaatccgtcctatgacaagatcttcagtcaccttcaacatgtaaagtacaaaggccaggaagcattcgtcccgggattcaacattgaagagctgcttccggagaggaccgctgaatattaccgctaccgggggtccctgaccacacccccttgcaaccccactgtgctctggacagttttccgaaaccccgtgcaaatttcccaggagcagctgctggctttggagacagccctgtactgcacacacatggacgacccttcccccagagaaatgatcaacaacttccggcaggtccagaagttcgatgagaggctggtatacacctccttctcccaagtgcaagtctgtactgcggcaggactgagtctgggcatcatcctctcactggccctggctggcattcttggcatctgtattgtggtggtggtgtccatttggcttttcagaaggaagagtatcaaaaaaggtgataacaagggagtcatttacaagccagccaccaagatggagactgaggcccacgcttgaggtccccggagctcccgggcacatccaggaaggaccttgctttggaccctacacacttcggctctctggacacttgcgacacctcaaggtgttctctgtagctcaatctgcaaacatgccaggcctcagggatcctctgctgggtgcctccttgccttgggaccatggccaccccagagccatccgatcgatggatgggatgcactctcagaccaagcagcaggaattcaaagctgcttgctgtaactgtgtgagattgtgaagtggtctgaattctggaatcacaaaccaagccatgctggtgggccattaatggttggaaaacactttcatccggggctttgccagagcgtgctttcaagtgtcctggaaagtctgctgcttctccaagctttcagacaagaatgtgcactctctgcttaggttttgcttgggaaactcaacttctttcctctggagacggggcatctccctctgatttccttctgctatgacaaaacctttaatctgcaccttacaactcggggacaaatggggacaggaaggatcaagttgtagagagaaaaaagaaaacaagagatatacattgtgatatattagggacactttcacagtcctgtcctctggatcacagacactgcacagaccttagggaatggcaggttcaagttccacttcttggtggggatgagaagggagagagagctagagggacaaagagaatgagaagacatggatgatctgggagagtctcactttggaatcagaattggaatcacattctgtttatcaagccataatgtaaggacagaataatacaatattaagtccaaatccaacctcctgtcagtggagcagttatgttttatactctacagattttacaaataatgaggctgttccttgaaaatgtgttgttgctgtgtcctggaggagacatgagttccgagatgacccaatctgcctttgaatctggaggaaataggcagaaacaaaatgactgtagaacttattctctgtaggccaaatttcatttcagccacttctgcaggatccctactgccaacctggaatggagacttttatctacttctctctctctgaagatgtcaaatcgtggtttagatcaaatatatttcaagctataaaagcaggaggttatctgtgcagggggctggcatcatgtatttaggggcaagtaataatggaatgctactaagatactccatattcttccccgaatcacacagacagtttctgacaggcgcaactcctccattttcctcccgcaggtgagaaccctgtggagatgagtcagtgccatgactgagaaggaaccgacccctagttgagagcaccttgcagttccccgagaactttctgattcacagtctcattttgacagcatgaaatgtcctcttgaagcatagctttttaaatatctttttccttctactcctccctctgactctaagaattctctcttctggaatcgcttgaacccaggaggcggaggttgcagtaagccaaggtcatgccactgcactctagcctgggtgacagagcgagactccatctcaaaaaaaaaaaaaaaa

SEQ ID NO: 576 - DNA, 1185 bp, Homo sapiens
  ref <308>: DATABASE ACCESSION NUMBER: NM_001223
  ref <309>: DATABASE ENTRY DATE: 2001-06-18
atggccgacaaggtcctgaaggagaagagaaagctgtttatccgttccatgggtgaaggtacaataaatggcttactggatgaattattacagacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgcgggcagg

SEQ ID NO: 577 - DNA, 1291 bp, Homo sapiens
  ref <308>: DATABASE ACCESSION NUMBER: NM_001225
  ref <309>: DATABASE ENTRY DATE: 2001-06-18
gctctttccaacgctgtaaaaaaggacagaggctgttccctatggcagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaagctcatccgaatatggaggctggaccacctgagtcaggagaatctacagatgccctcaagctttgtcctcatgaagaattcctgagactatgtaaagaaagagctgaagagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtgcaaaccgtggggaactgtgggtcagagactctccagcatccttggaagtggcctcttcacagtcatctgagaacctggaggaagatgctgtttacaagacccacgtggagaaggacttcattgctttctgctcttcaacgccacacaacgtgtcctggagagacagcacaatgggctctatcttcatcacacaactcatcacatgcttccagaaatattcttggtgctgccacctagaggaagtatttcggaaggtacagcaatcatttgaaactccaagggccaaagctcaaatgcccaccatagaacgactgtccatgacaagatatttctacctctttcctggcaattgaaaatggaagccacaagcagcccagccctccttaatcaacttcaaggagcaccttcattagtacagcttgcatatttaacattttgtatttcaataaaagtgaagacaaaaaaaaaa

SEQ ID NO: 578 - DNA, 1321 bp, Homo sapiens
  ref <308>: DATABASE ACCESSION NUMBER: NM_001233
  ref <309>: DATABASE ENTRY DATE: 2001-06-18
ggccgcgcaccaaggctgcgatggggctggagacggagaaggcggacgtacagctcttcatggacgacgactcctacagccaccacagcggcctcgagtacgccgaccccgagaagttcgcggactcggaccaggaccgggatccccaccggctcaactcgcatctcaagctgggcttcgaggatgtgatcgcagagccggtgactacgcactcctttgacaaagtgtggatctgcagccatgccctctttgaaatcagcaaatacgtaatgtacaagttcctgacggtgttcctggccattcccctggccttcattgcgggaattctctttgccaccctcagctgtctgcacatctggattttaatgccttttgtaaagacctgcctaatggttctgccttcagtgcagacaatatggaagagtgtgacagatgttatcattgctccattgtgtacgagcgtaggacgatgcttctcttctgtcagcctgcaactgagccaggattgaatacttggaccccaggtctggagattgggatactgtaatacttctttgttattataacataaaagcaccactgttctgttcatttcctagctgttctaattaagaaaactattaagatgagcaaccacatttagaaatgtttattgacaggtcttttcaaataatgcttttctaattaatagccaaagatttcatatctaactttgtaaccagaattatacagtaagttgacaccacttagatttaaaggcagacagttttgctttagtacaatagtatacattttataatgatgaacttataatgattaagggacatttctataaaaatactacaatagttttatgcacaacttcccattaaaaatgagatttcttatttgtttgtctgtttttactctgggagtaatactttttaaattacctttacatatatagtcactggcatactgagaatatacaatgatcctggaaattgcagtaccaaaagcacacaacgattatagtaactataagatacaataaaccaaataaatgtgaaagtagattcatgaaaatgtattcctttaaaatattgttttcctacaggcctatttaacaagatgtttcattttctgtatattttgtagttaatataaatgttgctctaatcagattgcttaaaagcatttttattatatttatgttgttgaactaatatatgaaataagtaaatgtagctcccacaaggtaaacttcattggtaagattgcactgttctgattatgtaagcatttgtacatcttctttggaaataaaagataaaagagcgat

SEQ ID NO: 579 - DNA, 900 bp, Homo sapiens
  ref <308>: DATABASE ACCESSION NUMBER: NM_001236
  ref <309>: DATABASE ENTRY DATE: 2001-06-18
gtgccccgcgctccccgctagcatgtcgtcctgcagccgcgtggcgctggtgaccggggccaacaggggcatcggcttggccatcgcgcgcgaactgtgccgacagttctctggggatgtggtgctcaccgcgcgggacgtggcgcggggccaggcggccgtgcagcagctgcaggcggagggcctgagcccgcgcttccaccaactggacatcgacgacttgcagagcatccgcgccctgcgcgacttcctgcgcaaggagtacggggggctcaacgtactggtcaacaacgcggccgtcgccttcaagagtgatgatccaatgccctttgacattaaagctgagatgacactgaagacaaatttttttgccactagaaacatgtgcaacgagttactgccgataatgaaacctcatgggagagtggtgaatatcagtagtttgcagtgtttaagggcttttgaaaactgcagtgaagatctgcaggaaaggttccacagtgagacactcacagaaggagacctggtggatctcatgaaaaagtttgtggaggacacaaaaaatgaggtgcatgagagggaaggctggcccaactcaccttatggggtgtccaagttgggggtcacggtcttatcgaggatcctggccaggcgtctggatgagaagaggaaagctgacaggattctggtgaatgcgtgctgcccaggaccagtgaagacagacatggatgggaaagacagcatcaggactgtggaggagggggctgagacccctgtctacttggccctcttgcctccagatgccactgagccacaaggccagttggtccatgacaaagttgtgcaaaactggtaaacgtctgcttcggagcttgctgcttaataaatgttggtggaatg

SEQ ID NO: 580 - DNA, 1649 bp, Homo sapiens
  ref <308>: DATABASE ACCESSION NUMBER: NM_001237
  ref <309>: DATABASE ENTRY DATE: 2001-06-18
cggcagccagcctattctttggccgggtcggtgcgagtggtcggctgggcagagtgcacgctgcttggcgccgcaggtgatcccgccgtccactcccgggagcagtgatgttgggcaactctgcgccggggcctgcgacccgcgaggcgggctcggcgctgctagcattgcagcagacggcgctccaagaggaccaggagaatatcaacccggaaaaggcagcgcccgtccaacaaccgcggacccgggccgcgctggcggtactgaagtccgggaacccgcggggtctagcgcagcagcagaggccgaagacgagacgggttgcaccccttaaggatcttcctgtaaatgatgagcatgtcaccgttcctccttggaaagcaaacagtaaacagcctgcgttcaccattcatgtggatgaagcagaaaaagaagctcagaagaagccagctgaatctcaaaaaatagagcgtgaagatgccctggcttttaattcagccattagtttacctggacccagaaaaccattggtccctcttgattatccaatggatggtagttttgagtcaccacatactatggacatgtcaattgtattagaagatgaaaagccagtgagtgttaatgaagtaccagactaccatgaggatattcacacataccttagggaaatggaggttaaatgtaaacctaaagtgggttacatgaagaaacagccagacatcactaacagtatgagagctatcctcgtggactggttagttgaagtaggagaagaatataaactacagaatgagaccctgcatttggctgtgaactacattgataggttcctgtcttccatgtcagtgctgagaggaaaacttcagcttgtgggcactgctgctatgctgttagcctcaaagtttgaagaaatataccccccagaagtagcagagtttgtgtacattacagatgatacctacaccaagaaacaagttctgagaatggagcatctagttttgaaagtccttacttttgacttagctgctccaacagtaaatcagtttcttacccaatactttctgcatcagcagcctgcaaactgcaaagttgaaagtttagcaatgtttttgggagaattaagtttgatagatgctgacccatacctcaagtatttgccatcagttattgctggagctgcctttcatttagcactctacacagtcacgggacaaagctggcctgaatcattaatacgaaagactggatataccctggaaagtcttaagccttgtctcatggaccttcaccagacctacctcaaagcaccacagcatgcacaacagtcaataagagaaaagtacaaaaattcaaagtatcatggtgtttctctcctcaacccaccagagacactaaatctgtaacaatgaaagactgcctttgttttctaagatgtaaatcactcaaagtatatggtgtacagtttttaacttaggtttttaattttacaatcatttctgaatacagaagttgtggccaagtacaaattatggtatctattactttttaaatggttttaatttgtatatcttttgtatatgtatctgtcttagatatttggctaattttaagtggttttgttaaagtattaatgatgccagctgccg

SEQ ID NO: 581 - DNA, 1722 bp, Homo sapiens
  ref <308>: DATABASE ACCESSION NUMBER: NM_001251
  ref <309>: DATABASE ENTRY DATE: 2001-06-18
gcgggcggttcagccatgaggctggctgtgcttttctcgggggccctgctggggctactggcagcccaggggacagggaatgactgtcctcacaaaaaatcagctactttgctgccatccttcacggtgacacccacggttacagagagcactggaacaaccagccacaggactaccaagagccacaaaaccaccactcacaggacaaccaccacaggcaccaccagccacggacccacgactgccactcacaaccccaccaccaccagccatggaaacgtcacagttcatccaacaagcaatagcactgccaccagccagggaccctcaactgccactcacagtcctgccaccactagtcatggaaatgccacggttcatccaacaagcaacagcactgccaccagcccaggattcaccagttctgcccacccagaaccacctccaccctctccgagtcctagcccaacctccaaggagaccattggagactacacgtggaccaatggttcccagccctgtgtccacctccaagcccagattcagattcgagtcatgtacacaacccagggtggaggagaggcctggggcatctctgtactgaaccccaacaaaaccaaggtccagggaagctgtgagggtgcccatccccacctgcttctctcattcccctatggacacctcagctttggattcatgcaggacctccagcagaaggttgtctacctgagctacatggcggtggagtacaatgtgtccttcccccacgcagcaaagtggacattctcggctcagaatgcatcccttcgagatctccaagcacccctggggcagagcttcagttgcagcaactcgagcatcattctttcaccagctgtccacctcgacctgctctccctgaggctccaggctgctcagctgccccacacaggggtctttgggcaaagtttctcctgccccagtgaccggtccatcttgctgcctctcatcatcggcctgatccttcttggcctcctcgccctggtgcttattgctttctgcatcatccggagacgcccatccgcctaccaggccctctgagcatttgcttcaaaccccagggcactgagggggtttggggtgtggtgggggggtacccttatttcctcgacacgccgctggctcaaagacaatgttattttccttccctttcttgaagaacaaaaagaaagccgggcatgacggctcatgcctgtaatcccagcactttgggaggctgaggcaggtggatcactggaggtcaggtctttgaggccagccctagccaacatggtgtaaacactgtctctactaaaaatacaattagccaggtgtggcggcgtaatcccatgctaacctgtaatcccagctacttgggaggctgaggcagagctgcttgaaccctggaagtggaggttgcagtgagcctgtcatcgctccactgagccaagatcgctcccactgcactccagcctgggcgacagagccagactgtctcaaataaataaatatgagataatgcagtcgggagaagggagggagagaattttattaaatgtgacgaactgcccccccccccccccccagcaggagagcagcaaaatttatgtaaatctttgacggggttttccttgctcctgccaggattaaaagtccatgagtttcttgctcaaaaaaaaaaaaaaaaaaaaaaaaaaaaaaaaa

SEQ ID NO: 582 - DNA, 1686 bp, Homo sapiens
  ref <308>: DATABASE ACCESSION NUMBER: NM_001255
  ref <309>: DATABASE ENTRY DATE: 2001-06-18
ccacgcgtccgggcgtaagccaggcgtgttaaagccggtcggaactgctccggagggcacgggctccgtaggcaccaactgcaaggacccctccccctgcgggcgctcccatggcacagttcgcgttcgagagtgacctgcactcgctgcttcagctggatgcacccatccccaatgcaccccctgcgcgctggcagcgcaaagccaaggaagccgcaggcccggccccctcacccatgcgggccgccaaccgatcccacagcgccggcaggactccgggccgaactcctggcaaatccagttccaaggttcagaccactcctagcaaacctggcggtgaccgctatatcccccatcgcagtgctgcccagatggaggtggccagcttcctcctgagcaaggagaaccagtctgaaaacagccagacgcccaccaagaaggaacatcagaaagcctgggctttgaacctgaacggttttgatgtagaggaagccaagatccttcggctcagtggaaaaccacaaaatgcgccagagggttatcagaacagactgaaagtactctacagccaaaaggccactcctggctccagccggaagacctgccgttacattccttccctgccagaccgtatcctggatgcgcctgaaatccgaaatgactattacctgaaccttgtggattggagttctgggaatgtactggccgtggcactggacaacagtgtgtacctgtggagtgcaagctctggtgacatcctgcagcttttgcaaatggagcagcctggggaatatatatcctctgtggcctggatcaaagagggcaactacttggctgtgggcaccagcagtgctgaggtgcagctatgggatgtgcagcagcagaaacggcttcgaaatatgaccagtcactctgcccgagtgggctccctaagctggaacagctatatcctgtccagtggttcacgttctggccacatccaccaccatgatgttcgggtagcagaacaccatgtggccacactgagtggccacagccaggaagtgtgtgggctgcgctgggccccagatggacgacatttggccagtggtggtaatgataacttggtcaatgtgtggcctagtgctcctggagagggtggctgggttcctctgcagacattcacccagcatcaaggggctgtcaaggccgtagcatggtgtccctggcagtccaatgtcctggcaacaggagggggcaccagtgatcgacacattcgcatctggaatgtgtgctctggggcctgtctgagtgccgtggatgcccattcccaggtgtgctccatcctctggtctccccattacaaggagctcatctcaggccatggctttgcacagaaccagctagttatttggaagtacccaaccatggccaaggtggctgaactcaaaggtcacacatcccgggtcctgagtctgaccatgagcccagatggggccacagtggcatccgcagcagcagatgagaccctgaggctatggcgctgttttgagttggaccctgcgcggcggcgggagcgggagaaggccagtgcagccaaaagcagcctcatccaccaaggcatccgctgaagaccaacccatcacctcagttgttttttatttttctaataaagtcatgtctcccttcatgtttttttttttaaaa

SEQ ID NO: 583 - DNA, 2103 bp, Homo sapiens
  ref <308>: DATABASE ACCESSION NUMBER: NM_001262
  ref <309>: DATABASE ENTRY DATE: 2001-06-18
ctctgccgagcctccttaaaactctgccgttaaaatgggggcgggtttttcaactcaaaaagcgctcaatttttttcttttcaaaaaaagctgatgaggtcggaaaaaagggagaagaaaccggcaccctctctgagaggcaacagaagcagcaattgtttcagcgaaaaaagcagcaagggagggagtgaaggaaaaaagcaaaaaagggggcgacacgcaagtgcctgtaggggtgaaaggagcagggaccggcgatctagggggggatcagctacaaaagaaactgtcactgggagcggtgcggccaaggaggaagcagtgctgccaggctctgctccagggcacagctggctggcggctgccctgtccgcagcaaaggggcacaggccggggaccgcgagaggtggcaaagtggcaccgggcgccgaggctgctgagcgctcgccgagacgcggaccggactggctgccccggaactgcggcgactctccctactcagaacttggcctacgtttcccaggactctccccatctccagaggcccccacaaaaccgggaaaggaaggaaaggacagcggcggcagcagctcaatgagtgcctacagcagaaagcctgaacgagctcggtcgtaggcgggaagttcccgggggctgcccagtgcagccgcaatgctgccgcgagctgccccagcagtccgggctccgtagacgctttccgcatcactctccttcctcgggctgccgggagtcccgggacctggcggggccggcatgacgggcttctcgggggcccgccgcacgcccggcagcctccggagacgcgcgccgagcccggctcccacggcctctgaggctcggcggggctgcggctgcctggcgggcgggctccggagctttcctgagccggcattagcccacggcttggcccggacgcgaccaaaggctcttctggagaagcccagagcactgggcaatcgttacgacctgtaacttgagggccaccgaactgctactcccgttcgcctttggcgatcatcttttaaccctccggagcacgtcagcatccagccaccgcggcgctctcccagcagcggaggacccaggactatcccttcggcgagacggatggaaaccgagccccctggaggacctgcccctgcagttctgcctcacacggctcaagtcaccaccgtgaacaagggaccctaaagaatggccgagccttgggggaacgagttggcgtccgcagctgccaggggggacctagagcaacttactagtttgttgcaaaataatgtaaacgtcaatgcacaaaatggatttggaaggactgcgctgcaggttatgaaacttggaaatcccgagattgccaggagactgctacttagaggtgctaatcccgatttgaaagaccgaactggtttcgctgtcattcatgatgcggccagagcaggtttcctggacactttacagactttgctggagtttcaagctgatgttaacatcgaggataatgaagggaacctgcccttgcacttggctgccaaagaaggtcacctccgggtggtggagttcctggtgaagcacacggccagcaatgtggggcatcggaaccataagggggacaccgcctgtgatttggccaggctctatgggaggaatgaggttgttagcctgatgcaggcaaacggggctgggggagccacaaatcttcaataaacgtggggagggctcccccacgttgcctctactttatcaattaactgagtagctctcctgacttttaatgtcatttgttaaaatacagttctgtcatatgttaagcagctaaattttctgaaactgcataagtgaaaatcttacaacaggtttatgaatatatttaagcaacatctttttaacctgcaaaatctgttctaacatgtaattgcagataactttgactttcttctgaatattttatctttccttggcttttcccttgcttccccttttgccaatctcaacacccaagttgaagactttgtttttaaaatggtttgtcctgatgcttttgtctaattaaaacactttcaaaacaggaaaaaaaaaaaaaaaaaa

SEQ ID NO: 584 - DNA, 2356 bp, Homo sapiens
  ref <308>: DATABASE ACCESSION NUMBER: NM_001263
  ref <309>: DATABASE ENTRY DATE: 2001-06-18
gaattcggcacgagcggggcgggaggggcctgcgcggcggcgggagcccagagccgcgctaaagcgggtcaagcgtcctccttttctccccgccccttctcctcctcctacctgggcctctgcgtggagacgcgcacctggcaaccggaggccgcgtctccgccttctctgctcgcgcctggcgcccggagcctgcccgggacctccgccggagccgcgctcgctgcaggcggcctcgagcgctctctcgttgatgccgttttggaggtgaccggcgcggcggccgctctatggtggggccgcgttagtggctgcggctccgcgggactccagggcgcggctgcgaggtggcggggcgccccgcctgcagaaccctgcttgcagctcaggtttcggggtgcttgaggaggccgccacggcagcgcgggagcggaagatgttggagctgaggcaccggggaagctgccccggccccagggaagcggtgtcgccgccacaccgcgagggagaggcggccggcggcgaccacgaaaccgagagcaccagcgacaaagaaacagatattgatgacagatatggagatttggattccagaacagattctgatattccggaaattccaccatcctcagatagaacccctgagattctcaaaaaagctctatctggtttatcttcaaggtggaaaaactggtggatacgtggaattctcactctaactatgatctcgttgtttttcctgatcatctatatgggatccttcatgctgatgcttcttgttctgggcatccaagtgaaatgcttccatgaaattatcactataggttatagagtctatcattcttatgatctaccatggtttagaacactaagttggtactttctattgtgtgtaaactactttttctatggagagactgtagctgattattttgctacatttgttcaaagagaagaacaacttcagttcctcattcgctaccatagatttatatcatttgccctctatctggcaggtttctgcatgtttgtactgagtttggtgaagaaacattatcgtctgcagttttatatgttcgcatggactcatgtcactttactgataactgtcactcagtcacaccttgtcatccaaaatctgtttgaaggcatgatatggttccttgttccaatatcaagtgttatctgcaatgacataactgcttacctttttggatttttttttgggagaactccattaattaagttgtctcctaaaaagacttgggaaggattcattggtggtttcttttccacagttgtgtttggattcattgctgcctatgtgttatccaaataccagtactttgtctgcccagtggaataccgaagtgatgtaaactccttcgtgacagaatgtgagccctcagaacttttccagcttcagacttactcacttccaccctttctaaaggcagtcttgagacaggaaagagtgagcttgtaccctttccagatccacagcattgcactgtcaacctttgcatctttaattggcccatttggaggcttctttgctagtggattcaaaagagccttcaaaatcaaggattttgcaaataccattcctggacatggtgggataatggacagatttgattgtcagtatttgatggcaacttttgtacatgtgtacatcacaagttttatccggggcccaaatcccagcaaagtgctacagcagttgttggtgcttcaacctgaacagcagttaaatatatataaaccctgaagactcatctcattgagaaaggatcctacaacccaccttgaaggtataactggatccagagagggaaggactgacaagaaggaattattcagaaaaacactgacagatgttttataaattgtacagaaaaatagttaaaaatgcaataggttgaagttttccagatatgtttctctctgaaattactgtgaatatttaacaaacacttacttgatctatgttatgaaataagtagcaaattgccagcaaaatgtcttgtaccttttctaaagtgtattttctgatgtgaacttccttccccttacttgctaggtttcaataatttaaaagagtcaaacactataaatgagtaagttgacgatgttttaagattgcacctggcagtgtgcctttttgcaacaaatatttacctggcagtgtgcctttttgcaacaaatatttactttgcacttggagctgcttttaattttagcaaaatgttttatgcaaggcacaataggaagtcagttctcctgcacttcctcctcatgtagtctggagtactttctaaagggcttagttggatttaaaaaaaaaaaaaaaaaa

SEQ ID NO: 585 - DNA, 1789 bp, Homo sapiens
  ref <308>: DATABASE ACCESSION NUMBER: NM_001267
  ref <309>: DATABASE ENTRY DATE: 2001-06-18
tcgatgctccacgtaggagctggctcggctgccggctgcggtcagggccaccgtataaagagggcggcagacccgagcgcctaggactcgccgctgcccgcgccccgccgccgctgctgcccccagccccggccccaggcgtcccagccatggtccgcccaatgctcttgctcagcctcggcctcctggctggtctgctgccggcgctggccgcctgcccccagaactgccactgccacagcgacctgcagcacgtcatctgcgacaaggtggggctgcagaagatccccaaggtgtcagagaagaccaagctgctcaacctacagcgcaacaacttcccggtgctggctgccaattcgttccgggccatgccgaacctcgtgtcattgcacctgcagcactgccagatccgcgaggtggccgccggtgccttccgcggcctcaagcaacttatctacttgtacctgtcccataacgacatccgcgtcgtgcgtgccggtgccttcgacgacctgaccgagctgacctacctctacctggaccacaacaaggtcactgagctgccccgggggttgctctccccgctggtcaacctcttcatcttgcagctcaacaacaacaagatccgtgagctgcgcgcagggcccttccagggagccaaggacctgcgctggctctacctgtcggaaaacgcgttgagctccctgcagcccggggccctggacgacgtggagaacctcgccaaattccacgtggacaggaaccagctgtccagctacccctcagctgccctgagcaagctacgggtggtggaggagctgaagctgtcccacaaccccctgaaaagcatcccggacaatgccttccagtcctttggcagatacctggagaccctctggctggacaacaccaacctggagaagttctcagatggtgccttcctgggtgtaaccacgctgaaacacgtccatttggagaacaaccgcttgaaccagctaccctcgaacttccccttcgacagcctggagaccctcgcccttaccaataacccctggaagtgtacctgccagctccggggccttcggcggtggctggaagccaaggcctcccgcccagatgccacctgtgcctcacctgccaagttcaagggccagcacatccgtgacacggacgccttccgcagctgcaagttccccaccaagaggtccaagaaagctggccgccattaaacaggttctgacccagccagtcctggtgactggcctctgccttccaccggagagactactgaccttctcacctccgacccataccttctccccacagcctctgctgatgcacagagctgcctacacctagacacgtcctggcagggggcctcgggcactccactaccaacccagctccacccagcagtgtcctggggagaaggaaggctgagcctctccccagccttcatgccttccccaccctccagctcctcttggagaagctgttgctgagaccccccccccccccccaagtcaatcagaaccacaacaggttggtcatcaggatggccaccctcccaggatcatccttcctctgttctctttccctgccacgtggaaacaatcatcagatccttgccccaccccttgcttccagaaagggttttaaagcccatgccccaactctgccagcccccacctgccaggacgttctagcaggtcatcggtgctttgctgtccatcttcccatgctgcaatttcttcctgagatttctataaatataaatgtatgtatgtat

SEQ ID NO: 586 - DNA, 1994 bp, Homo sapiens
  ref <308>: DATABASE ACCESSION NUMBER: NM_001275
  ref <309>: DATABASE ENTRY DATE: 2001-06-18
gctgccaccgctcctgccactgcagtgctcgagccccgtgcaggggagcttgcgggaggatcgaccgacagacggacgcacgccgaggcactgcgcccccagccccgcgccggtgccaccgcagcccgaccccggccgccagtccagccgcccctcgcccggtgcctaggtgcccggccccacaccgccagctgctcggcgcccgggtccgccatgcgctccgccgctgtcctggctcttctgctctgcgccgggcaagtcactgcgctccctgtgaacagccctatgaataaaggggataccgaggtgatgaaatgcatcgttgaggtcatctccgacacactttccaagcccagccccatgcctgtcagccaggaatgttttgagacactccgaggagatgaacggatcctttccattctgagacatcagaatttactgaaggagctccaagacctcgctctccaaggcgccaaggagagggcacatcagcagaagaaacacagcggttttgaagatgaactctcagaggttcttgagaaccagagcagccaggccgagctgaaagaggcggtggaagagccatcatccaaggatgttatggagaaaagagaggattccaaggaggcagagaaaagtggtgaagccacagacggagccaggccccaggccctcccggagcccatgcaggagtccaaggctgaggggaacaatcaggcccctggggaggaagaggaggaggaggaggaggccaccaacacccaccctccagccagcctccccagccagaaatacccaggcccacaggccgagggggacagtgagggcctctctcagggtctggtggacagagagaagggcctgagtgcagagccagggtggcaggcaaagagagaagaggaggaggaggaggaggaggaggctgaggctggagaggaggctgtccccgaggaagaaggccccactgtagtgctgaacccccacccgagccttggctacaaggagatccggaaaggcgagagtcggtcggaggctctggctgtggatggagctgggaagcctggggctgaggaggctcaggaccccgaagggaagggagaacaggagcactcccagcagaaagaggaggaggaggagatggcagtggtcccgcaaggcctcttccggggtgggaagagcggagagctggagcaggaggaggagcggctctccaaggagtgggaggactccaaacgctggagcaagatggaccagctggccaaggagctgacggctgagaagcggctggaggggcaggaggaggaggaggacaaccgggacagttccatgaagctctccttccgggcccgggcctacggcttcaggggccctgggccgcagctgcgacgaggctggaggccatcctcccgggaggacagccttgaggcgggcctgcccctccaggtccgaggctaccccgaggagaagaaagaggaggagggcagcgcaaaccgcagaccagaggaccaggagctggagagcctgtcggccattgaagcagagctggagaaagtggcccaccagctgcaggcactacggcggggctgagacaccggctggcagggctggccccagggcaccctgtggccctggctctgctgtccccttggcaggtcctggccagatggcccggacgctgcttccggtagggaggcagcctccagcctgcccaagcccaggccaccctatcgccccctacgcgccttgtctcctactcctgactcctacctgccctggaacatcctttgcagggcagccccacaactttaaacattgacgattccttctctgaacacaggcagctttctagaagtttcccttcctccatcctatccactgggcacaactgcaataacttctgaccttttggtgaaagctgagaactcctgactgtaacatattctgtatgaactttatctaaagaaaaataaatctgttctgggctctttcctctg

SEQ ID NO: 587 - DNA, 1925 bp, Homo sapiens
  ref <308>: DATABASE ACCESSION NUMBER: NM_001276
  ref <309>: DATABASE ENTRY DATE: 2001-06-18
agtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggctttgtggtcctggtgctgctccagtgctgctctgcatacaaactggtctgctactacaccagctggtcccagtaccgggaaggcgatgggagctgcttcccagatgcccttgaccgcttcctctgtacccacatcatctacagctttgccaatataagcaacgatcacatcgacacctgggagtggaatgatgtgacgctctacggcatgctcaacacactcaagaacaggaaccccaacctgaagactctcttgtctgtcggaggatggaactttgggtctcaaagattttccaagatagcctccaacacccagagtcgccggactttcatcaagtcagtaccgccattcctgcgcacccatggctttgatgggctggaccttgcctggctctaccctggacggagagacaaacagcattttaccaccctaatcaaggaaatgaaggccgaatttataaaggaagcccagccagggaaaaagcagctcctgctcagcgcagcactgtctgcggggaaggtcaccattgacagcagctatgacattgccaagatatcccaacacctggatttcattagcatcatgacctacgattttcatggagcctggcgtgggaccacaggccatcacagtcccctgttccgaggtcaggaggatgcaagtcctgacagattcagcaacactgactatgctgtggggtacatgttgaggctgggggctcctgccagtaagctggtgatgggcatccccaccttcgggaggagcttcactctggcttcttctgagactggtgttggagccccaatctcaggaccgggaattccaggccggttcaccaaggaggcagggacccttgcctactatgagatctgtgacttcctccgcggagccacagtccatagaaccctcggccagcaggtcccctatgccaccaagggcaaccagtgggtaggatacgacgaccaggaaagcgtcaaaagcaaggtgcagtacctgaaggataggcagctggcaggcgccatggtatgggccctggacctggatgacttccagggctccttctgcggccaggatctgcgcttccctctcaccaatgccatcaaggatgcactcgctgcaacgtagccctctgttctgcacacagcacgggggccaaggatgccccgtccccctctggctccagctggccgggagcctgatcacctgccctgctgagtcccaggctgagcctcagtctccctcccttggggcctatgcagaggtccacaacacacagatttgagctcagccctggtgggcagagaggtagggatggggctgtggggatagtgaggcatcgcaatgtaagactcgggattagtacacacttgttgatgattaatggaaatgtttacagatccccaagcctggcaagggaatttcttcaactccctgccccctagccctccttatcaaaggacaccattttggcaagctctatcaccaaggagccaaacatcctacaagacacagtgaccatactaattataccccctgcaaagccagcttgaaaccttcacttaggaacgtaatcgtgtcccctatcctacttccccttcctaattccacagctgctcaataaagtacaagagtttaacagtgtgttggcgctttgctttggtctatctttgagcgcccactagacccactggactcacctcccccatctcttctgggttccttcctctgagccttgggacccctgagcttgcagagatgaaggccgccatgtt

SEQ ID NO: 588 - DNA, 1322 bp, Homo sapiens
  ref <308>: DATABASE ACCESSION NUMBER: NM_001280
  ref <309>: DATABASE ENTRY DATE: 2001-06-18
tagcttggcacgaggctcgggtcgttgtggtgcgctgtcttcccgcttgcgtcagggacctgcccgactcagtggccgccatggcatcagatgaaggcaaactttttgttggagggctgagttttgacaccaatgagcagtcgctggagcaggtcttctcaaagtacggacagatctctgaagtggtggttgtgaaagacagggagacccagagatctcggggatttgggtttgtcacctttgagaacattgacgacgctaaggatgccatgatggccatgaatgggaagtctgtagatggacggcagatccgagtagaccaggcaggcaagtcgtcagacaaccgatcccgtgggtaccgtggtggctctgccgggggccggggcttcttccgtgggggccgaggacggggccgtgggttctctagaggaggaggggaccgaggctatggggggaaccggttcgagtccaggagtgggggctacggaggctccagagactactatagcagccggagtcagagtggtggctacagtgaccggagctcgggcgggtcctacagagacagttacgacagttacgctacacacaacgagtaaaaacccttcctgctcaagatcgtccttccaatggctgtgtgtttaaagattgtgggagcttcgctgaacgttaatgtgtagtaaatgcacctccttgtattcccactttcgtagtcatttcggttctgatcttgtcaaacccagcctgaccgcttctgacgccgggatggcctcgttactagacttttctttttaaggaagtgctgtttttttttgagggttttcaaaacattttgaaaagcatttacttttttgaccacgagccatgagttttcaaaaaaatcgggggttgtgtgggtttttggtttttgttttagtttttggttgcgttgccttttttttttagtggggttggccccatgaagtgggtgccccactcacttctctgagatcgaacggactgtgaatccgctctttgtcggaagctgagcaagctgtggcttttttccaactccgtgtgacgtttctgagtgtagtgtggtaggacccggcgggtgtgcagcaactgccctggagccccagcccctgcgtccatctgtgctgtgcgccccacagtagacgtgcagacgtccctgagaggttcttgaagatgtttatttatattgtccttttttactggaagacgtacgcatactccatcgatgttgtatttgcagtggctgaggaattcttgtacgcagttttctttggctttacgagccgattaaaagaccgtgtgaaatg

SEQ ID NO: 589 - DNA, 5701 bp, Homo sapiens
  ref <308>: DATABASE ACCESSION NUMBER: NM_001282
  ref <309>: DATABASE ENTRY DATE: 2001-06-18
ctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctggtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaggcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtaggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacac

SEQ ID NO: 590 - DNA, 2156 bp, Homo sapiens
  ref <308>: DATABASE ACCESSION NUMBER: NM_001295
  ref <309>: DATABASE ENTRY DATE: 2001-06-18
ggcacgagcccagaaacaaagacttcacggacaaagtcccttggaaccagagagaagccgggatggaaactccaaacaccacagaggactatgacacgaccacagagtttgactatggggatgcaactccgtgccagaaggtgaacgagagggcctttggggcccaactgctgccccctctgtactccttggtatttgtcattggcctggttggaaacatcctggtggtcctggtccttgtgcaatacaagaggctaaaaaacatgaccagcatctacctcctgaacctggccatttctgacctgctcttcctgttcacgcttcccttctggatcgactacaagttgaaggatgactgggtttttggtgatgccatgtgtaagatcctctctgggttttattacacaggcttgtacagcgagatctttttcatcatcctgctgacgattgacaggtacctggccatcgtccacgccgtgtttgccttgcgggcacggaccgtcacttttggtgtcatcaccagcatcatcatttgggccctggccatcttggcttccatgccaggcttatacttttccaagacccaatgggaattcactcaccacacctgcagccttcactttcctcacgaaagcctacgagagtggaagctgtttcaggctctgaaactgaacctctttgggctggtattgcctttgttggtcatgatcatctgctacacagggattataaagattctgctaagacgaccaaatgagaagaaatccaaagctgtccgtttgatttttgtcatcatgatcatcttttttctcttttggaccccctacaatttgactatacttatttctgttttccaagacttcctgttcacccatgagtgtgagcagagcagacatttggacctggctgtgcaagtgacggaggtgatcgcctacacgcactgctgtgtcaacccagtgatctacgccttcgttggtgagaggttccggaagtacctgcggcagttgttccacaggcgtgtggctgtgcacctggttaaatggctccccttcctctccgtggacaggctggagagggtcagctccacatctccctccacaggggagcatgaactctctgctgggttctgactcagaccataggaggccaacccaaaataagcaggcgtgacctgccaggcacactgagccagcagcctggctctcccagccaggttctgactcttggcacagcatggagtcacagccacttgggatagagagggaatgtaatggtggcctggggcttctgaggcttctggggcttcagtcttttccatgaacttctcccctggtagaaagaagatgaatgagcaaaaccaaatattccagagactgggactaagtgtaccagagaagggcttggactcaagcaagatttcagatttgtgaccattagcatttgtcaacaaagtcacccacttcccactattgcttgcacaaaccaattaaacccagtagtggtgactgtgggctccattcaaagtgagctcctaagccatgggagacactgatgtatgaggaatttctgttcttccatcacctccccccccccgccaccctcccactgccaagaacttggaaatagtgatttccacagtgactccactctgagtcccagagccaatcagtagccagcatctgcctccccttcactcccaccgcaggatttgggctcttggaatcctggggaacatagaactcatgacggaagagttgagacctaacgagaaatagaaatgggggaactactgctggcagtggaactaagaaagcccttaggaagaatttttatatccactaaaatcaaacaattcagggagtgggctaagcacgggccatatgaataacatggtgtgcttcttaaaatagccataaaggggagggactcatcatttccatttacccttcttttctgactatttttcagaatctctcttcttttcaagttgggtgatatgttggtagattctaatggctttattgcagcgattaataacaggcaaaaggaagcagggttggtttcccttctttttgttcttcatctaagccttctggttttatgggtcagagttccgactgccatcttggacttgtcagcaaaaaaaaaaaaaaaaa

SEQ ID NO: 591 - DNA, 1665 bp, Homo sapiens
  ref <308>: DATABASE ACCESSION NUMBER: NM_001305
  ref <309>: DATABASE ENTRY DATE: 2001-06-18
gaaggaactggttctgctcacacttgctggcttgcgcatcaggactggctttatctcctgactcacggtgcaaaggtgcactctgcgaacgttaagtccgtccccagcgcttggaatcctacggcccccacagccggatcccctcagccttccaggtcctcaactcccgtggacgctgaacaatggcctccatggggctacaggtaatgggcatcgcgctggccgtcctgggctggctggccgtcatgctgtgctgcgcgctgcccatgtggcgcgtgacggccttcatcggcagcaacattgtcacctcgcagaccatctgggagggcctatggatgaactgcgtggtgcagagcaccggccagatgcagtgcaaggtgtacgactcgctgctggcactgccgcaggacctgcaggcggcccgcgccctcgtcatcatcagcatcatcgtggctgctctgggcgtgctgctgtccgtggtggggggcaagtgtaccaactgcctggaggatgaaagcgccaaggccaagaccatgatcgtggcgggcgtggtgttcctgttggccggccttatggtgatagtgccggtgtcctggacggcccacaacatcatccaagacttctacaatccgctggtggcctccgggcagaagcgggagatgggtgcctcgctctacgtcggctgggccgcctccggcctgctgctccttggcggggggctgctttgctgcaactgtccaccccgcacagacaagccttactccgccaagtattctgctgcccgctctgctgctgccagcaactacgtgtaaggtgccacggctccactctgttcctctctgctttgttcttccctggactgagctcagcgcaggctgtgaccccaggagggccctgccacgggccactggctgctggggactggggactgggcagagactgagccaggcaggaaggcagcagccttcagcctctctggcccactcggacaacttcccaaggccgcctcctgctagcaagaacagagtccaccctcctctggatattggggagggacggaagtgacagggtgtggtggtggagtggggagctggcttctgctggccaggatagcttaaccctgactttgggatctgcctgcatcggcgttggccactgtccccatttacattttccccactctgtctgcctgcatctcctctgttccgggtaggccttgatatcacctctgggactgtgccttgctcaccgaaacccgcgcccaggagtatggctgaggccttgcccacccacctgcctgggaagtgcagagtggatggacgggtttagaggggaggggcgaaggtgctgtaaacaggtttgggcagtggtgggggagggggccagagaggcggctcaggttgcccagctctgtggcctcaggactctctgcctcacccgcttcagcccagggcccctggagactgatcccctctgagtcctctgccccttccaaggacactaatgagcctgggagggtggcagggaggaggggacagcttcacccttggaagtcctggggtttttcctcttccttctttgtggtttctgttttgtaatttaagaagagctattcatcactgtaattattattattttctacaataaatgggacctgtgcacagg

SEQ ID NO: 592 - DNA, 3748 bp, Homo sapiens
  ref <308>: DATABASE ACCESSION NUMBER: NM_001310
  ref <309>: DATABASE ENTRY DATE: 2001-06-18
cgtctgtaaacacccagagactgtcatggagggggaggaggaggcggcggcggcgaagggaggcgtttggggccgcctccagggtccgctctgccattcctgaactggtccctcgtccccgtgactctggcatcagggaagcgaactgttaggcgagaggaggaggcagccagaaccatatccccttcttcctcggggcgggggccgggccaggccggctgagccgggggagggctccgggagggagtgcctggccaggccggcctgtctgccgcgatggatgacagtaaggtggttggaggcaaagtaaagaagcccggtaaacgtggtcggaagccagccaaaattgacttgaaagcaaaacttgagaggagccggcagagtgcaagagaatgccgagcccgaaaaaagctgagatatcagtatttggaagagttggtatccagtcgagaaagagctatatgtgccctcagagaggaactggaaatgtacaagcagtggtgcatggcaatggaccaaggaaaaatcccttctgaaataaaggccctactcactggagaagagcagaacaaatctcagcagaactcaagcaggcataccaaggctgggaagacagatgctaatagcaattcctggtgaagattatataaagatgagtcagtgattgaagccaatattctgattcccatggaagatggatgggcaagagtgtacttcttggctccatttactacctactgctcagtagtcatctctgtaaatctgcaatttctaccaaaatgtgtgatcgtagatctcaaaggatcttgctttaactttcaacacttagaaaatctacaaacattcagacctgtctgggttggtattgccacccatgacatttaacatgttgtgatgcttgaaaacacaggagtagagaaaatcgatgaagattgtatttttgcaccttaactccacattgctttattggttaatttatattctttccatgtaattcatgtaattgtatgtctgtgtgtgttttatgtgtcaccacctttcatgtttttgattgccctacaaagagaaaccaaatgagctgattactgactataagttctcagcctttatggacctaatcttatttttatttacttgagtaatgtttattctctgcatgaaccatgatttctcctgtgagccattccagcataagctgtgaatatgtattaacaaatatatacatttctatttttataatccataaggatatgcctgttttaaataacatacatattaacaatatctatcaggaaaaccctcaagacagcttctagttaaaacctttgttgctgtcctctcaaactatatttataaaaatttgctagggccaaatccatacttgcagaataattcatcaaattttatttttaagtgaaaagtaacctttcaggcatttcagcagcatacattgacaatctagggtatatatgtatgtatgtttcttattgtatgtctatatatgtatgtggggaggacaggagtgaatgttcacacacttttcttgcgtactcaactaaattggagaatgtttctgaagaaaattggatgaaattagctgctgagattgagtttctgccttaaaatctgaaacaaaaaaagggacaaattgctggtagatctactgactgtagccatcaccagaacacttagtttcttcccagacatgaatttcctgacaggctctgagccagaaacacactgtgggcgtgcatctggttcagccctggatatgcctccactgtggagggaagcattggaactggagttgtgcacagcaccgcagctagtgggcctggctgggggtgcagaagggcagggtagttctttccatttccccttgcagctacacttactttctccctgactaccaaatggagtgacggttgaagaatcaagctcataatatgatacacccagacagacccagaaatcttttgatttccccagcgagatacttaccactctctcttctctttcccatggttaaaacaggagttgtgttctctgtcgctgctaaattattcttcacttgagtgaagcaaatatttagcttccaaataaagtatattttgttctgaactggcagtttaagaggagataccgtagtctagattgtctttgaggtagaatatatgatggaccacatagtttaagattacaaggtactttccctcttctctcaggccatgcatttgaataaagtgcctcccttagcctgagctcctaaagacctcttgtacttggttgcaaactcagatctctagtctagtctagtctagtctagtctagtcatgtgtgactgtgtactgagataccactagcccagtttgctgggtctctatgttttggaagttgggggtttaataatatttaatgtctttttaggatcataaacataaataggtttgttgatattcaggccttcagaatttaagggttttaaatatagcattcagattgtaattggtatgtttttgccatctggtccactcaattgtatatttttattttgcaaaacaacccaaaacttactttaygttgctttgttcagtaccttttgaattcccccagaagagttgttttcaaaacaaacattccagaatgaatgtcgctcttcaatggaacgtctttattgtgcttgaagtatttcttctctggttgtaattctaaattacagagtcatttgagctttctcccctcccgctagtatctttacaggagcagggaagagcagtagaggatgtataattttgggcgaagttaaattacaatttatttgaggttattcctaaacctatttatttggtgttttggaggagatcacacactaagagaacgttgattgcctcggctattgtgctggctggacactttggtcacttttgaagcatgttaataaatgtcactgattaaaacagctggagcatttccttccctttccagtgaaggagcagcatagtgaaatcctggcacccctcacctttttgtgatgacaagatggctgacagtcacggagtccaggagaaggtgctgctctccttgctttctgagtaaacagagtaatgttttttttcttattttcccaaagaaagaaaagggggaaaatatatttgtatgtttagaccagccaaattctgtcattattttagtatcaacctgctgtatattagagcaactgaatataatatggaataagtttgaccaggtcaagttttaggatatagttgaatttctttaaaaagttttctattttatctaaaatctttctattatatctaaattagaatgatcatcctgcgcaaattcagattactgtttgctggctaattgacagtatttctcagcatcactatgtagcattctgttttagcatctttgaattatgatcatttgatttggctaattacaaaaagtacaggtttaaactggacttaccttgagttaaaggcaaagaaaatctaaaaacataaatgttatatttcacaagaaatcagttgcatattatccattacatatttagttttaaaaggaggagtcaccttgaattattttctgagtcaccttgagttatttgatctctcagcctgctttctcatctgtaaaaaaggggggaggataactttcacagggtaattggtaggctaaataggagttacagaaaactgttaaatagggaagaactacattaaatttaaatattcacatt

SEQ ID NO: 593 - DNA, 1160 bp, Homo sapiens
  ref <308>: DATABASE ACCESSION NUMBER: NM_001312
  ref <309>: DATABASE ENTRY DATE: 2001-06-18
gcgcgggccgaccgggcgcaccgaccatggcctccaaatgccccaagtgcgacaagaccgtgtacttcgccgagaaggtgagctccctggggaaggactggcacaagttctgcctcaagtgcgagcgctgcagcaagacgctgacgcccgggggccacgccgagcatgacgggaagccgttctgccacaagccgtgctacgccaccctgttcggacccaaaggcgtgaacatcgggggcgcgggctcctacatctacgagaagcccctggcggaggggccgcaggtcaccggccccatcgaggtccccgcggcccgagcagaggagcggaaggcgagcggccccccgaaggggcccagcagagcctccagtgtcaccactttcaccggggagcccaacacgtgcccgcgctgcagcaagaaggtgtacttcgctgagaaggtgacgtctctgggcaaggattggcaccggccctgcctgcgctgcgagcgctgcgggaagacactgacccccggcgggcacgcggagcacgacggccagccctactgccacaagccctgctatggaatcctcttcggacccaagggagtgaacaccggtgcggtgggcagctacatctatgaccgggaccccgaaggcaaggtccagccctaggctacagcggctctcatgatgtgggctcacctgcgccccagaccctgcaggggcccccctgcttggctctgctgggagagtgctcagccgcccagtcctgcctgcaagcccagggcgagtattggaggaggggcagccacgggcagagcaccatgcccatccccgagtctctggtgtgtctgccccctctggcatcctctgggcgtcccatgatcccttctgtgtctgcgtgtccgaatccccgtgtgaccctgtcccagcattttcccgccgaccctgcgtgtccccgtggcgctgtccgctctccctctcctgctgcccacccacctgccagtgttatttatgctcccttcgtgggtgatggccacgccctcaccatgtccctggcagagggcttcctccgggatcccctgcctggtgcccacactgcctcgcaagcgctcgccaccctcacgtggctcacctgctgttgagccttgtgctgtcaataaacggtttgaggattgc

SEQ ID NO: 594 - DNA, 901 bp, Homo sapiens
  ref <308>: DATABASE ACCESSION NUMBER: NM_001321
  ref <309>: DATABASE ENTRY DATE: 2001-06-18
gggatctcggactccctggaccctccctccagcccagcctcgctagctccgcctgcggtacgtgctcccgcctccgactcaaaatgcctgtctggggaggtggaaacaagtgtggggcctgtgggaggaccgtgtaccacgcagaagaggtgcagtgtgatggcaggagcttccaccgctgctgctttctctgcatggtttgcaggaaaaatttagatagcacaacagtggcaattcacgatgaagagatctactgcaaatcctgctacggaaagaagtatgggccaaaaggctacggttatggccagggcgctggcacgcttaacatggaccgtggcgagaggctgggcatcaaaccagagagtgttcagcctcacaggcctacaacaaatccaaacacttctaaatttgctcagaaatatggaggtgctgagaagtgttccagatgtggggattctgtatatgctgccgagaagataattggagctggaaagccctggcacaaaaactgtttccgatgtgcaaagtgtgggaagagtcttgaatcaacaactctgactgaaaaagaaggtgaaatctattgtaaaggatgctatgcaaagaactttgggcccaagggatttggctatggccaaggagcaggggctcttgttcatgcccagtaagatgtaaaccctgaactaaacatcacacactgagaatctcttcataatctaggcacagataatctttaacactaaactactgtgaaattctaccagcattaagtactgtatatcgccctgtacttggataggctggctaactcgtaggaagagagcactgtatggtatccttttgctttattcaccagcattttgggggaacatttcttttacattttaaataaaacttcagcttg

SEQ ID NO: 595 - DNA, 806 bp, Homo sapiens
  ref <308>: DATABASE ACCESSION NUMBER: NM_001327
  ref <309>: DATABASE ENTRY DATE: 2001-06-18
agcagggggcgctgtgtgtaccgagaatacgagaatacctcgtgggccctgaccttctctctgagagccgggcagaggctccggagccatgcaggccgaaggccggggcacagggggttcgacgggcgatgctgatggcccaggaggccctggcattcctgatggcccagggggcaatgctggcggcccaggagaggcgggtgccacgggcggcagaggtccccggggcgcaggggcagcaagggcctcggggccgggaggaggcgccccgcggggtccgcatggcggcgcggcttcagggctgaatggatgctgcagatgcggggccagggggccggagagccgcctgcttgagttctacctcgccatgcctttcgcgacacccatggaagcagagctggcccgcaggagcctggcccaggatgccccaccgcttcccgtgccaggggtgcttctgaaggagttcactgtgtccggcaacatactgactatccgactgactgctgcagaccaccgccaactgcagctctccatcagctcctgtctccagcagctttccctgttgatgtggatcacgcagtgctttctgcccgtgtttttggctcagcctccctcagggcagaggcgctaagcccagcctggcgccccttcctaggtcatgcctcctcccctagggaatggtcccagcacgagtggccagttcattgtgggggcctgattgtttgtcgctggaggaggacggcttacatgtttgtttctgtagaaaataaaactgagctacgaaaaaaaaaaaaaaaaaaaaaaaa

SEQ ID NO: 596 - DNA, 2368 bp, Homo sapiens
  ref <308>: DATABASE ACCESSION NUMBER: NM_001329
  ref <309>: DATABASE ENTRY DATE: 2001-06-18
cgggcgatgccgcgctgcgggggggccgcacagccgccgccaccgccaccgccgccgggtggggtgggaggggcgggaacgcgcgccgccgcctccagggtgggcgcctttcgccgtggacgccgaccgtccgggacgagggtttcatcaccttaaatggttttgaaccaatgaaggtgtattcccttaaaaagacggacagcccatcgtgtgaactatagagtttgtggacagatttatattgggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggaattgccgtgtgcaacatcccgtctgcagccgtggaagagacagcggactctaccatctgccacatcctcaacctgtaccggaggaacacgtggctgtaccaggcactgcgggaaggcacgcgggttcagagcgtggagcagatccgcgaggtggcctcgggagcggcccgcatccgtggggagacgctgggcctcattggctttggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcagatgaggcagggagcattccttgtgaacgcagcccgtggcggcctggtggacgagaaagccttagcacaagccctcaaggagggcaggatacgaggggcagccctcgacgtgcatgagtcagagcccttcagctttgctcagggtccgttgaaagatgccccgaatctcatctgcactcctcacactgcctggtacagtgagcaggcgtcactggagatgagggaggcagctgccaccgagatccgccgagccatcacaggtcgcatcccagaaagcttaagaaattgtgtgaacaaggaattctttgtcacatcagcgccttggtcagtaatagaccagcaagcaattcatcctgagctcaatggtgccacatacagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaagtattaagtttcacaagctgtttgtactcaaatatattttctcagtttcag

SEQ ID NO: 597 - DNA, 1342 bp, Homo sapiens
  ref <308>: DATABASE ACCESSION NUMBER: NM_001333
  ref <309>: DATABASE ENTRY DATE: 2001-06-18
cggctgtaatctcagaggcttgtttgctgagggtgcctgcgcacgtgcgacggctgctggttttgaaacatgaatctttcgctcgtcctggctgccttttgcttgggaatagcctccgctgttccaaaatttgaccaaaatttggatacaaagtggtaccagtggaaggcaacacacagaagattatatggcgcgaatgaagaaggatggaggagagcagtgtgggaaaagaatatgaaaatgattgaactgcacaatggggaatacagccaagggaaacatggcttcacaatggccatgaatgcttttcctgacatgaccaatgaagaattcaggcagatgatgggttgctttcgaaaccagaaattcaggaaggggaaagtgttccgtgagcctctgtttcttgatcttcccaaatctgtggattggagaaagaaaggctacgtgacgccagtgaagaatcagaaacagtgtggttcttgttgggcttttagtgcgactggtgctcttgaaggacagatgttccggaaaactgggaaacttgtctcactgagcgagcagaatctggtggactgttcgcgtcctcaaggcaatcagggctgcaatggtggcttcatggctagggccttccagtatgtcaaggagaacggaggcctggactctgaggaatcctatccatatgtagcagtggatgaaatctgtaagtacagacctgagaattctgttgctaatgacactggcttcacagtggtcgcacctggaaaggagaaggccctgatgaaagcagtcgcaactgtggggcccatctccgttgctatggatgcaggccattcgtccttccagttctacaaatcaggcatttattttgaaccagactgcagcagcaaaaacctggatcatggtgttctggtggttggctacggctttgaaggagcaaattcgaataacagcaagtattggctcgtcaaaaacagctggggtccagaatggggctcgaatggctatgtaaaaatagccaaagacaagaacaaccactgtggaatcgccacagcagccagctaccccaatgtgtgagctgatggatggtgaggaggaaggacttaaggacagcatgtctggggaaattttatcttgaaactgaccaaacgcttattgtgtaagataaaccagttgaatcattgaggatccaagttgagattttaattctgtgacatttttacaagggtaaaatgttaccactactttaattattgttatacacagctttatgatatcaaagactcattgcttaattctaagacttttgaattttcattttttaaaaagatgtacaaaacagttt

SEQ ID NO: 598 - DNA, 2434 bp, Homo sapiens
  ref <308>: DATABASE ACCESSION NUMBER: NM_001338
  ref <309>: DATABASE ENTRY DATE: 2001-06-18
gaattcccaggagcgagagccgcctacctgcagccgccgcccacggcacggcagccaccatggcgctcctgctgtgcttcgtgctcctgtgcggagtagtggatttcgccagaagtttgagtatcactactcctgaagagatgattgaaaaagccaaaggggaaactgcctatctgccgtgcaaatttacgcttagtcccgaagaccagggaccgctggacatcgagtggctgatatcaccagctgataatcagaaggtggatcaagtgattattttatattctggagacaaaatttatgatgactactatccagatctgaaaggccgagtacattttacgagtaatgatctcaaatctggtgatgcatcaataaatgtaacgaatttacaactgtcagatattggcacatatcagtgcaaagtgaaaaaagctcctggtgttgcaaataagaagattcatctggtagttcttgttaagccttcaggtgcgagatgttacgttgatggatctgaagaaattggaagtgactttaagataaaatgtgaaccaaaagaaggttcacttccattacagtatgagtggcaaaaattgtctgactcacagaaaatgcccacttcatggttagcagaaatgacttcatctgttatatctgtaaaaaatgcctcttctgagtactctgggacatacagctgtacagtcagaaacagagtgggctctgatcagtgcctgttgcgtctaaacgttgtccctccttcaaataaagctggactaattgcaggagccattataggaactttgcttgctctagcgctcattggtcttatcatcttttgctgtcgtaaaaagcgcagagaagaaaaatatgaaaaggaagttcatcacgatatcagggaagatgtgccacctccaaagagccgtacgtccactgccagaagctacatcggcagtaatcattcatccctggggtccatgtctccttccaacatggaaggatattccaagactcagtataaccaagtaccaagtgaagactttgaacgcactcctcagagtccgactctcccacctgctaaggtagctgcccctaatctaagtcgaatgggtgcgattcctgtgatgattccagcacagagcaaggatgggtctatagtatagagcctccatatgtctcatctgtgctctccgtgttcctttcctttttttgatatatgaaaacctattctggtctaaattgtgttactagcctcaaaatacatcaaaaaataagttaatcaggaactgtacggaatatatttttaaaaatttttgtttggttatatcgaaatagttacaggcactaaagttagtaaagaaaagtttaccatctgaaaaagctggattttctttaagaggttgattataaagttttctaaatttatcagtacctaagtaagatgtagcgctttgaatatgaaatcataggtgaagacatgggtgaacttacttgcataccaagttgatacttgaataaccatctgaaagtggtacttgatcatttttaccattatttttaggatgtgtatttcatttatttatggcccaccagtctcccccaaattagtacagaaatatccatgacaaaattacttacgtatgtttgtacttggttttacagctcctttgaaaactctgtgtttggaatatctctaaaaacatagaaaacactacagtggtttagaaattactaattttacttctaagtcattcataaaccttgtctatgaaatgacttcttaaatatttagttgatagactgctacaggtaatagggacttagcaagctcttttatatgctaaaggagcatctatcagattaagttagaacatttgctgtcagccacatattgagatgacactaggtgcaatagcagggatagattttgttggtgagtagtctcatgccttgagatctgtggtggtcttcaaaatggtggccagccagatcaaggatgtagtatctcatagttcccaggtgatatttttcttattagaaaaatattataactcatttgttgtttgacacttatagattgaaatttcctaatttattctaaattttaagtggttctttggttccagtgctttatgttgttgttgtttttggatggtgttacatattatatgttctagaaacatgtaatcctaaatttaccctcttgaatataatccctggatgatattttttatcataaatgcagaataatcaaatacattttaagcaagttaagtgtcctccatcaattctgtattccagacttgggaggatgtacagttgctgttgtgtgatcaaacatgtctctgtgtagttccagcaaatcaagctgagctttgaaaaagtttgtcttagttttgtgaaggtgatttattcttagaaaaaaaaaaaaaaaaaaaaa

SEQ ID NO: 599 - DNA, 2597 bp, Homo sapiens
  ref <308>: DATABASE ACCESSION NUMBER: NM_001360
  ref <309>: DATABASE ENTRY DATE: 2001-06-18
gagcagcgcgcgcaagcaggccaggggaaggtgggcgcaggtgaggggccgaggtgtgcgcaggactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaattgcaacccaacattcccaaagccaagagtctagatggcgtcaccaatgacagaaccgcatctcaagggcagtggggccgtgcctgggaggtggactggttttcactggcgagcgtcatcttcctactgctgttcgcccccttcatcgtctactacttcatcatggcttgtgaccagtacagctgcgccctgaccggccctgtggtggacatcgtcaccggacatgctcggctctcggacatctgggccaagactccacctataacgaggaaagccgcccagctctataccttgtgggtcaccttccaggtgcttctgtacacgtctctccctgacttctgccataagtttctacccggctacgtaggaggcatccaggagggggccgtgactcctgcaggggttgtgaacaagtatcagatcaacggcctgcaagcctggctcctcacgcacctgctctggtttgcaaacgctcatctcctgtcctggttctcgcccaccatcatcttcgacaactggatcccactgctgtggtgcgccaacatccttggctatgccgtctccaccttcgccatggtcaagggctacttcttccccaccagcgccagagactgcaaattcacaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggccatctacgtgattgacttcttctggaacgaaacctggtacctgaagaccattgacatctgccatgaccacttcgggtggtacctgggctggggcgactgtgtctggctgccttatctttacacgctgcagggtctgtacttggtgtaccaccccgtgcagctgtccaccccgcacgccgtgggcgtcctgctgctgggcctggtgggctactacatcttccgggtggccaaccaccagaaggacctgttccgccgcacggatgggcgctgcctcatctggggcaggaagcccaaggtcatcgagtgctcctacacatccgccgacgggcagaggcaccacagcaagctgctggtgtcgggcttctggggcgtggcccgccacttcaactacgtcggcgacctgatgggcagcctggcctactgcctggcctgtggcggtggccacctgctgccctacttctacatcatctacatggccatcctgctgacccaccgctgcctccgggacgagcaccgctgcgccagcaagtacggccgggactgggagcgctacaccgccgcagtgccttaccgcctgctgcctggaatcttctaagggcacgccctagggagaagccctgtggggctgtcaagagcgtgttctgccaggtccatgggggctggcatcccagctccaactcgaggagcctcagtttcctcatctgtaaactggagagagcccagcacttggcaggtgtccagtacctaatcacgctctgttccttgcttttgccttcaagggaattccgagtgtccagcactgccgtattgccagcacagacggattttctctaatcagtgtccctgggcaggaggatgacccagtcacctttactagtcctttggagacaatttacctgtattaggagcccaggccacgctacactctgcccacactggtgagcaggaggtcttcccacgccctgtcattaggctgcatttactcttgctaaataaaagtgggagtggggcgtgcgcgttatccatgtattgcctttcagctctagatccccctcccctgcctgctctgcagtcgtgggtggggcccgtgcgccgtttctccttggtagcgtgcacggtgttgaactgggacactggggagaaaggggctttcatgtcgtttccttcctgctcctgctgcacagctgccaggagtgctctgcctggagtctgcagacctcagagaggtcccagcactggctgtggctttcaggtgtaggcaggtgggctctgcttcccgattccctgtgagcgcccaccctctcgaaagaattttctgtcttgccctgtgactgtgcagactctggctcgagcaacccggggaacttcaccctcaggggcctctccacaccttctccagcgaggaggtctcagtcccagcctcgggagggcacctccttttctgtgctttcttccctgaggcattcttcctcatccctagggtgttgtgtagaactctttttaaactctatgctccgagtagagttcatctttatattaaacttcccctgttcaaaaaaaaaaaaaaaaa

SEQ ID NO: 600 - DNA, 2422 bp, Homo sapiens
  ref <308>: DATABASE ACCESSION NUMBER: NM_001363
  ref <309>: DATABASE ENTRY DATE: 2001-06-18
ggagtctgcggtcgttccctcggctgtggaccgggcggcacgcacgcggtgcagggtaacatggcggatgcggaagtaattattttgccaaagaaacataagaagaaaaaggagcggaagtcattgccagaagaagatgtagccgaaatacaacacgctgaagaatttcttatcaaacctgaatccaaagttgctaagttggacacgtctcagtggccccttttgctaaagaattttgataagctgaatgtaaggacaacacactatacacctcttgcatgtggttcaaatcctctgaagagagagattggggactatatcaggacaggtttcattaatcttgacaagccctctaacccctcttcccatgaggtggtagcctggattcgacggatacttcgggtggagaagacagggcacagtggtactctggatcccaaggtgactggttgtttaatcgtgtgcatagaacgagccactcgcttggtgaagtcacaacagagtgcaggcaaagagtatgtggggattgtccggctgcacaatgctattgaaggggggacccagctttctagggccctagaaactctgacaggtgccttattccagcgacccccacttattgctgcagtaaagaggcagctccgagtgaggaccatctacgagagcaaaatgattgaatacgatcctgaaagaagattaggaatcttttgggtgagttgtgaggctggcacctacattcggacattatgtgtgcaccttggtttgttattgggagttggtggtcagatgcaggagcttcggagggttcgttctggagtcatgagtgaaaaggaccacatggtgacaatgcatgatgtgcttgatgctcagtggctgtatgataaccacaaggatgagagttacctgcggcgagttgtttaccctttggaaaagctgttgacatctcataaacggctggttatgaaagacagtgcagtaaatgccatctgctatggggccaagattatgcttccaggtgttcttcgatatgaggacggcattgaggtcaatcaggagattgtggttatcaccaccaaaggagaagcaatctgcatggctattgcattaatgaccacagcggtcatctctacctgcgaccatggtatagtagccaagatcaagagagtgatcatggagagagacacttaccctcggaagtggggtttaggtccaaaggcaagtcagaagaagctgatgatcaagcagggccttctggacaagcatgggaagcccacagacagcacacctgccacctggaagcaggagtatgttgactacagtgagtctgccaaaaaagaggtggttgctgaagtggtaaaagccccgcaggtagttgccgaagcagcaaaaactgcgaagcggaagcgagagagtgagagtgaaagtgacgagactcctccagcagctcctcagttgatcaagaaggaaaagaagaagagtaagaaggacaagaaggccaaagctggtctggagagcggggccgagcctggagatggggacagtgataccaccaagaagaagaagaagaagaagaaagcaaaagaggtagaattggtttctgagtagtgaaggccacttgaagctggaggagaaactaaagccttattgagaaaacatgttatagatccttttgttgctgagagagtggaacataggtcctagacagggtgaagagttctggcacattttagctgctactttgagacctcggtgatgttacctggtgtggtcatcccatcttgtcctgttttaaggatatgggtggtgaaagatgaaagaggcagagtttatcccaatgacttctctgtttgagttgggaagcctcaccttcagacccagtaactgtccgcagctgtctgctagtggttgtcttaacatcgtagtcctagtttgcattttttaaatcccctctgtttaaaaggtttgtaaaacaaaaacaaaaaactaagtctgctcagtgaaatgctgtagaaccctaaataagtggtagaagagtgtcactgaattttgtctctgaattcagtataactgagttttgtccatgctggtgtctgggttataggcctgatgggcctggtagttttccatcttgttctggcctagaggtcagtcctttgcacttcctcaaagcttgtgtacagtgctcacctaaatccatctgactacttgttcctgtgccctcttgttttaggcctcgtttacttttaaaaaatgaaattgttcattgctgggagaagaatgttgtaatttttacttattaaagtcaacttgttaagttttttatgtattcctgttgggttttcttgttgatctcatgctagcagagcaaaaattgtaaaatattttgattaaaaatctagggacctttatgtcctatttgaaa

SEQ ID NO: 601 - DNA, 1908 bp, Homo sapiens
  ref <308>: DATABASE ACCESSION NUMBER: NM_001381
  ref <309>: DATABASE ENTRY DATE: 2001-06-18
gcggaaggaaccgccgggggccatggacggagcagtgatggaagggccgctttttttgcagagtcagcgctttgggaccaagaggtggaggaagacctgggccgtgctctacccggccagtccccacggcgtagcgcggctcgagttctttgaccataaggggtcgagctctgggggtggccgagggagctcgcgccgcctggactgcaaagtgatccgtctggctgagtgtgtgagtgtggcccccgtcaccgtggagaccccccctgagcccggcgccactgccttccgcctggacactgctcagcgctcgcacctgctggcggccgacgcgccgtccagtgcagcctgggtgcagacgctgtgccgaaacgcctttccgaaaggcagctggactctggcgcctaccgataacccacctaagctttctgccctggagatgctggagaactccttgtacagccctacctgggaaggatcccaattctgggtaacggtgcagaggactgaggccgccgagcgctgtggcctgcatggctcctacgtgctgagggtggaggctgaaaggctgactctcctgaccgtgggggcccagagtcagatactggagccactcctgtcctggccctacactctgttgcgtcgctatggccgggacaaggtcatgttctctttcgaggccggccgccgctgcccctcaggccctggaaccttcaccttccagacggcacagggaaatgacatcttccaggcagttgagactgccatccaccggcagaaggcccagggaaaggccggacaggggcacgatgttctcagagctgactcccatgaaggggaggtggcagaggggaagttgccttccccacctggcccccaagagctcctcgacagtcccccagccctgtatgctgagcccttagactccctgcgcattgctccatgcccttcccaggactccctatactcagaccccttggacagcacgtctgctcaggcaggagagggagtacaacggaagaaacctctctattgggacttgtatgagcatgcgcagcagcagttgctgaaggccaagctgacagaccccaaagaggatcccatctatgatgaacctgagggcctggccccagtccctccccagggcctttatgatctgcctcgggagcccaaggatgcatggtggtgccaagctcgggtgaaggaggagggctatgagctcccctacaaccctgccactgatgactacgctgtgccaccccctcggagcacaaagcccctccttgctcccaagccccagggcccagccttccctgaacctggtactgcaactggcagtggcatcaaaagccacaactcagccctgtacagccaggtccagaagagcggggcctcagggagctgggactgtgggctctctagagtagggactgacaagactggggtcaagtcagagggctctacctgagaaggacggcaaggctgaggtggctaagggggaccatggggaggtggcactagggatcaaagaagatggttagaaccagcagaagccagagggtgggaggggccatgctgtgtgagaccaggggaccagagggatgggagagtcaagggaaggacaatcccaggaagtcctaagaagtggggcagatggcagggctgaggatgggctctgcatcccccaaagccatcccttccctacttccccaaatgaagggacggctgtgggaccaggtctgtggaaagtggtgcatggtcagaatgggtgcagtttgaggggcctgtgtggaggcctcagggagatgttggactgtgcctggatccttactcctgcattgttctttgccagagacctatttaaaaattttaaaattctcattaaagtcaaaaaaaaaaaaaaaaaaa

SEQ ID NO: 602 - DNA, 2361 bp, Homo sapiens
  ref <308>: DATABASE ACCESSION NUMBER: NM_001394
  ref <309>: DATABASE ENTRY DATE: 2001-06-18
ccccctccgctctgctgcgccgcccggctgggccccgaggccgctccgactgctatgtgaccgcgaggctgcgggaggaaggggacagggaagaagaggctctcccgcgggagcccttgaggaccaagtttgcggccacttctgcaggcgtcccttcttagctctcgcctgcccctttctgcagcctaggcggcccaggttctcttctcttcctcgcgcgcccagccgcctcggttcccggcgaccatggtgacgatggaggagctgcgggagatggactgcagtgtgctcaaaaggctgatgaaccgggacgagaatggcggcggcgcgggcggcagcggcagccacggcaccctggggctgccgagcggcggcaagtgcctgctgctggactgcagaccgttcctggcgcacagcgcgggctacatcctaggttcggtcaacgtgcgctgtaacaccatcgtgcggcggcgggctaagggctccgtgagcctggagcagatcctgcccgccgaggaggaggtacgcgcccgcttgcgctccggcctctactcggcggtcatcgtctacgacgagcgcagcccgcgcgccgagagcctccgcgaggacagcaccgtgtcgctggtggtgcaggcgctgcgccgcaacgccgagcgcaccgacatctgcctgctcaaaggcggctatgagaggttttcctccgagtacccagaattctgttctaaaaccaaggccctggcagccatcccacccccggttccccccagcgccacagagcccttggacctgggctgcagctcctgtgggaccccactacacgaccaggggggtcctgtggagatccttcccttcctctacctcggcagtgcctaccatgctgcccggagagacatgctggacgccctgggcatcacggctctgttgaatgtctcctcggactgcccaaaccactttgaaggacactatcagtacaagtgcatcccagtggaagataaccacaaggccgacatcagctcctggttcatggaagccatagagtacatcgatgccgtgaaggactgccgtgggcgcgtgctggtgcactgccaggcgggcatctcgcggtcggccaccatctgcctggcctacctgatgatgaagaaacgggtgaggctggaggaggccttcgagttcgttaagcagcgccgcagcatcatctcgcccaacttcagcttcatggggcagctgctgcagttcgagtcccaggtgctggccacgtcctgtgctgcggaggctgctagcccctcgggacccctgcgggagcggggcaagacccccgccacccccacctcgcagttcgtcttcagctttccggtctccgtgggcgtgcactcggcccccagcagcctgccctacctgcacagccccatcaccacctctcccagctgttagagccgccctgggggccccagaaccagagctggctcccagcaagggtaggacgggccgcatgcggcagaaagttgggactgagcagctgggagcaggcgaccgagctccttccccatcatttctccttggccaacgacgaggccagccagaatggcaataaggactccgaatacataataaaagcaaacagaacactccaacttagagcaataaccggtgccgcagcagccagggaagaccttggtttggtttatgtgtcagtttcacttttccgatagaaatttcttacctcatttttttaagcagtaaggcttgaagtgatgaaacccacagatcctagcaaatgtgcccaaccagctttactaaagggggaggaagggagggcaaagggatgagaagacaagtttcccagaagtgcctggttctgggtacttgtccctttgttgtcgttgttgtagttaaaggaatttcatttttaaaagaaatcttcgaaggtgtggttttcatttctcagtcaccaacagatgaataattatgcttaataataaagtatttattaagactttcttcagagtatgaaagtacaaaaagtctagttacagtggatttagaatatatttatgttgatgtcaaacagctgagcaccgtagcatgcagatgtcaaggcagttaggaagtaaatggtgtcttgtagatatgtgcaaggtagcatgatgagcaacttgagtttgttgccactgagaagcaggcgggttgggtgggaggaggaagaaagggaagaattaggtttgaattgctttttaaaaaaaaaagaaaagaaaaagacagcatctcactatgttgccaaggctcatcttgagaagcaggcgggttgggtgggaggaggaagaaagggaagaattaggtttgaattgcttttttaaaaaaaaa

SEQ ID NO: 603 - DNA, 2303 bp, Homo sapiens
  ref <308>: DATABASE ACCESSION NUMBER: NM_001395
  ref <309>: DATABASE ENTRY DATE: 2001-06-18
cgcttcccgccgcccgagcttcggaaacttcccggccgcgacgcagggaaccggcgcggagaaccgagcagagcggagcgcccgtggtccagcgtgtagggagccgatcgcccatggagggtctgggccgctcgtgcctgtggctgcgtcgggagctgtcgcccccgcggccgcggctcctgctcctggactgccgcagccgcgagctgtacgagtcggcgcgcatcggtggggcgctgagcgtggccctgccggcgctcctgctgcgccgcctgcggaggggcagcctgtcggtgcgcgcgctcctgcctgggccgccgctgcagccgcccccgcctgcccccgtgctcctgtacgaccagggcgggggccggcgccggcgcggggaggccgaggccgaggccgaggagtgggaggccgagtcggtgctgggcaccctgctgcagaagctgcgagaggaaggctacctggcctactacctccagggaggcttcagcagattccaggccgagtgccctcacctgtgtgagaccagccttgctggccgtgccggctccagcatggcgccggtgcccggtccagtgcccgtggtggggttgggcagcctgtgcctgggctccgactgctctgatgcggaatccgaggctgaccgcgactccatgagctgtggcctggattcggagggtgccacacccccaccagtggggctgcgggcatccttccctgtccagatcctgcccaacctctatctgggcagtgcccgggattccgccaatttggagagcctggccaaactgggcatccgctacatcctcaatgtcacccccaacctcccaaacttcttcgagaagaatggtgactttcactacaagcagatccccatctccgaccactggagccagaacctgtcgcggttctttccggaggccattgagttcattgatgaggccttgtcccagaactgcggggtgctcgtccactgcttggcgggggtcagccgttctgtcaccgtcactgtggcctacctcatgcagaagctccacctctctctcaacgatgcctatgacctggtcaagaggaagaagtctaacatctcccccaacttcaacttcatggggcagttgctggactttgagcgcagcttgcggctggaggagcgccactcgcaggagcagggcagtggggggcaggcatctgcggcctccaacccgccctccttcttcaccacccccaccagtgatggcgccttcgagctggcccccacctagggccccgtggccggcaggccggcccctgccccacccccacccacgggtgtccctgcccactcgtgtggcaagggaggggagggcaggagggctcggcctgagcagggtgctggggggagagcgcaatacctcacgcgggctgccgtcctaatcaacgtgcctatggcgggaccacgctcggagcctgcctcttctgcgactgttactttttctttgcgggatgggggtgggggttccctctccaggtggttgtccaagcccaggtcccggccctgggtgctcagccagctcggctaggccctgcgcctccctgcgcttcccccttcaggaagggtgtgtgccacctcgttgcactggatcccagtggctgcttgggggagaggcgtttgccatcactggtgttgtcacctccctgtttctccaccaagggcttgggcctctcggggctggggcctcccaggggatggggacccagaggtgcagtggccgcccacatccatggcctaggagctactgggcaggttcccggccacacatctggtgggctgttttgtttttttttttcctcttcccccagatgtcttgacgggatcactggggctctttgtgagtgagggtggccaaactaccgccggaggagatggggtctcagagcgagagctgcggagggggaggggaagaagaaggcctcacttttgctgctgcggggcccacacagccgctgctactttggggggtggggaaggggccaagctgcagacacacacagtcattcatttctgtccacacccctgtgggtggcgggtgtgcgtgtgtgtgcttgtgtgtgcgcacgtgtcggcgctcacacacacatgctagcccactgatgcacccagcccagggctggcagtctttgcagcgtggggccgtctcaccctggagcctggagaggatctatgcttgtttgtttttgtaatccatatcatagttgctttctttaattgttccttctgaataaacagtttatttaagataaaaaaaaaaaaaaaaaaa

SEQ ID NO: 604 - DNA, 1230 bp, Homo sapiens
  ref <308>: DATABASE ACCESSION NUMBER: NM_001419
  ref <309>: DATABASE ENTRY DATE: 2001-06-18
ccgccgccaccgctaccgaggccgagcggagccgttagcgccgcgccgccgccgcctcccgcccgccccggagcagccccgggcccgcccgcccgcatccagatttttgaaaaatacaatgtctaatggttatgaagaccacatggccgaagactgcaggggtgacatcgggagaacgaatttgatcgtcaactacctccctcagaacatgacccaggatgagttacgaagcctgttcagcagcattggtgaagttgaatctgcaaaacttattcgggataaagtagcaggacacagcttgggctacggctttgtgaactacgtgaccgcgaaggatgcagagagagcgatcaacacgctgaacggcttgaggctccagtcaaaaaccattaaggtgtcgtatgctcgcccgagctcagaggtgatcaaagacgccaacttgtacatcagcgggctcccgcggaccatgacccagaaggacgtagaagacatgttctctcggtttgggcggatcatcaactcgcgggtcctcgtggatcagactacaggtttgtccagaggggttgcgtttatccggtttgacaaacggtcggaggcagaagaggcaattaccagtttcaatggtcataaacccccaggttcctctgagcccatcgcagtgaagtttgcagccaaccccaaccagaacaaaaacgtggcactcctctcgcagctgtaccactcgccagcgcgacggttcggaggccccgttcaccaccaggcgcagagattcaggttctcccccatgggcgtcgatcacatgagcgggctctctggcgtcaacgtgccaggaaacgcctcctccggctggtgcattttcatctacaacctggggcaggatgccgacgaggggatcctctggcagatgtttgggccgtttggtgccgtcaccaatgtgaaagtgatccgcgacttcaacaccaacaagtgcaaagggtttggctttgtgaccatgacaaactatgaagaagccgcgatggccatagccagcctgaacggctaccgcctgggggacaaaatcttacaggtttccttcaaaaccaacaagtcccacaaataactcgctcatgctttttttgtacggaatagataattaagagtgaaggagttgaaacttttcttgttagtgtacaactcattttgcgccaattttcacaagtgtttgtctttgtctgaatgagaagtgagaag

SEQ ID NO: 605 - DNA, 690 bp, Homo sapiens
  ref <308>: DATABASE ACCESSION NUMBER: NM_001424
  ref <309>: DATABASE ENTRY DATE: 2001-06-18
cagcacatcccgctctgggctttaaacgtgacccctcgcctcgactcgccctgccctgtgaaaatgttggtgcttcttgctttcatcatcgccttccacatcacctctgcagccttgctgttcattgccaccgtcgacaatgcctggtgggtaggagatgagttttttgcagatgtctggagaatatgtaccaacaacacgaattgcacagtcatcaatgacagctttcaagagtactccacgctgcaggcggtccaggccaccatgatcctctccaccattctctgctgcatcgccttcttcatcttcgtgctccagctcttccgcctgaagcagggagagaggtttgtcctaacctccatcatccagctaatgtcatgtctgtgtgtcatgattgcggcctccatttatacagacaggcgtgaagacattcacgacaaaaacgcgaaattctatcccgtgaccagagaaggcagctacggctactcctacatcctggcgtgggtggccttcgcctgcaccttcatcagcggcatgatgtacctgatactgaggaagcgcaaatagagttccggagctgggttgcttctgctgcagtacagaatccacattcagataaccattttgtatataatcattattttttgaggtttttctagcaaaccgtattgtttcctttaaaagccaaaa

SEQ ID NO: 606 - DNA, 1755 bp, Homo sapiens
  ref <308>: DATABASE ACCESSION NUMBER: NM_001428
  ref <309>: DATABASE ENTRY DATE: 2001-06-18
acggagatctcgccggctttacgttcacctcggtgtctgcagcaccctccgcttcctctcctaggcgacgagacccagtggctagaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggcctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtaagctgtgggcaggcaagccttcggtcacctgttggctacacagacccctcccctcgtgtcagctcaggcagctcgaggcccccgaccaacacttgcaggggtccctgctagttagcgccccaccgccgtggagttcgtaccgcttccttagaacttctacagaagccaagctccctggagccctgttggcagctctagcttttgcagtcgtgtaatgggcccaagtcattgtttttctcgcctcactttccaccaagtgtctagagtcatgtgagcctcgtgtcatctccggggtggccacaggctagatccccggtggttttgtgctcaaaataaaaagcctcagtgacccatgag

SEQ ID NO: 607 - DNA, 1135 bp, Homo sapiens
  ref <308>: DATABASE ACCESSION NUMBER: NM_001436
  ref <309>: DATABASE ENTRY DATE: 2001-06-18
ggatccggcaacgaaggtaccatggccggactccggagccgcacaaaccagggctcgccatgaagccaggattcagtccccgtgggggtggctttggcggccgagggggctttggtgaccgtggtggtcgtggaggccgagggggctttggcgggggccgaggtcgaggcggaggctttagaggtcgtggacgaggaggaggtggaggcggcggcggcggtggaggaggaggaagaggtggtggaggcttccattctggtggcaaccggggtcgtggtcggggaggaaaaagaggaaaccagtcggggaagaatgtgatggtggagccgcatcggcatgagggtgtcttcatttgtcgaggaaaggaagatgcactggtcaccaagaacctggtccctggggaatcagtttatggagagaagagagtctcgatttcggaaggagatgacaaaattgagtaccgagcctggaaccccttccgctccaagctagcagcagcaatcctgggtggtgtggaccagatccacatcaaaccgggggctaaggttctctacctcggggctgcctcgggcaccacggtctcccatgtctctgacatcgttggtccggatggtctagtctatgcagtcgagttctcccaccgctctggccgtgacctcattaacttggccaagaagaggaccaacatcattcctgtgatcgaggatgctcgacacccacacaaataccgcatgctcatcgcaatggtggatgtgatctttgctgatgtggcccagccagaccagacccggattgtggccctgaatgcccacaccttcctgcgtaatggaggacactttgtgatttccattaaggccaactgcattgactccacagcctcagccgaggccgtgtttgcctccgaagtgaaaaagatgcaacaggagaacatgaagccgcaggagcagttgacccttgagccatatgaaagagaccatgccgtggtcgtgggagtgtacaggccaccccccaaggtgaagaactgaagttcagcgctgtcaggattgcgagagatgtgtgttgatactgttgcacgtgtgtttttctattaaaagactcatccgtcaaaaaaaaaaaaaaaaaaaaaaaaaaaaaa

SEQ ID NO: 608 - DNA, 662 bp, Homo sapiens
  ref <308>: DATABASE ACCESSION NUMBER: NM_001444
  ref <309>: DATABASE ENTRY DATE: 2001-06-18
accgccgacgcagacccctctctgcacgccagcccgcccgcacccaccatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcatccctttggttaataaataaatgtgtttgtgct

SEQ ID NO: 609 - DNA, 778 bp, Homo sapiens
  ref <308>: DATABASE ACCESSION NUMBER: NM_001446
  ref <309>: DATABASE ENTRY DATE: 2001-06-18
aagggtcttctgagctgcagtggcaattagaccagaagatccccgctcctgtctctaaagaggggaaagggcaaggatggtggaggctttctgtgctacctggaagctgaccaacagtcagaactttgatgagtacatgaaggctctaggcgtgggctttgccactaggcaggtgggaaatgtgaccaaaccaacggtaattatcagtcaagaaggagacaaagtggtcatcaggactctcagcacattcaagaacacggagattagtttccagctgggagaagagtttgatgaaaccactgcagatgatagaaactgtaagtctgttgttagcctggatggagacaaacttgttcacatacagaaatgggatggcaaagaaacaaattttgtaagagaaattaaggatggcaaaatggttatgacccttacttttggtgatgtggttgctgttcgccactatgagaaggcataaaaatgttcctggtcggggcttggaagagctcttcagtttttctgtttcctcaagtctcagtgctatcctattacaacatggctgatcattaattagaaggttatccttggtgtggaggtggaaaatggtgatttaaaaacttgttactccaagcaacttgcccaattttaatctgaaaatttatcatgttttataatttgaattaaagttttgtccccccccccttttttttataaacaagtgaatacattttataatttcttttggaatgtaaatcaaatttgaataaaaatcttacacgtg

SEQ ID NO: 610 - DNA, 3724 bp, Homo sapiens
  Modified_base 1 ... 3724: n = a,c,g, or t
  ref <308>: DATABASE ACCESSION NUMBER: NM_001448
  ref <309>: DATABASE ENTRY DATE: 2001-06-18
gcctggcaccggggaccgttgcctgacgcgaggcccagctctacttttcgccccgcgtctcctccgcctgctcgcctcttccaccaactccaactccttctccctccagctccactcgctagtccccgactccgccagccctcggcccgctgccgtagcgccgcttcccgtccggtcccaaaggtgggaacgtgtccgccccggcccgcaccatggcacggttcggcttgcccgcgcttctctgcaccctggcagtgctcagcgccgcgctgctggctgccgagctcaagtcgaaaagttgctcggaagtgcgacgtctttacgtgtccaaaggcttcaacaagaacgatgcccccctccacgagatcaacggtgatcatttgaagatctgtccccagggttctacctgctgctctcaagagatggaggagaagtacagcctgcaaagtaaagatgatttcaaaagtgtggtcagcgaacagtgcaatcatttgcaagctgtctttgcttcacgttacaagaagtttgatgaattcttcaaagaactacttgaaaatgcagagaaatccctgaatgatatgtttgtgaagacatatggccatttatacatgcaaaattctgagctatttaaagatctcttcgtagagttgaaacgttactacgtggtgggaaatgtgaacctggaagaaatgctaaatgacttctgggctcgcctcctggagcggatgttccgcctggtgaactcccagtaccactttacagatgagtatctggaatgtgtgagcaagtatacggagcagctgaagcccttcggagatgtccctcgcaaattgaagctccaggttactcgtgcttttgtagcagcccgtactttcgctcaaggcttagcggttgcgggagatgtcgtgagcaaggtctccgtggtaaaccccacagcccagtgtacccatgccctgttgaagatgatctactgctcccactgccggggtctcgtgactgtgaagccatgttacaactactgctcaaacatcatgagaggctgtttggccaaccaaggggatctcgattttgaatggaacaatttcatagatgctatgctgatggtggcagagaggctagagggtcctttcaacattgaatcggtcatggatcccatcgatgtgaagatttctgatgctattatgaacatgcaggataatagtgttcaagtgtctcagaaggttttccagggatgtggaccccccaagcccctcccagctggacgaatttctcgttccatctctgaaagtgccttcagtgctcgcttcagaccacatcaccccgaggaacgcccaaccacagcagctggcactagtttggaccgactggttactgatgtcaaggataaactgaaacaggccaagaaattctggtcctcccttccgagcaacgtttgcaacgatgagaggatggctgcaggaaacggcaatgaggatgactgttggaatgggaaaggcaaaagcaggtacctgtttgcagtgacaggaaatggattagtcaaccagggcaacaacccagaggtccaggttgacaccagcaaaccagacatactgatccttcgtcaaatcatggctcttcgagtgatgaccagcaagatgaagaatgcatacaatgggaacgacgtggacttctttgatatcagtgatgaaagtagtggagaaggaagtggaagtggctgtgagtatcagcagtgcccttcagagtttgactacaatgccactgaccatgctgggaagagtgccaatgagaaagccgacagtgctggtgtccgtcctggggcacaggcctacctcctcactgtcttctgcatcttgttcctggttatgcagagagagtggagataattctcaaactctgagaaaaagtgttcatcaaaaagttaaaaggcaccagttatcacttttctaccatcctagtgactttgctttttaaatgaatggacaacaatgtacagtttttactatgtggccactggtttaagaagtgctgactttgttttctcattcagttttgggaggaaaagggactgtgcattgagttggttcctgctcccccaaaccatgttaaacgtggctaacagtgtaggtacagaactatagttagttgtgcatttgtgattttatcactctattatttgtttgtatgtttttttctcatttcgtttgtgggtttttttttccaactgtgatctcgccttgtttcttacaagcaaaccagggtcccttcttggcacgtaacatgtacgtatttctgaaatattaaatagctgtacagaagcaggttttatttatcatgttatcttattaaaagaaaaagcccaaaaagcagtaaaatttccatttctccctgttattttagttgccttatctggagagacgtggaggtgattttctttttttaaattattattaagacagaatgtgaaggcacaagcaggcttctgagccacttgtcagattgtattcaaagcatcaatccaagaggaggttatgtgtacttcatttattggtgatagttggaagagactgcagactactgctttgaatgagttgaattacataagctaagatcactataaggtccatttcttgaacccacttatacataaaatgtaacccatttagaaaaagattctggatatcatccccccttgaaagatagaaagcattcaggatgtcccagttatcacatgttcacacttgggtttaggggtgtttttttttaaaaccaggcaggttagctagcccaccctgtgctagttttcatgttcacgctgaccctatttgaattaatatcctttgttagagtggtcgagatttcaaacccaattatgtacanggagctgtctgagagctagccagaactggggtacagcctgggctcagggaatagctgtcaacactcgggcaaagtttttgtctgcagcaacgtgtatcaccatttgttttgggatccagtttttgttttaagagagtataaggtgtctcatttgagtctttttcttacctagccccctcttatcagtaaaacaaaggacttgccatggttcacagcaatgtgctacgatccaagatatcaaccaaggagcccacttaggggagaactaggtgtccagatttttgtatgtgttgtttttcttgggggatggggtggggtgggagtaggtagagctgagaatactacatcttagtggtgacctttagccacgtgggtgaagtggcaaaggccatggccatatctgttgtcccaggccaaagactaacaactgccttgggaatcccttccttgtgtccttaccaaatgatagctcataaaactctgataatgtaacaaatcacttncaaaggagttcccagaagtcttcagaaagactaaaattctgtctcttcctgctttagacagccattaagatcccaactaattttaccgaacctaaaacccacaaagaggttgtttgtgttattgttcaatcttcagttgtaagagtaattctctatttttatattgaaacataattacttgatagctcagggtctacacttcattcaactttttacaccaaattctgcagagtggtcaaaatggaatattgggggctgttgtaaacagaggcttaattttattagaagtagccagttatttattaaagcatgatgttaataaaataggcatattccaaaaaaaa

SEQ ID NO: 611 - DNA, 1662 bp, Homo sapiens
  ref <308>: DATABASE ACCESSION NUMBER: NM_001453
  ref <309>: DATABASE ENTRY DATE: 2001-06-18
atgcaggcgcgctactccgtgtccagccccaactccctgggagtggtgccctacctcggcggcgagcagagctactaccgcgcggcggccgcggcggccgggggcggctacaccgccatgccggcccccatgagcgtgtactcgcaccctgcgcacgccgagcagtacccgggcggcatggcccgcgcctacgggccctacacgccgcagccgcagcccaaggacatggtgaagccgccctatagctacatcgcgctcatcaccatggccatccagaacgccccggacaagaagatcaccctgaacggcatctaccagttcatcatggaccgcttccccttctaccgggacaacaagcagggctggcagaacagcatccgccacaacctctcgctcaacgagtgcttcgtcaaggtgccgcgcgacgacaagaagccgggcaagggcagctactggacgctggacccggactcctacaacatgttcgagaacggcagcttcctgcggcggcggcggcgcttcaagaagaaggacgcggtgaaggacaaggaggagaaggacaggctgcacctcaaggagccgcccccgcccggccgccagcccccgcccgcgccgccggagcaggccgacggcaacgcgcccggtccgcagccgccgcccgtgcgcatccaggacatcaagaccgagaacggtacgtgcccctcgccgccccagcccctgtccccggccgccgccctgggcagcggcagcgccgccgcggtgcccaagatcgagagccccgacagcagcagcagcagcctgtccagcgggagcagccccccgggcagcctgccgtcggcgcggccgctcagcctggacggtgcggattccgcgccgccgccgcccgcgccctccgccccgccgccgcaccatagccagggcttcagcgtggacaacatcatgacgtcgctgcgggggtcgccgcagagcgcggccgcggagctcagctccggccttctggcctcggcggccgcgtcctcgcgcgcggggatcgcacccccgctggcgctcggcgcctactcgcccggccagagctccctctacagctccccctgcagccagacctccagcgcgggcagctcgggcggcggcggcggcggcgcgggggccgcggggggcgcgggcggcgccgggacctaccactgcaacctgcaagccatgagcctgtacgcggccggcgagcgcgggggccacttgcagggcgcgcccgggggcgcgggcggctcggccgtggacaaccccctgcccgactactctctgcctccggtcaccagcagcagctcgtcgtccctgagtcacggcggcggcggcggcggcggcgggggaggccaggaggccggccaccaccctgcggcccaccaaggccgcctcacctcgtggtacctgaaccaggcgggcggagacctgggccacttggcaagcgcggcggcggcggcggcggccgcaggctacccgggccagcagcagaacttccactcggtgcgggagatgttcgagtcacagaggatcggcttgaacaactctccagtgaacgggaatagtagctgtcaaatggccttcccttccagccagtctctgtaccgcacgtccggagctttcgtctacgactgtagcaagttttga

SEQ ID NO: 612 - DNA, 8368 bp, Homo sapiens
  ref <308>: DATABASE ACCESSION NUMBER: NM_001456
  ref <309>: DATABASE ENTRY DATE: 2001-06-18
gcgatccgggcgccaccccgcggtcatcggtcaccggtcgctctcaggaacagcagcgcaacctctgctccctgcctcgcctcccgcgcgcctaggtgcctgcgactttaattaaagggccgtcccctcgccgaggctgcagcaccgcccccccggcttctcgcgcctcaaaatgagtagctcccactctcgggcgggccagagcgcagcaggcgcggctccgggcggcggcgtcgacacgcgggacgccgagatgccggccaccgagaaggacctggcggaggacgcgccgtggaagaagatccagcagaacactttcacgcgctggtgcaacgagcacctgaagtgcgtgagcaagcgcatcgccaacctgcagacggacctgagcgacgggctgcggcttatcgcgctgttggaggtgctcagccagaagaagatgcaccgcaagcacaaccagcggcccactttccgccaaatgcagcttgagaacgtgtcggtggcgctcgagttcctggaccgcgagagcatcaaactggtgtccatcgacagcaaggccatcgtggacgggaacctgaagctgatcctgggcctcatctggaccctgatcctgcactactccatctccatgcccatgtgggacgaggaggaggatgaggaggccaagaagcagacccccaagcagaggctcctgggctggatccagaacaagctgccgcagctgcccatcaccaacttcagccgggactggcagagcggccgggccctgggcgccctggtggacagctgtgccccgggcctgtgtcctgactgggactcttgggacgccagcaagcccgttaccaatgcgcgagaggccatgcagcaggcggatgactggctgggcatcccccaggtgatcacccccgaggagattgtggaccccaacgtggacgagcactctgtcatgacctacctgtcccagttccccaaggccaagctgaagccaggggctcccttgcgccccaaactgaacccgaagaaagcccgtgcctacgggccaggcatcgagcccacaggcaacatggtgaagaagcgggcagagttcactgtggagaccagaagtgctggccagggagaggtgctggtgtacgtggaggacccggccggacaccaggaggaggcaaaagtgaccgccaataacgacaagaaccgcaccttctccgtctggtacgtccccgaggtgacggggactcataaggttactgtgctctttgctggccagcacatcgccaagagccccttcgaggtgtacgtggataagtcacagggtgacgccagcaaagtgacagcccaaggtcccggcctggagcccagtggcaacatcgccaacaagaccacctactttgagatctttacggcaggagctggcacgggcgaggtcgaggttgtgatccaggaccccatgggacagaagggcacggtagagcctcagctggaggcccggggcgacagcacataccgctgcagctaccagcccaccatggagggcgtccacaccgtgcacgtcacgtttgccggcgtgcccatccctcgcagcccctacactgtcactgttggccaagcctgtaacccgagtgcctgccgggcggttggccggggcctccagcccaagggtgtgcgggtgaaggagacagctgacttcaaggtgtacacaaagggcgctggcagtggggagctgaaggtcaccgtgaagggccccaagggagaggagcgcgtgaagcagaaggacctgggggatggcgtgtatggcttcgagtattaccccatggtccctggaacctatatcgtcaccatcacgtggggtggtcagaacatcgggcgcagtcccttcgaagtgaaggtgggcaccgagtgtggcaatcagaaggtacgggcctggggccctgggctggagggcggcgtcgttggcaagtcagcagactttgtggtggaggctatcggggacgacgtgggcacgctgggcttctcggtggaagggccatcgcaggctaagatcgaatgtgacgacaagggcgacggctcctgtgatgtgcgctactggccgcaggaggctggcgagtatgccgttcacgtgctgtgcaacagcgaagacatccgcctcagccccttcatggctgacatccgtgacgcgccccaggacttccacccagacagggtgaaggcacgtgggcctggattggagaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagccaccccaacaaggtcaaagtatacggccccggagtagccaagacagggctcaaggcccacgagcccacctacttcactgtggactgcgccgaggctggccagggggacgtcagcatcggcatcaagtgtgcccctggagtggtaggccccgccgaagctgacatcgacttcgacatcatccgcaatgacaatgacaccttcacggtcaagtacacgccccggggggctggcagctacaccattatggtcctctttgctgaccaggccacgcccaccagccccatccgagtcaaggtggagccctctcatgacgccagtaaggtgaaggccgagggccctggcctcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagcagggtccagtaggcgtcaatgtcacttatggaggggatcccatccctaagagccctttctcagtggcagtatctccaagcctggacctcagcaagatcaaggtgtctggcctgggagagaaggtggacgttggcaaagaccaggagttcacagtcaaatcaaagggtgctggtggtcaaggcaaagtggcatccaagattgtgggcccctcgggtgcagcggtgccctgcaaggtggagccaggcctgggggctgacaacagtgtggtgcgcttcctgccccgtgaggaagggccctatgaggtggaggtgacctatgacggcgtgcccgtgcctggcagcccctttcctctggaagctgtggcccccaccaagcctagcaaggtgaaggcgtttgggccggggctgcagggaggcagtgcgggctcccccgcccgcttcaccatcgacaccaagggcgccggcacaggtggcctgggcctgacggtggagggcccctgtgaggcgcagctcgagtgcttggacaatggggatggcacatgttccgtgtcctacgtgcccaccgagcccggggactacaacatcaacatcctcttcgctgacacccacatccctggctccccattcaaggcccacgtggttccctgctttgacgcatccaaagtcaagtgctcaggccccgggctggagcgggccaccgctggggaggtgggccaattccaagtggactgctcgagcgcgggcagcgcggagctgaccattgagatctgctcggaggcggggcttccggccgaggtgtacatccaggaccacggtgatggcacgcacaccattacctacattcccctctgccccggggcctacaccgtcaccatcaagtacggcggccagcccgtgcccaacttccccagcaagctgcaggtggaacctgcggtggacacttccggtgtccagtgctatgggcctggtattgagggccagggtgtcttccgtgaggccaccactgagttcagtgtggacgcccgggctctgacacagaccggagggccgcacgtcaaggcccgtgtggccaacccctcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaacaagcccaacaagttcactgtggagaccaggggagctggcacgggcggcctgggcctggctgtagagggcccctccgaggccaagatgtcctgcatggataacaaggacggcagctgctcggtcgagtacatcccttatgaggctggcacctacagcctcaacgtcacctatggtggccatcaagtgccaggcagtcctttcaaggtccctgtgcatgatgtgacagatgcgtccaaggtcaagtgctctgggcccggcctgagcccaggcatggttcgtgccaacctccctcagtccttccaggtggacacaagcaaggctggtgtggccccattgcaggtcaaagtgcaagggcccaaaggcctggtggagccagtggacgtggtagacaacgctgatggcacccagaccgtcaattatgtgcccagccgagaagggccctacagcatctcagtactgtatggagatgaagaggtaccccggagccccttcaaggtcaaggtgctgcctactcatgatgccagcaaggtgaaggccagtggccccgggctcaacaccactggcgtgcctgccagcctgcccgtggagttcaccatcgatgcaaaggacgccggggagggcctgctggctgtccagatcacggatcccgaaggcaagccgaagaagacacacatccaagacaaccatgacggcacgtatacagtggcctacgtgccagacgtgacaggtcgctacaccatcctcatcaagtacggtggtgacgagatccccttctccccgtaccgcgtgcgtgccgtgcccaccggggacgccagcaagtgcactgtcacagtgtcaatcggaggtcacgggctaggtgctggcatcggccccaccattcagattggggaggagacggtgatcactgtggacactaaggcggcaggcaaaggcaaagtgacgtgcaccgtgtgcacgcctgatggctcagaggtggatgtggacgtggtggagaatgaggacggcactttcgacatcttctacacggccccccagccgggcaaatacgtcatctgtgtgcgctttggtggcgagcacgtgcccaacagccccttccaagtgacggctctggctggggaccagccctcggtgcagccccctctacggtctcagcagctggccccacagtacacctacgcccagggcggccagcagacttgggccccggagaggcccctggtgggtgtcaatgggctggatgtgaccagcctgaggccctttgaccttgtcatccccttcaccatcaagaagggcgagatcacaggggaggttcggatgccctcaggcaaggtggcgcagcccaccatcactgacaacaaagacggcaccgtgaccgtgcggtatgcacccagcgaggctggcctgcacgagatggacatccgctatgacaacatgcacatcccaggaagccccttgcagttctatgtggattacgtcaactgtggccatgtcactgcctatgggcctggcctcacccatggagtagtgaacaagcctgccaccttcaccgtcaacaccaaggatgcaggagaggggggcctgtctctggccattgagggcccgtccaaagcagaaatcagctgcactgacaaccaggatgggacatgcagcgtgtcctacctgcctgtgctgccgggggactacagcattctagtcaagtacaatgaacagcacgtcccaggcagccccttcactgctcgggtcacaggtgacgactccatgcgtatgtcccacctaaaggtcggctctgctgccgacatccccatcaacatctcagagacggatctcagcctgctgacggccactgtggtcccgccctcgggccgggaggagccctgtttgctgaagcggctgcgtaatggccacgtggggatttcattcgtgcccaaggagacgggggagcacctggtgcatgtgaagaaaaatggccagcacgtggccagcagccccatcccggtggtgatcagccagtcggaaattggggatgccagtcgtgttcgggtctctggtcagggccttcacgaaggccacacctttgagcctgcagagtttatcattgatacccgcgatgcaggctatggtgggctcagcctgtccattgagggccccagcaaggtggacatcaacacagaggacctggaggacgggacgtgcagggtcacctactgccccacagagccaggcaactacatcatcaacatcaagtttgccgaccagcacgtgcctggcagccccttctctgtgaaggtgacaggcgagggccgggtgaaagagagcatcacccgcaggcgtcgggctccttcagtggccaacgttggtagtcattgtgacctcagcctgaaaatccctgaaattagcatccaggatatgacagcccaggtgaccagcccatcgggcaagacccatgaggccgagatcgtggaaggggagaaccacacctactgcatccgctttgttcccgctgagatgggcacacacacagtcagcgtcaagtacaagggccagcacgtgcctgggagccccttccagttcaccgtggggcccctaggggaagggggagcccacaaggtccgagctgggggccctggcctggagagagctgaagctggagtgccagccgaattcagtatctggacccgggaagctggtgctggaggcctggccattgctgtcgagggccccagcaaggctgagatctcttttgaggaccgcaaggacggctcctgtggtgtggcttatgtggtccaggagccaggtgactacgaagtctcagtcaagttcaacgaggaacacattcccgacagccccttcgtggtgcctgtggcttctccgtctggcgacgcccgccgcctcactgtttctagccttcaggagtcagggctaaaggtcaaccagccagcctcttttgcagtcagcctgaacggggccaagggggcgatcgatgccaaggtgcacagcccctcaggagccctggaggagtgctatgtcacagaaattgaccaagataagtatgctgtgcgcttcatccctcgggagaatggcgtttacctgattgacgtcaagttcaacggtacccacatccctggaagccccttcaagatccgagttggggagcctgggcatggaggggacccaggcttggtgtctgcttacggagcaggtctggaaggcggtgtcacagggaacccagctgagttcgtcgtgaacacgagcaatgcgggagctggtgccctgtcggtgaccattgacggcccctccaaggtgaagatggattgccaggagtgccctgagggctaccgcgtcacctatacccccatggcacctggcagctacctcatctccatcaagtacggcggcccctaccacattgggggcagccccttcaaggccaaagtcacaggcccccgtctcgtcagcaaccacagcctccacgagacatcatcagtgtttgtagactctctgaccaaggccacctgtgccccccagcatggggccccgggtcctgggcctgctgacgccagcaaggtggtggccaagggcctggggctgagcaaggcctacgtaggccagaagagcagcttcacagtagactgcagcaaagcaggcaacaacatgctgctggtgggggttcatggcccaaggaccccctgcgaggagatcctggtgaagcacgtgggcagccggctctacagcgtgtcctacctgctcaaggacaagggggagtacacactggtggtcaaatgggggcacgagcacatcccaggcagcccctaccgcgttgtggtgccctgagtctggggcccgtgccagccggcagcccccaagcctgccccgctacccaagcagccccgccctcttcccctcaaccccggcccaggccgccctggccgcccgcctgtcactgcagctgcccctgccctgtgccgtgctgcgctcacctgcctccccagccagccgctgacctctcggctttcacttgggcagagggagccatttggtggcgctgcttgtcttctttggttctgggaggggtgagggatgggg

SEQ ID NO: 613 - DNA, 9432 bp, Homo sapiens
  ref <308>: DATABASE ACCESSION NUMBER: NM_001457
  ref <309>: DATABASE ENTRY DATE: 2001-06-18
gccgtggctccggtagcagcaagttcgaaccccgctcccgctccgcttcggttctcgctccttcggcccttgggcctccaaacaccagtccccggcagctcgttgcgcattgcgctctccccgccaccaggatgccggtaaccgagaaggatctagctgaggacgcgccttggaagaagatccagcagaacacgttcacacgctggtgcaacgagcacctcaagtgcgtgaacaaacgcatcggcaacctgcagaccgacctgagcgacgggctgcggctcatcgcgctgctcgaggtgctcagccagaagcgcatgtaccgcaagtaccatcagcggcccacctttcgccagatgcagctcgagaatgtgtccgtggcgctcgagttcctggaccgtgagagcatcaagctcgtgtccatcgatagcaaagccattgtggatgggaacctgaagctcatcttgggtctggtgtggacgctgatcctccactactccatctccatgcccgtgtgggaggatgaaggggatgatgatgccaagaagcagacgccaaagcagaggctgctggggtggattcagaacaagatcccctacttgcccatcaccaactttaaccagaactggcaagacggcaaagccctgggagccctggtagacagctgtgctccaggtctgtgcccagactgggaatcctgggacccgcagaagcctgtggataatgcacgagaagccatgcagcaggcagatgactggctgggtgtcccacaggtcatcactcctgaagaaatcattcacccggatgtggacgagcactcagttatgacttacctgtcccagttccccaaagccaagctcaagccgggggctcctctcaaacccaaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacaagtgacccctgacagcgacaagaacaagacatactctgtggagtatctgcccaaggtcaccgggctacacaaagtcacagtcctctttgcaggacagcacatctccaagagcccatttgaagtgagtgttgacaaggcccagggagatgccagtaaagtcactgcaaaaggtccagggttggaagctgtagggaacatcgccaataagcccacctactttgacatctatacggcaggagctggtgtgggtgacattggtgtggaggtggaagatccccaggggaagaacaccgtggagttgctcgtggaagacaaaggaaaccaggtgtatcgatgtgtgtacaaacccatgcagcctggccctcacgtggtcaagatcttctttgctggggacactattcctaagagtcccttcgttgtgcaggttggggaagcctgcaatccaaatgcctgccgggccagtggccgaggcctacaacccaaaggcgtccgtatccgggagaccacagatttcaaggttgacaccaaagctgcaggaagtggggagctcggggtaaccatgaagggtcctaagggtctggaggagctggtgaagcagaaagactttctggatggggtctacgcattcgagtattaccccagcaccccggggagatacagcattgccatcacatgggggggacaccacattccaaagagcccctttgaagttcaagttggccctgaagcgggtatgcagaaagtccgtgcttggggccctgggctccatggtgggattgtcgggcggtcagcggacttcgtggtagaatccattggctctgaagtggggtctctggggtttgccattgaaggcccctctcaggcaaagattgagtacaacgaccagaatgatggatcgtgtgatgtcaaatactggcccaaggagcctggcgaatatgctgttcacatcatgtgtgacgacgaagacatcaaggacagcccgtacatggccttcatccacccagccacgggaggctacaaccctgatctggttcgagcatacgggccaggtttggagaaatctggatgcattgtcaacaacctggccgagttcactgtggatcctaaggatgctggaaaagctcccttaaagatatttgctcaggatggggaaggccaacgcattgacatccagatgaagaaccggatggacggcacatatgcatgctcatacaccccggtgaaggccatcaagcacaccattgctgtggtctggggaggcgtgaacatcccgcacagcccctacagggtcaacatcgggcaaggtagccatcctcagaaggtcaaagtgtttgggccaggtgtggagagaagtggtctgaaggcaaatgaacctacacacttcacggtggactgtactgaggctggggaaggtgatgtcagtgttggcattaagtgtgatgcccgggtgttaagtgaagatgaggaagacgtggattttgacattattcacaatgccaatgatacgttcacagtcaaatatgtgcctcctgctgctgggcgatacactatcaaagttctctttgcatctcaggaaatccccgccagccctttcagagtcaaagttgacccttcccacgatgccagcaaagtgaaggcagaaggcccagggctcagcaaagcaggtgtggaaaatgggaaaccgacccacttcactgtctacaccaagggggctgggaaagccccgctcaacgtgcagttcaacagccctcttcctggcgatgcagtgaaggatttggatatcatcgataattatgactactctcacacggttaaatatacacccacccaacagggcaacatgcaggttctggtgacttacggtggcgatcccatccctaaaagccctttcactgtgggtgttgctgcaccgctggatctgagcaagataaaactcaatgggctggaaaacagggtggaagttgggaaggatcaggagttcaccgttgataccaggggggcaggaggccaggggaagctggacgtgacaatcctcagcccctctcggaaggtcgtgccatgcctagtgacacctgtgacaggccgggagaacagcacggccaagttcatccctcgggaggaggggctgtatgctgtagacgtgacctacgatggacaccctgtgcccgggagcccctacacagtggaggcctcgctgccaccagatcccagcaaggtgaaggcccacggtcccggcctcgaaggtggtctcgtgggcaagcctgccgagttcaccatcgataccaaaggagctggtactggaggtctgggcttaacggtggaaggtccgtgcgaggccaaaatcgagtgctccgacaatggtgatgggacctgctccgtctcttaccttcccacaaaacccggggagtacttcgtcaacatcctctttgaagaagtccacatacctgggtctcccttcaaagctgacattgaaatgccctttgacccctctaaagtcgtggcatcggggccaggtctcgagcacgggaaggtgggtgaagctggcctccttagcgtcaactgctcggaagcgggaccgggggccctgggcctggaagctgtctcggactcgggaacaaaagccgaagtcagtattcagaacaacaaagatggcacctacgcggtgacctacgtgcccctgacggccggcatgtacacgttgaccatgaagtatggtggcgaactcgtgccacacttccccgcccgggtcaaggtggagcccgccgtggacaccagcaggatcaaagtctttggaccaggaatagaagggaaagatgtgttccgggaagctaccaccgactttacagttgactctcggccgctgacccaggttgggggtgaccacatcaaggcccacattgccaacccctcaggggcctccaccgagtgctttgtcacagacaatgcggatgggacctaccaggtggaatacacaccctttgagaaaggtctccatgtagtggaggtgacatatgatgacgtgcctatcccaaacagtcccttcaaggtggctgtcactgaaggctgccagccatctagggtgcaagcccaaggacctggattgaaagaggcctttaccaacaagcccaatgtcttcaccgtggttaccagaggcgcaggaattggtgggcttggcataactgttgagggaccatcagagtcgaagataaattgcagagacaacaaggatggcagctgcagtgctgagtacattcctttcgcgccgggggattacgatgttaatatcacatatggaggagcccacatccctggcagccccttcagggttcctgtgaaggatgttgtggaccccagcaaggtcaagattgccggccccgggctgggctcaggcgtccgagcccgtgtcctgcagtccttcacggtggacagcagcaaggctggcctggctccgctggaagtgagggttctgggcccacgaggcttggtggagccagtgaacatggtggacaatggagatggcacacacacagtaacctacaccccatctcaggagggaccttacatggtctcagttaaatatgctgatgaagagattcctcgcagtcccttcaaggtcaaggtccttcccacatatgatgccagcaaagtgactgccagtggccccggccttagttcctatggtgtgcctgccagtctacctgtggactttgcaattgatgcccgagatgccggggaaggcctgcttgctgttcaaataacggaccaagaaggaaaacccaaaagagccattgtccatgacaataaagatggcacgtatgctgtcacctacatccccgacaagactgggcgctatatgattggagtcacctacgggggtgacgacatcccactttctccttatcgcatccgagccacacagacgggtgatgccagcaagtgcctggccacgggtcctggaatcgcctccactgtgaaaactggcgaagaagtaggctttgtggttgatgccaagactgccgggaagggtaaagtgacctgcacggttctgaccccagatggcactgaggccgaggccgatgtcattgagaatgaagatggaacctatgacatcttctacacagctgccaagccgggcacatatgtgatctatgtgcgcttcggtggtgttgatattcctaacagccccttcactgtcatggccacagatggggaagtcacagccgtggaggaggcaccggtaaatgcatgtccccctggattcaggccctgggtgaccgaagaggcctatgtcccagtgagtgacatgaacggcctgggatttaagccttttgacctggtcattccgtttgctgtcaggaaaggagaaatcactggagaggtccacatgccttctgggaagacagccacacctgagattgtggacaacaaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaagcagaaatcagctgcattgacaataaagatgggacatgcacagtgacctacctgccgactctgccaggcgactacagcattctggtcaagtacaatgacaagcacatccctggcagccccttcacagccaagatcacagatgacagcaggcggtgctcccaggtgaagttgggctcagccgctgacttcctgctcgacatcagtgagactgacctcagcagcctgacggccagcattaaggccccatctggccgagacgagccctgtctcctgaagaggctgcccaacaaccacattggcatctccttcatcccccgggaagtgggcgaacatctggtcagcatcaagaaaaatggcaaccatgtggccaacagccccgtgtctatcatggtggtccagtcggagattggtgacgcccgccgagccaaagtctatggccgcggcctgtcagaaggccggactttcgagatgtctgacttcatcgtggacacaagggatgcaggttatggtggcatatccttggcggtggaaggccccagcaaagtggacatccagacggaggacctggaagatggcacctgcaaagtctcctacttccctaccgtgcctggggtttatatcgtctccaccaaattcgctgacgagcacgtgcctgggagcccatttaccgtgaagatcagtggggagggaagagtcaaagagagcatcacccgcaccagtcgggccccgtccgtggccactgtcgggagcatttgtgacctgaacctgaaaatcccagaaatcaacagcagtgatatgtcggcccacgtcaccagcccctctggccgtgtgactgaggcagagattgtgcccatggggaagaactcacactgcgtccggtttgtgccccaggagatgggcgtgcacacggtcagcgtcaagtaccgtgggcagcacgtcaccggcagccccttccagttcaccgtggggccacttggtgaaggaggcgcccacaaggtgcgggcaggaggccctggcctggagagaggagaagcgggagtcccagctgagttcagcatttggacccgggaagcaggcgctggaggcctctccatcgctgttgagggccccagtaaggccgagattacattcgatgaccataaaaatgggtcgtgcggtgtatcttatattgcccaagagcctggtaactacgaggtgtccatcaagttcaatgatgagcacatcccggaaagcccctacctggtgccggtcatcgcaccctccgacgacgcccgccgcctcactgttatgagccttcaggaatcgggattaaaagttaaccagccagcatcctttgctataaggttgaatggcgcaaaaggcaagattgatgcaaaggtgcacagcccctctggagccgtggaggagtgccacgtgtctgagctggagccagataagtatgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacgggactcgaagggggcaccacaggtatccagtcggaattctttattaacaccacccgagcaggtccagggacattatccgtcaccatcgaaggcccatccaaggttaaaatggattgccaggaaacacctgaagggtacaaagtcatgtacacccccatggctcctggtaactacctgatcagtgtcaaatacggtgggcccaaccacatcgtgggcagtcccttcaaggccaaggtgacaggccagcgtctagttagccctggctcagccaacgagacctcatccatcctggtggagtcagtgaccaggtcgtctacagagacctgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagcccttttcatgtcacagtgccttaaaacagttttctcaaatcctggagagagttcttgtggttgcttttgttgcttgtttgtaattcattttatacaaagccctccagcctgtttgtggggctgaaaccccatccctaaaatattgctgttgtaaaatgccttcagaaataagtcctagactggactcttgagggacatattggagaatcttaagaaatgcaagcttgttcagggggctgagaagatcctgagtacactaggtgcaaaccagaactcttggtggaacagaccagccactgcagcagacagaccaggaacacaatgagactgacatttcaaaaaaacaaaactggctagcctgagctgctggttcactcttcagcatttatgaaacaaggctaggggaagatgggcagagaaaaaggggacacctagtttggttgtcatttggcaaaggagatgacttaaaatccgcttaatctcttccagtgtccgtgttaatgtatttggctattagatcactagcactgctttaccgctcctcatcgccaacacccccatgctctgtggccttcttacacttctcagagggcagagtggcagccgggcaccctacagaaactcagagggcagagtggcagccaggcccacatgtctctcaagtacctgtcccctcgctctggtgattatttcttgcagaatcaccacacgagaccatcccggcagtcatggttttgctttagttttccaagtccgtttcagtcccttccttggtctgaagaaattctgcagtggcgagcagtttcccacttgccaaagatcccttttaaccaacactagcccttgtttttaacacacgctccagcccttcatcagcctgggcagtcttaccaaaatgtttaaagtgatctcagaggggcccatggattaacgccctcatcccaaggtccgtcccatgacataacactccacacccgccccagccaacttcatgggtcactttttctggaaaataatgatctgtacagacaggacagaatgaaactcctgcggctctttggcctgaaagttgggaatggttgggggagagaagggcagcagcttattggtggtcttttcaccattggcagaaacagtgagagctgtgtggtgcagaaatccagaaatgaggtgtagggaattttgcctgccttcctgcagacctgagctggctttggaatgaggttaaagtgtcagggacgttgcctgagcccaaatgtgtagtgtggtctgggcaggcagacctttaggttttgctgcttagtcctgaggaagtggccactcttgtggcaggtgtagtatctggggcgagtgttgggggtaaaagcccaccctacagaaagtggaacagcccggacctgatgtgaaaggaccacgggtgttgtaagctgggaccggaaccaaactggaatcaaacgcgactgtaaattgtatcttataacttattaaataaaacattgctccgtaaaaaaaaaaa

SEQ ID NO: 614 - DNA, 1476 bp, Homo sapiens
  ref <308>: DATABASE ACCESSION NUMBER: NM_001463
  ref <309>: DATABASE ENTRY DATE: 2001-06-18
acggggcctgggcggsaggggcggtggctggagctcggtaaagctcgtgggaccccattgggggaatttgatccaaggaagcggtgattgccgggggaggagaagctcccagatccttgtgtccacttgcagcgggggaggcggagacgcggagcgggccttttggcgtccactgcgcggctgcaccctgccccatcctgccgggatcatggtctgcggcagcccgggagggatgctgctgctgcgggccgggctgcttgccctggctgctctctgcctgctccgggtgcccggggctcgggctgcagcctgtgagcccgtccgcatccccctgtgcaagtccctgccctggaacatgactaagatgcccaaccacctgcaccacagcactcaggccaacgccatcctggccatcgagcagttcgaaggtctgctgggcacccactgcagccccgatctgctcttcttcctctgtgccatgtacgcgcccatctgcaccattgacttccagcacgagcccatcaacccctgtaagtctgtgtgcgagcgggcccggcagggctgtgagcccatactcatcaagtaccgccactcgtggccggagaacctggcctgcgaggagctgccagtgtacgacaggggcgtgtgcatctctcccgaggccatcgttactgcggacggagctgattttcctatggattctagtaacggaaactgtagaggggcaagcagtgaacgctgtaaatgtaagcctattagagctacacagaagacctatttccggaacaattacaactatgtcattcgggctaaagttaaagagataaagactaagtgccatgatgtgactgcagtagtggaggtgaaggagattctaaagtcctctctggtaaacattccacgggacactgtcaacctctataccagctctggctgcctctgccctccacttaatgttaatgaggaatatatcatcatgggctatgaagatgaggaacgttccagattactcttggtggaaggctctatagctgagaagtggaaggatcgactcggtaaaaaagttaagcgctgggatatgaagcttcgtcatcttggactcagtaaaagtgattctagcaatagtgattccactcagagtcagaagtctggcaggaactcgaacccccggcaagcacgcaactaaatcccgaaatacaaaaagtaacacagtggacttcctattaagacttacttgcattgctggactagcaaaggaaaattgcactattgcacatcatattctattgtttactataaaaatcatgtgataactgattattacttctgtttctcttttggtttctgcttctctcttctctcaacccctttgtaatggtttgggggcagactcttaagtatattgtgagttttctatttcactaatcatgagaaaaactgttcttttgcaataataataaattaaacatgctgtta

SEQ ID NO: 615 - DNA, 2400 bp, Homo sapiens
  ref <308>: DATABASE ACCESSION NUMBER: NM_001465
  ref <309>: DATABASE ENTRY DATE: 2001-06-18
taggatggaaaggcagatgtaaagtccctcatggcgaaatataacacggggggcaacccgacagaggatgtctcagtcaatagccgacccttcagagtcacagggccaaactcatcttcaggaatacaagcaagaaagaacttattcaacaaccaaggaaatgccagccctcctgcaggacccagcaatgtacctaagtttgggtccccaaagccacctgtggcagtcaaaccttcttctgaggaaaagcctgacaaggaacccaagcccccgtttctaaagcccactggagcaggccaaagattcggaacaccagccagcttgaccaccagagaccccgaggcgaaagtgggatttctgaaacctgtaggccccaagcccatcaacttgcccaaagaagattccaaacctacatttccctggcctcctggaaacaagccatctcttcacagtgtaaaccaagaccatgacttaaagccactaggcccgaaatctgggcctactcctccaacctcagaaaatgaacagaagcaagcgtttcccaaattgactggggttaaagggaaatttatgtcagcatcacaagatcttgaacccaagcccctcttccccaaacccgcctttggccagaagccgcccctaagtaccgagaactcccatgaagacgaaagccccatgaagaatgtgtcttcatcaaaagggtccccagctcccctgggagtcaggtccaaaagcggccctttaaaaccagcaagggaagactcagaaaataaagaccatgcaggggagatttcaagtttgccctttcctggagtggttttgaaacctgctgcgagcaggggaggcctaggtctctccaaaaatggtgaagaaaaaaaggaagataggaagatagatgctgctaagaacaccttccagagcaaaataaatcaggaagagttggcctcagggactcctcctgccaggttccctaaggccccttctaagctgacagtgggggggccatggggccaaagtcaggaaaaggaaaagggagacaagaattcagccaccccgaaacagaagccattgcctcccttgtttaccttgggtccacctccaccaaaacccaacagaccaccaaatgttgacctgacgaaattccacaaaacctcttctggaaacagtactagcaaaggccagacgtcttactcaacaacttccctgccaccacctccaccatcccatccggccagccaaccaccattgccagcatctcacccatcacaaccaccagtcccaagcctacctcccagaaacattaaacctccgtttgacctaaaaagccctgtcaatgaagacaatcaagatggtgtcacgcactctgatggtgctggaaatctagatgaggaacaagacagtgaaggagaaacatatgaagacatagaagcatccaaagaaagagagaagaaaagggaaaaggaagaaaagaagaggttagagctggagaaaaaggaacagaaagagaaagaaaagaaagaacaagaaataaagaagaaatttaaactaacaggccctattcaagtcatccatcttgcaaaagcttgttgtgatgtcaaaggaggaaagaatgaactgagcttcaagcaaggagagcaaattgaaatcatccgcatcacagacaacccagaaggaaaatggttgggcagaacagcaaggggttcatatggctatattaaaacaactgctgtagagattgactatgattctttgaaactgaaaaaagactctcttggtgccccttcaagacctattgaagatgaccaagaagtatatgatgatgttgcagagcaggatgatattagcagccacagtcagagtggaagtggagggatattccctccaccaccagatgatgacatttatgatgggattgaagaggaagatgctgatgatggtttccctgctcctcctaaacaattggacatgggagatgaagtttacgatgatgtggatacctctgatttccctgtttcatcagcagagatgagtcaaggaactaattttggaaaagctaagacagaagaaaaggaccttaagaagctaaaaaagcaggaaaaagaagaaaaagacttcaggaaaaaatttaaatatgatggtgaaattagagtcctatattcaactaaagttacaacttccataacttctaaaaagtggggaaccagagatctacaggtaaaacctggtgaatctctagaagttatacaaaccacagatgacacaaaagttctctgcagaaatgaagaagggaaatatggttatgtccttcggagttacctagcggacaatgatggagagatctatgatgatattgctgatggctgcatctatgacaatgactagcactcaactttggtcatt

SEQ ID NO: 616 - DNA, 3186 bp, Homo sapiens
  ref <308>: DATABASE ACCESSION NUMBER: NM_001481
  ref <309>: DATABASE ENTRY DATE: 2001-06-18
ggagtctcgcgaggatcttgtgacttatcgcggcatcgcccagcggttgccgggaaacggcgtggcttccgggggcgggcgccctggtcccggagtcgccgctgggcctgtccgctggcgtcatggcaccgaaaaagaaagggaagaaaggcaaagccaaaggcaccccgattgtcgatgggctcgctccagaggacatgagcaaggagcaggtggaggagcatgtcagccgcatccgggaggagctggaccgcgagcgggaggaacgaaactacttccagctggagcgggacaagatccacaccttctgggagatcacacggaggcagctggaggagaagaaggctgagctgcggaacaaagaccgggagatggaagaagccgaggagaggcaccaggtggagatcaaggtgtacaagcagaaagtgaagcacctgctatatgagcaccagaacaacctgacagagatgaaggctgagggcactgtagtcatgaagctggcacagaaagagcaccgcatacaggagagtgtgctgcgcaaggacatgcgggcactgaaggtggagctcaaggagcaggagctggccagtgaggtggtggtgaagaacctgcggctgaaacacaccgaggagatcaccaggatgcggaatgattttgagaggcaagttcgagaaattgaggccaagtatgataagaagatgaagatgctgagggacgaactcgacttgcggagaaagactgagctccacgaagtggaggagaggaagaatggccagatccacacgctgatgcagcgccacgaggaggccttcaccgacattaagaactactacaacgacatcaccctcaacaacctggccctcatcaactccctcaaggagcagatggaggacatgcggaagaaggaggaccacctggagagggagatggcagaggtgtctgggcagaacaagcgcctggcagaccctctccagaaggctcgggaggagatgagcgagatgcagaaacagctcgcaaactacgagagggacaagcagatcctgctttgcacaaaagcccgtttgaaagtcagggagaaagagctgaaagacctgcagtgggagcatgaagtgttagagcagcgattcaccaaggtgcagcaggagcgggacgagctctatcggaagttcaccgcagccatccaggaggtgcagcagaagacagggttcaagaacctcgtgctagaacgcaagctgcaggctctgagcgccgctgtggagaagaaggaggtgcagttcaacgaggtcctggctgcctctaacctggaccctgcagccctgacgctggtgtcccgcaagctggaggatgttcttgagtcgaagaacagcaccatcaaggacctgcagtatgagctggcccaggtctgtaaggcccataacgacctgctgcgcacgtatgaggcaaagctgctggccttcgggatccctctggacaacgtgggcttcaagcccttggaaacagctgtgatcggacagacgctgggccagggccccgcgggactggtgggcaccccgacgtagctgccccccctggggggccacagcccagagaaccagcctaggaacactcgggatgacaccccttatcacaccaaggacagcaagttttttagattttatcatcagcaaatgaaagcttttcacatgttcttgccatcctctttcctggctctgtggaggagaaccacctgcaggaccctcacccatggtgtccctgtcgctcccttccctgggtgccgcacgtccagcctgtgtccaggcctactccctggtctcacctccgaccacagtcggcggcaccttctcagagtgccccgcactcacctgggggttggggcaatgccgcgctgtgctgcctgtcttcgcgccactgttgtcccaccgaatggacagctttgcaggtgctggcactaacttcattgacacctgagtcacagctgcccagtgggattctccagggggccgggacttccctaggaagtggtgagccaatgctccctgatgagcacaaagcccgctctgttgagggctgggtgggtgcagccagcgtgcgggaacgggcaggcagcctcccgctgccagtcttcgctctaactccctcggtaggtgatgtaggaccaggggcacgtggaacttctgggccttgctggtgatggttaaaacaacctgagatggagaggccaggagagagtataaggggatagcagcaaaccacctatctggccccaacacacctgagagaattcagcagcccagactgagggtctgggatggggtgaaccttccgcaccagagggacactccacagaagccacagcccagtaagtcaggcgcttctgcggcggctccagtgtggggtgaggcagtgaggttaggcccagagagctggagttggctcagatgaaaacctctgtcaacaaagaggggatgaatcacccttggcccagcctccccacaaagcctgaccctgggcaggtgagtgacgggtgtgtcctcgtagagtctattgctgcctggacacctttcttttgggagctcaaagcaagtgagctcacctacctgccaccgcccaggaccagtctgcccactgcctaaatgatgcccggccagcaggacctggcctgcagatcccagtgagtcatgagcctcagccccctccagcccactggggctctcacctccacatgtgggtagaagctttcctgccccctcttcctctagtagccctcagtgtcgaaggtgagcttgtaggtgcctgccttcatctggtccaggacagtgaccatctgggtctgtgtagctggggagagaatgaggctgcagagatggggaccagaagccccccaccccagctttcctgggtctgcatcccagtgggcctcagacactgccctgccacctgtcagacttgggtgagcagacacagtgaggctgttaggtcctgcagttccagagcagtctagggacaccactgccctgtctttaggaaatcacaacacagagaagcaaaaagggaaaaagtctcccacaatttatcccatgagcaagaaccactttatagctggcatatatttttccagattttctctatgcataagtatatttgtttaaaaacttataaagtggattatactatttgtattgtttt

SEQ ID NO: 617 - DNA, 2225 bp, Homo sapiens
  ref <308>: DATABASE ACCESSION NUMBER: NM_001493
  ref <309>: DATABASE ENTRY DATE: 2001-06-18
cggcggcggcggtggcggcggcgactgctgcggtgaaggaggaggaggagccgagcgggcgctggcaccgaggcctgaccatggacgaggaatacgatgtgatcgtgctggggaccggtctcaccgaatgcatcctgtcgggcatcatgtctgtgaacgggaagaaggtgctgcacatggaccggaacccctactacgggggcgagagctcctccatcacacccctggaggagctgtataagcgttttcagttgctggaggggccccctgagtcgatgggccgaggccgagactggaatgttgacctgattcccaaattcctcatggctaacgggcagctggtaaagatgctactgtatacagaggtgactcgctacctggacttcaaggtggtggagggcagctttgtctacaaggggggcaagatctacaaagtgccgtccactgagactgaggccttggcttccaatctgatgggcatgtttgagaaacggcgcttccgcaagttcctggtgtttgtggcaaacttcgatgagaatgaccccaagacctttgagggcgttgacccccagactaccagcatgcgtgacgtctaccggaagtttgatctgggccaggatgtcatcgatttcactggccatgccctggcgctctaccgcactgatgactacctggaccagccctgccttgagaccgtcaaccgcatcaagttgtacagtgagtccctggcccggtatggcaagagcccatatttatacccgctctacggcttgggcgagctgccccagggttttgcaagattgagtgccatctatggggggacatatatgctgaacaaacctgtggatgacatcatcatggagaacggcaaggtggtgggcgtgaagtctgagggagaggtggcccgctgcaagcagctgatctgtgaccccagctacatcccggaccgtgtgcggaaggctggccaggttatccgcatcatctgtatccttagccaccccatcaagaacaccaacgacgccaactcctgccaaataatcatcccccagaaccaggtcaacaggaagtcagacatctacgtgtgcatgatctcctatgcacacaacgtggcggcccagggcaagtacatagctattgccagcactactgtggagaccacggaccctgaaaaggaggtggagccggctctggagctgttggagcccattgaccagaagtttgtggctatcagtgacttgtatgagcccattgatgatggttgtgagagccaggtgttctgttcctgctcctacgatgccaccacacactttgagacaacctgcaacgacatcaaagacatctacaaacgcatggctggcacggcctttgactttgagaacatgaagcgcaaacagaacgacgtctttggagaagctgagcagtgattgtggccgcccccagcccctgctgccccagcctgtgtctgttctcctcgagggctccagcatcctctgcttcccccaccacgttcccatcacccacctcattgatccactgaccaaatccttaaccctagcgatggcttgggagatggggggttggatagcatcctctttcttggcccttccttatcctaggaaaagagggttcctctccttgtgtgtgtctcttccccccacccctaattcttctgctctgtttgggaagacgtggaggaaaaggtgacttctgcccccaccgctcttacccccactgtagtggcctttggagatgcccccacctcccccccaccaactctcgcgtgttggagagaaggggccctcccagcacaaagttgcattcctccccccctaatttattctaatttattaactttgacccaccctttctgagcctgcagccttcccgtgtggcctgagggctgtcgagtgagctgccccagccccctcccagcccttgcccagcctgggggagtggggaaggcttgggcatggccccgttggaggttgatttgctgttttgtttcttgtctttgtgttctgtggtacttgctgagagaaaagaaaagtgagccaagcagaaggaggtggaaaacggacccaaaccccagtgtgccctgccccatgcctttcctttagtggtgggaaacccttatcttgcaaagtgaatgtgtccccttccccaccctctagtgtatttcacagaaaacaaaacctcccaataaaacggttgaaacctgaaaaaaa

SEQ ID NO: 618 - DNA, 2274 bp, Homo sapiens
  ref <308>: DATABASE ACCESSION NUMBER: NM_001494
  ref <309>: DATABASE ENTRY DATE: 2001-06-18
ggcggtcggtctcgccttgtcgccagctccattttcctctctttctcttcccctttccttcgcgcccaagagcgcctcccagcctcgtagggtggtcacggagcccctgcgccttttccttgctcgggtcctgcgtccgcgcctgccccgccatgaatgaggagtacgacgtgatcgtgctgggcaccggcctgacggaatgtatcctgtcaggtataatgtcagtgaatggcaagaaagttcttcatatggatcgaaacccttactacggaggagaaagtgcatctataacaccattggaagatttatacaaaagatttaaaataccaggatcaccacccgagtcaatggggagaggaagagactggaatgttgacttgattcccaagttccttatggctaatggtcagctggttaagatgctgctttatacagaggtaactcgctatctggattttaaagtgactgaagggagctttgtctataagggtggaaaaatctacaaggttccttccactgaagcagaagccctggcatctagcctaatgggattgtttgaaaaacgtcgcttcaggaaattcctagtgtatgttgccaacttcgatgaaaaagatccaagaacttttgaaggcattgatcctaagaagaccacaatgcgagatgtgtataagaaatttgatttgggtcaagacgttatagattttactggtcatgctcttgcactttacagaactgatgattacttagatcaaccgtgttatgaaaccattaatagaattaaactttacagtgaatctttggcaagatatggcaaaagcccatacctttatccactctatggccttggagaactgccccaaggatttgcaaggctaagtgctatttatggaggtacctatatgctgaataaacccattgaagaaatcattgtacagaatggaaaagtaattggtgtaaaatctgaaggagaaattgctcgctgtaagcagctcatctgtgaccccagctacgtaaaagatcgggtagaaaaagtgggccaggtgatcagagttatttgcatcctcagccaccccatcaagaacaccaatgatgccaactcctgccagatcattattccacagaaccaagtcaatcgaaagtcagatatctacgtctgcatgatctcctttgcgcacaatgtagcagcacaagggaagtacattgctatagttagtacaactgtggaaaccaaggagcctgagaaggaaatcagaccagctttggagctcttggaaccaattgaacagaaatttgttagcatcagtgacctcctggtaccaaaagacttgggaacagaaagccagatctttatttcccgcacatatgatgccaccactcattttgagacaacgtgtgatgacattaaaaacatctataagaggatgacaggatcagagtttgactttgaggaaatgaagcgcaagaagaatgacatctatggggaagactaacagcagtacatgttattatgtaattaggacacatttaaaatttggcaaataatgcatataatgaaatcaatattgtaaggcctgcttttgtaatgaaaatggagagaatgaagagcgctgtgccagtaaatactccccttcacctttctaattattaacttgttttcatggagtggctattcagcattggcagttaccacattctgttcaatttaaccaaactggcttttttttttttctagtgaagttaaacaaacattgggataccgacacagacaacttgagacagtttttttaatcttttaatcagtgtagctatgtgctgctgctgctcaagagctggatccatacaggttgtgtgtcatctgtcctcttgaggttcaggagattctaaattgaatattccacggtttgggacagcatccggaagttttccctatgactttatattttgtattatgtcaaatgttatggcagggcccaaatagcatagccacaagtttggtttatgtgggcataaaattctaaccaaaccccagacatagggagtcatttggagaaagcctgtatgtggtgttttaacctaataaagttgatgagagagaaggggagaggaagcgaacataaagcgggtcaagtgtagtgcatcttttgtatctcaggcgtggcttcttcagtggaccaagctgcaatgcagtattgacttgacagagcctctacttctgtctcaaaatggctccaaatgatttctgtactgcaaaataaagccaaattctggaaacta

SEQ ID NO: 619 - DNA, 1520 bp, Homo sapiens
  ref <308>: DATABASE ACCESSION NUMBER: NM_001500
  ref <309>: DATABASE ENTRY DATE: 2001-06-18
ccgcgttcctgccggcaccgcgcctgccctctgccgcgctccgccctgccgccgaccgcacgcccgccgcgggacatggcacacgcaccggcacgctgccccagcgcccggggctccggggacggcgagatgggcaagcccaggaacgtggcgctcatcaccggtatcacaggccaggatggttcctacctggctgagttcctgctggagaaaggctatgaggtccatggaattgtacggcggtccagttcatttaatacgggtcgaattgagcatctgtataagaatccccaggctcacattgaaggaaacatgaagttgcactatggcgatctcactgacagtacctgccttgtgaagatcattaatgaagtaaagcccacagagatctacaaccttggagcccagagccacgtcaaaatttcctttgacctcgctgagtacactgcggacgttgacggagttggcactctacgacttctagatgcagttaagacttgtggccttatcaactctgtgaagttctaccaagcctcaacaagtgaactttatgggaaagtgcaggaaataccccagaaggagaccacccctttctatccccggtcaccctatggggcagcaaaactctatgcctattggattgtggtgaacttccgtgaggcgtataatctctttgcagtgaacggcattctcttcaatcatgagagtcccagaagaggagctaatttcgttactcgaaaaattagccggtcagtagctaagatttaccttggacaactggaatgtttcagtttgggaaatctggatgccaaacgagattggggccatgccaaggactatgtggaggctatgtggttgatgttgcagaatgatgagccggaggacttcgttatagctactggggaggtccatagtgtccgggaatttgtcgagaaatcattcttgcacattggaaaaaccattgtgtgggaaggaaagaatgaaaatgaagtgggcagatgtaaagagaccggcaaagttcacgtgactgtggatctcaagtactaccggccaactgaagtggactttctgcagggcgactgcaccaaagcgaaacagaagctgaactggaagccccgggtcgctttcgatgagctggtgagggagatggtgcacgccgacgtggagctcatgaggacaaaccccaatgcctgagcagcgcctcggagcccggcccgccctccggctacaatccccgcagagtctccggtgcagacgcgctgcggggatggggagcggcgtgccaatctgcgggtcccctgcggcccctgctgccgctgcgctgtcccggccgcaagagcggggccgccccgccgaggtttgtagcagccgggatgtgaccctccagggtttgggtcgctttgcgtttgtcgaagcctcctctgaatggctttgtgaaatcaagatgttttaatcacattcactttacttgaaattatgttgttacacaacaaattgtggggccttcaaattgtttttcc

SEQ ID NO: 620 - DNA, 1670 bp, Homo sapiens
  ref <308>: DATABASE ACCESSION NUMBER: NM_001504
  ref <309>: DATABASE ENTRY DATE: 2001-06-18
ccaaccacaagcaccaaagcagaggggcaggcagcacaccacccagcagccagagcaccagcccagccatggtccttgaggtgagtgaccaccaagtgctaaatgacgccgaggttgccgccctcctggagaacttcagctcttcctatgactatggagaaaacgagagtgactcgtgctgtacctccccgccctgcccacaggacttcagcctgaacttcgaccgggccttcctgccagccctctacagcctcctctttctgctggggctgctgggcaacggcgcggtggcagccgtgctgctgagccggcggacagccctgagcagcaccgacaccttcctgctccacctagctgtagcagacacgctgctggtgctgacactgccgctctgggcagtggacgctgccgtccagtgggtctttggctctggcctctgcaaagtggcaggtgccctcttcaacatcaacttctacgcaggagccctcctgctggcctgcatcagctttgaccgctacctgaacatagttcatgccacccagctctaccgccgggggcccccggcccgcgtgaccctcacctgcctggctgtctgggggctctgcctgcttttcgccctcccagacttcatcttcctgtcggcccaccacgacgagcgcctcaacgccacccactgccaatacaacttcccacaggtgggccgcacggctctgcgggtgctgcagctggtggctggctttctgctgcccctgctggtcatggcctactgctatgcccacatcctggccgtgctgctggtttccaggggccagcggcgcctgcgggccatgcggctggtggtggtggtcgtggtggcctttgccctctgctggaccccctatcacctggtggtgctggtggacatcctcatggacctgggcgctttggcccgcaactgtggccgagaaagcagggtagacgtggccaagtcggtcacctcaggcctgggctacatgcactgctgcctcaacccgctgctctatgcctttgtaggggtcaagttccgggagcggatgtggatgctgctcttgcgcctgggctgccccaaccagagagggctccagaggcagccatcgtcttcccgccgggattcatcctggtctgagacctcagaggcctcctactcgggcttgtgaggccggaatccgggctcccctttcgcccacagtctgacttccccgcattccaggctcctccctccctctgccggctctggctctccccaatatcctcgctcccgggactcactggcagccccagcaccaccaggtctcccgggaagccaccctcccagctctgaggactgcaccattgctgctccttagctgccaagccccatcctgccgcccgaggtggctgcctggagccccactgcccttctcatttggaaactaaaacttcatcttccccaagtgcggggagtacaaggcatggcgtagagggtgctgccccatgaagccacagcccaggcctccagctcagcagtgactgtggccatggtccccaagacctctatatttgctcttttatttttatgtctaaaatcctgcttaaaacttttcaataaacaagatcgtcaggaccaaaaaaaaaaaaaaaaaaaaaaaaaaaaaaaaaaaaaaaaaaaaaaa

SEQ ID NO: 621 - DNA, 1103 bp, Homo sapiens
  ref <308>: DATABASE ACCESSION NUMBER: NM_001511
  ref <309>: DATABASE ENTRY DATE: 2001-06-18
cacagagcccgggccgcaggcacctcctcgccagctcttccgctcctctcacagccgccagacccgcctgctgagccccatggcccgcgctgctctctccgccgcccccagcaatccccggctcctgcgagtggcactgctgctcctgctcctggtagccgctggccggcgcgcagcaggagcgtccgtggccactgaactgcgctgccagtgcttgcagaccctgcagggaattcaccccaagaacatccaaagtgtgaacgtgaagtcccccggaccccactgcgcccaaaccgaagtcatagccacactcaagaatgggcggaaagcttgcctcaatcctgcatcccccatagttaagaaaatcatcgaaaagatgctgaacagtgacaaatccaactgaccagaagggaggaggaagctcactggtggctgttcctgaaggaggccctgcccttataggaacagaagaggaaagagagacacagctgcagaggccacctggattgtgcctaatgtgtttgagcatcgcttaggagaagtcttctatttatttatttattcattagttttgaagattctatgttaatattttaggtgtaaaataattaagggtatgattaactctacctgcacactgtcctattatattcattctttttgaaatgtcaaccccaagttagttcaatctggattcatatttaatttgaaggtagaatgttttcaaatgttctccagtcattatgttaatatttctgaggagcctgcaacatgccagccactgtgatagaggctggcggatccaagcaaatggccaatgagatcattgtgaaggcaggggaatgtatgtgcacatctgttttgtaactgtttagatgaatgtcagttgttatttattgaaatgatttcacagtgtgtggtcaacatttctcatgttgaaactttaagaactaaaatgttctaaatatcccttggacattttatgtctttcttgtaaggcatactgccttgtttaatggtagttttacagtgtttctggcttagaacaaaggggcttaattattgatgttttcatagagaatataaaaataaagcacttatag

SEQ ID NO: 622 - DNA, 1155 bp, Homo sapiens
  ref <308>: DATABASE ACCESSION NUMBER: NM_001513
  ref <309>: DATABASE ENTRY DATE: 2001-06-18
aagacacgggcctgattcgtcgagtctcactgagccttagtcgtcggcaggtcccaggcgcgaagtttctcggcctggaggagggggtcgcgcgaagtgccagatgcaggcggggaagcccatcctctattcctatttccgaagctcctgctcatggagagttcgaattgctctggccttgaaaggcatcgactacaagacggtgcccatcaatctcataaaggataggggccaacagttttctaaggacttccaggcactgaatcctatgaagcaggtgccaaccctgaagattgatggaatcaccattcaccagtcactggccatcattgagtatctagaggagacgcgtcccactccgcgacttctgcctcaggacccaaagaagagggccagcgtgcgtatgatttctgacctcatcgctggtggcatccagcccctgcagaacctgtctgtcctgaagcaagtgggagaggagatgcagctgacctgggcccagaacgccatcacttgtggctttaacgccctggagcagatcctacagagcacagcgggcatatactgtgtaggagacgaggtgaccatggctgatctgtgcttggtgcctcaggtggcaaatgctgaaagattcaaggtggatctcaccccctaccctaccatcagctccatcaacaagaggctgctggtcttggaggccttccaggtgtctcacccctgccggcagccagatacacccactgagctgagggcctagctcccaaatcctgccccgttggcacagggccacaggagcagaagctgggtgggctgaagaggcctggaaacgagagtcttaattgaggagatgggagactcgaactctagccctggatctgccttcctgctgaaacttgttccacctcagtcccctcatctgtcacacgcatgtggggtggagtagggagatgcggggagcagggtgggcaggaatactgttatctatgtgacggggcagtcgtgaggctgagatgagaatgcggattaaaatgcctggcgtgctcaccgtaacaccacggggaaggctgtgtgccttttctcatccgcttttgttgtgtgtgactccaaagaatgcccgcgctgaaatttggcgtgaattaaactgaagcccaggcctct

SEQ ID NO: 623 - DNA, 1985 bp, Homo sapiens
  ref <308>: DATABASE ACCESSION NUMBER: NM_001527
  ref <309>: DATABASE ENTRY DATE: 2001-06-18
cgccgagctttcggcacctctgccgggtggtaccgagccttcccggcgccccctcctctcctcccaccggcctgcccttccccgcgggactatcgcccccacgtttccctcagcccttttctctcccggccgagccgcggcggcagcagcagcagcagcagcagcaggaggaggagcccggtggcggcggtggccggggagcccatggcgtacagtcaaggaggcggcaaaaaaaaagtctgctactactacgacggtgatattggaaattattattatggacagggtcatcccatgaagcctcatagaatccgcatgacccataacttgctgttaaattatggcttatacagaaaaatggaaatatataggccccataaagccactgccgaagaaatgacaaaatatcacagtgatgagtatatcaaatttctacggtcaataagaccagataacatgtctgagtatagtaagcagatgcatatatttaatgttggagaagattgtccagcgtttgatggactctttgagttttgtcagctctcaactggcggttcagttgctggagctgtgaagttaaaccgacaacagactgatatggctgttaattgggctggaggattacatcatgctaagaaatacgaagcatcaggattctgttacgttaatgatattgtgcttgccatccttgaattactaaagtatcatcagagagtcttatatattgatatagatattcatcatggtgatggtgttgaagaagctttttatacaacagatcgtgtaatgacggtatcattccataaatatggggaatactttcctggcacaggagacttgagggatattggtgctggaaaaggcaaatactatgctgtcaattttccaatgtgtgatggtatagatgatgagtcatatgggcagatatttaagcctattatctcaaaggtgatggagatgtatcaacctagtgctgtggtattacagtgtggtgcagactcattatctggtgatagactgggttgtttcaatctaacagtcaaaggtcatgctaaatgtgtagaagttgtaaaaacttttaacttaccattactgatgcttggaggaggtggctacacaatccgtaatgttgctcgatgttggacatatgagactgcagttgcccttgattgtgagattcccaatgagttgccatataatgattactttgagtattttggaccagacttcaaactgcatattagtccttcaaacatgacaaaccagaacactccagaatatatggaaaagataaaacagcgtttgtttgaaaatttgcgcatgttacctcatgcacctggtgtccagatgcaagctattccagaagatgctgttcatgaagacagtggagatgaagatggagaagatccagacaagagaatttctattcgagcatcagacaagcggatagcttgtgatgaagaattctcagattctgaggatgaaggagaaggaggtcgaagaaatgtggctgatcataagaaaggagcaaagaaagctagaattgaagaagataagaaagaaacagaggacaaaaaaacagacgttaaggaagaagataaatccaaggacaacagtggtgaaaaaacagataccaaaggaaccaaatcagaacagctcagcaacccctgaatttgacagtctcaccaatttcagaaaatcattaaaaagaaaatattgaaaggaaaatgttttctttttgaagacttctggcttcattttatactactttggcatggactgtatttattttcaaatgggactttttcgtttttgtttttctgggcaagttttattgtgagattttctaattatgaagcaaaatttcttttctccaccatgctttatgtgatagtatttaaaattgatgtgagttattatgtcaaaaaaactgatctattaaagaagtaattggcctttctgagctgaaaaaaaaaaaaaaaaag

SEQ ID NO: 624 - DNA, 1712 bp, Homo sapiens
  ref <308>: DATABASE ACCESSION NUMBER: NM_001529
  ref <309>: DATABASE ENTRY DATE: 2001-06-18
gccaaattcgggcgaggggcgggcgcggcggagccatgcagtacccgcaccccgggccggcggcgggcgccgtgggggtgccgctgtacgcgcccacgccgctgctgcaacccgcacacccgacgcccttttacatcgaggacatcctgggccgcgggcccgccgcgcccacgcccgcccccacgctgccgtcccccaactcctccttcaccagcctcgtgtccccctaccggaccccggtgtacgagcccacgccgatccatccagccttctcgcaccactccgccgccgcgctggccgctgcctacggacccggcggcttcgggggccctctgtaccccttcccgcggacggtgaacgactacacgcacgccctcgtccgccacgaccccctgggcaaacctctactctggagccccttcttgcagaggcctctgcataaaaggaaaggcggccaggtgagattctccaacgaccagaccatcgagctggagaagaaattcgagacgcagaaatatctctctccgcccgagaggaagcgtctggccaagatgctgcagctcagcgagagacaggtcaaaacctggtttcagaatcgacgcgctaaatggaggagactaaaacaggagaaccctcaaagcaataaaaaagaagaactggaaagtttggacagttcctgtgatcagaggcaagatttgcccagtgaacagaataaaggtgcttctttggatagctctcaatgttcgccctcccctgcctcccaggaagaccttgaatcagagatttcagaggattctgatcaggaagtggacattgagggcgataaaagctattttaatgctggatgatgaccactggcattggcatgttcagaaaactggatttaggaataatgttttgctacagaaaatcttcatagaagaactggaaggctatataagaaagggaatcaattctctggtattctggaaacctaaaaatatttggtgcactgctcaattaacaaacctacatggagaccttaattttgacttaacaatagtttatgtactgctcttaggttgttttgataagtgacgattatagtgattaaattcttccccctttaaaaaaacagttagtggttttcactatttataaaaaattaattttgaactttttgttaaatttttaagttatagctttaaaggttttaataggaccttcttgaacgacttttctgtaatctgtttatctcccacttaatggaaaggcaaaggggtaccccaaatccagaggtgcctacatttcaggcagccttggagtattttaaaaggaaaacattctttacttttatatgacattcttatactgctgtctcaaatcctttttcatttcagagctcttgtctcagagatgtgtgttctttttgtcagagatatggttgatgagaatcttaaatgcttgttttgcactatcacttagtacctgtttgaccaaggtgttaagggatagtacctcccatcagcagagaaactgacctgactaaagttaatcgcagatgaactagaagtcacagttaattaaatgtaagtagatgtagatactgttttatatcaaacaatgtttataatgtgtatatagaattgttcactgtaaaaaaaatggccaaaatgtgttttttttttaataagtaacttgactataaaataaagccgtccgtggccgaattc

SEQ ID NO: 625 - DNA, 3933 bp, Homo sapiens
  ref <308>: DATABASE ACCESSION NUMBER: NM_001530
  ref <309>: DATABASE ENTRY DATE: 2001-06-18
cacgaggcagcactctcttcgtcgcttcggccagtgtgtcgggctgggccctgacaagccacctgaggagaggctcggagccgggcccggaccccggcgattgccgcccgcttctctctagtctcacgaggggtttcccgcctcgcacccccacctctggacttgcctttccttctcttctccgcgtgtggagggagccagcgcttaggccggagcgagcctgggggccgcccgccgtgaagacatcgcggggaccgattcaccatggagggcgccggcggcgcgaacgacaagaaaaagataagttctgaacgtcgaaaagaaaagtctcgagatgcagccagatctcggcgaagtaaagaatctgaagttttttatgagcttgctcatcagttgccacttccacataatgtgagttcgcatcttgataaggcctctgtgatgaggcttaccatcagctatttgcgtgtgaggaaacttctggatgctggtgatttggatattgaagatgacatgaaagcacagatgaattgcttttatttgaaagccttggatggttttgttatggttctcacagatgatggtgacatgatttacatttctgataatgtgaacaaatacatgggattaactcagtttgaactaactggacacagtgtgtttgattttactcatccatgtgaccatgaggaaatgagagaaatgcttacacacagaaatggccttgtgaaaaagggtaaagaacaaaacacacagcgaagcttttttctcagaatgaagtgtaccctaactagccgaggaagaactatgaacataaagtctgcaacatggaaggtattgcactgcacaggccacattcacgtatatgataccaacagtaaccaacctcagtgtgggtataagaaaccacctatgacctgcttggtgctgatttgtgaacccattcctcacccatcaaatattgaaattcctttagatagcaagactttcctcagtcgacacagcctggatatgaaattttcttattgtgatgaaagaattaccgaattgatgggatatgagccagaagaacttttaggccgctcaatttatgaatattatcatgctttggactctgatcatctgaccaaaactcatcatgatatgtttactaaaggacaagtcaccacaggacagtacaggatgcttgccaaaagaggtggatatgtctgggttgaaactcaagcaactgtcatatataacaccaagaattctcaaccacagtgcattgtatgtgtgaattacgttgtgagtggtattattcagcacgacttgattttctcccttcaacaaacagaatgtgtccttaaaccggttgaatcttcagatatgaaaatgactcagctattcaccaaagttgaatcagaagatacaagtagcctctttgacaaacttaagaaggaacctgatgctttaactttgctggccccagccgctggagacacaatcatatctttagattttggcagcaacgacacagaaactgatgaccagcaacttgaggaagtaccattatataatgatgtaatgctcccctcacccaacgaaaaattacagaatataaatttggcaatgtctccattacccaccgctgaaacgccaaagccacttcgaagtagtgctgaccctgcactcaatcaagaagttgcattaaaattagaaccaaatccagagtcactggaactttcttttaccatgccccagattcaggatcagacacctagtccttccgatggaagcactagacaaagttcacctgagcctaatagtcccagtgaatattgtttttatgtggatagtgatatggtcaatgaattcaagttggaattggtagaaaaactttttgctgaagacacagaagcaaagaacccattttctactcaggacacagatttagacttggagatgttagctccctatatcccaatggatgatgacttccagttacgttccttcgatcagttgtcaccattagaaagcagttccgcaagccctgaaagcgcaagtcctcaaagcacagttacagtattccagcagactcaaatacaagaacctactgctaatgccaccactaccactgccaccactgatgaattaaaaacagtgacaaaagaccgtatggaagacattaaaatattgattgcatctccatctcctacccacatacataaagaaactactagtgccacatcatcaccatatagagatactcaaagtcggacagcctcaccaaacagagcaggaaaaggagtcatagaacagacagaaaaatctcatccaagaagccctaacgtgttatctgtcgctttgagtcaaagaactacagttcctgaggaagaactaaatccaaagatactagctttgcagaatgctcagagaaagcgaaaaatggaacatgatggttcactttttcaagcagtaggaattggaacattattacagcagccagacgatcatgcagctactacatcactttcttggaaacgtgtaaaaggatgcaaatctagtgaacagaatggaatggagcaaaagacaattattttaataccctctgatttagcatgtagactgctggggcaatcaatggatgaaagtggattaccacagctgaccagttatgattgtgaagttaatgctcctatacaaggcagcagaaacctactgcagggtgaagaattactcagagctttggatcaagttaactgagctttttcttaatttcattcctttttttggacactggtggctcactacctaaagcagtctatttatattttctacatctaattttagaagcctggctacaatactgcacaaacttggttagttcaatttttgatcccctttctacttaatttacattaatgctcttttttagtatgttctttaatgctggatcacagacagctcattttctcagttttttggtatttaaaccattgcattgcagtagcatcattttaaaaaatgcacctttttatttatttatttttggctagggagtttatccctttttcgaattatttttaagaagatgccaatataatttttgtaagaaggcagtaacctttcatcatgatcataggcagttgaaaaatttttacaccttttttttcacattttacataaataataatgctttgccagcagtacgtggtagccacaattgcacaatatattttcttaaaaaataccagcagttactcatggaatatattctgcgtttataaaactagtttttaagaagaaattttttttggcctatgaaattgttaaacctggaacatgacattgttaatcatataataatgattcttaaatgctgtatggtttattatttaaatgggtaaagccatttacataatatagaaagatatgcatatatctagaaggtatgtggcatttatttggataaaattctcaattcagagaaatcatctgatgtttctatagtcactttgccagctcaaaagaaaacaataccctatgtagttgtggaagtttatgctaatattgtgtaactgatattaaacctaaatgttctgcctaccctgttggtataaagatattttgagcagactgtaaacaagaaaaaaaaaatcatgcattcttagcaaaattgcctagtatgttaatttgctcaaaatacaatgtttgattttatgcactttgtcgctattaacatcctttttttcatgtagatttcaataattgagtaattttagaagcattattttaggaatatatagttgtcacagtaaatatcttgttttttctatgtacattgtacaaatttttcattccttttgctctttgtggttggatctaacactaactgtattgttttgttacatcaaataaacatcttctgtggaaaaaaaaaaaaaaaaaaaa

SEQ ID NO: 626 - DNA, 865 bp, Homo sapiens
  ref <308>: DATABASE ACCESSION NUMBER: NM_001540
  ref <309>: DATABASE ENTRY DATE: 2001-06-18
ctcaaacaccgcctgctaaaaatacccgactggaggagcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggcaagcacgaggagcggcaggacgagcatggctacatctcccggtgcttcacgcggaaatacacgctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcctggatgcccacccctgctgccgccactggctgtgcctcccccgccacctgtgtgttcttttgatacatttatcttctgtttttctcaaataaagttcaaagcaaccacctgtaaaaaaaaaaaaaaaaaa

SEQ ID NO: 627 - DNA, 1791 bp, Homo sapiens
  ref <308>: DATABASE ACCESSION NUMBER: NM_001550
  ref <309>: DATABASE ENTRY DATE: 2001-06-18
cctcgtgccagagaaacatgtatcgttttcgatcacagctcttcacggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcggcggcgggtcaggagcagccgcagcgacggcggcgacagcaggtggccagcatcgaaatgttcagccttttagtgatgaagatgcatcaattgaaacaatgagccattgcagtggttatagcgatccttccagttttgctgaagatggaccagaagtccttgatgaggaaggaactcaagaagacctagagtacaagagaaagggattaattgacctaaccctggataagagtgcgaagacaaggcaagcagctcttgaaggtattaaaaatgcactggcttcaaaaatgctgtatgaatttattctggaaaggagaatgactttaactgatagcattgaacgctgcctgaaaaaaggtaagagtgatgagcaacgtgcagctgcagcgttagcatctgttctttgtattcagctgggccctggaattgaaagtgaagagattttgaaaactcttggaccaatcctaaagaaaatcatttgtgatgggtcagctagtatgcaggctaggcaaacttgtgcaacttgctttggtgtttgctgttttattgccacagatgacattactgaactatactcaactctggaatgtttggaaaatatcttcactaaatcctatctcaaagagaaagacactactgttatttgcagcactcctaatacagtgcttcatatcagctctcttcttgcatggacactactgctgaccatatgcccaatcaatgaagtgaagaaaaagcttgagatgcatttccataagcttccaagcctcctctcttgtgatgatgtaaacatgagaatagctgctggtgaatctttggcacttctctttgaattggccagaggaatagagagtgactttttttatgaagacatggagtccttgacgcagatgcttagggccttggcaacagatggaaataaacaccgggccaaagtggacaagagaaagcagcggtcagttttcagagatgtcctgagggcagtggaggaacgggattttccaacagaaaccattaaatttggtcctgaacgcatgtatattgattgctgggtaaaaaaacacacctatgacacctttaaggaggttcttggatcagggatgcagtacccacttgcagtcaaaatggaattcctcgaaaatgtatttgaaacttggacccccagtgatgccttgatgctgcaacgccttaaaacgatgaagatttctcgtttcgaaaggcatttatataactctgcagccttcaaagctcgaaccaaagctagaagcaaatgtcgagataagagagcagatgttggagaattcttctagattttcagaacttgaagactattttctaatttctatttttttttctatttcaatgtatttaaactctagacacagtttttatcttggattaacttagataacttttgtagccagtggttatattgcttataatttaatgtacaatactattgaaactggtgagttctgattattaaatattctctgtaaatcagtaaacatgtataaagt

SEQ ID NO: 628 - DNA, 1321 bp, Homo sapiens
  ref <308>: DATABASE ACCESSION NUMBER: NM_001551
  ref <309>: DATABASE ENTRY DATE: 2001-06-18
cccccaagatggctgctgaggacgagttacagctgccgcggctccccgagctgttcgaaactggtagacagttactggacgaagtagaagtggcgactgaacccgccggttcccggatagtccaggagaaggtgttcaagggcttggacctccttgagaaggctgccgaaatgttatcgcagctcgacttgttcagccgaaatgaagatttggaagagattgcttccaccgacctgaagtaccttttggtgccagcgtttcaaggagccctcaccatgaaacaagtcaaccccagcaagcgtctagatcatttgcagcgggctcgagaacactttataaactacttaactcagtgccattgctatcatgtggcagagtttgagctgcccaaaaccatgaacaactctgctgaaaatcacactgccaattcctccatggcttatcctagtctcgttgctatggcatctcaaagacaggctaaaatacagagatacaagcagaagaaggagttggagcataggttgtctgcaatgaaatctgctgtggaaagtggtcaagcagatgatgagcgtgttcgtgaatattatcttcttcaccttcagaggtggattgatatcagcttagaagagattgagagcattgaccaggaaataaagatcctgagagaaagagactcttcaagagaggcatcaacttctaactcatctcgccaggagaggcctccagtgaaacccttcattctcactcggaacatggctcaagccaaagtatttggagctggttatccaagtctgccaactatgacggtgagtgactggtatgagcaacatcggaaatatggagcattaccggatcagggaatagccaaggcagcaccagaggaattcagaaaagcagctcagcaacaggaagaacaagaagaaaaggaggaagaggatgatgaacaaacactccacagagcccgggagtgggatgactggaaggacacccatcctaggggctatgggaaccgacagaacatgggctgatcttcccacaacaccacaggactgcagggtgcacaactccctgccaaggaaaaccatgcagtcctcccctccctggtctcctgcttcagctctgtacaacgagggcaaagatgctaaatcttgctttgcattcagtaaagtgtcaagtgattaagtgtgtatttgtaccctagatgatatgaaccagcagtcttgttttggcatcatcctcatcatgttgtattccagcttcttaagtggaaggaaaagagtgctgagaaatggctctgtataatctatggctatccgaattc

SEQ ID NO: 629 - DNA, 2160 bp, Homo sapiens
  ref <308>: DATABASE ACCESSION NUMBER: NM_001552
  ref <309>: DATABASE ENTRY DATE: 2001-06-18
agccccctgcccctcgccgccccccgccgcctgcctgggccgggccgaggatgcggcgcagcgcctcggcggccaggcttgctcccctccggcacgcctgctaacttcccccgctacgtccccgttcgcccgccgggccgccccgtctccccgcggcctccgggtccgggtcctccaggacggccaggccgtgccgccgtgtgccctccgccgctcgcccgcgcgccgcgcgctccccgcctgcgcccagcgccccgcgcccgcgccccagtcctcgggcggtccatgctgcccctctgcctcgtggccgccctgctgctggccgccgggcccgggccgagcctgggcgacgaagccatccactgcccgccctgctccgaggagaagctggcgcgctgccgcccccccgtgggctgcgaggagctggtgcgagaggcgggctgcggctgttgcgccacttgcgccctgggcttggggatgccctgcggggtgtacaccccccgttgcggctcgggcctgcgctgctacccgccccgaggggtggagaagcccctgcacacactgatgcacgggcaaggcgtgtgcatggagctggcggagatcgaggccatccaggaaagcctgcagccctctgacaaggacgagggtgaccaccccaacaacagcttcagcccctgtagcgcccatgaccgcaggtgcctgcagaagcacttcgccaaaattcgagaccggagcaccagtgggggcaagatgaaggtcaatggggcgccccgggaggatgcccggcctgtgccccagggctcctgccagagcgagctgcaccgggcgctggagcggctggccgcttcacagagccgcacccacgaggacctctacttcatccccatccccaactgcgaccgcaacggcaacttccaccccaagcagtgtcacccagctctggatgggcagcgtggcaagtgctggtgtgtggaccggaagacgggggtgaagcttccggggggcctggagccaaagggggagctggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagcccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttcccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttctt

SEQ ID NO: 630 - DNA, 1124 bp, Homo sapiens
  ref <308>: DATABASE ACCESSION NUMBER: NM_001553
  ref <309>: DATABASE ENTRY DATE: 2001-06-18
gccgctgccaccgcaccccgccatggagcggccgtcgctgcgcgccctgctcctcggcgccgctgggctgctgctcctgctcctgcccctctcctcttcctcctcttcggacacctgcggcccctgcgagccggcctcctgcccgcccctgcccccgctgggctgcctgctgggcgagacccgcgacgcgtgcggctgctgccctatgtgcgcccgcggcgagggcgagccgtgcgggggtggcggcgccggcagggggtactgcgcgccgggcatggagtgcgtgaagagccgcaagaggcggaagggtaaagccggggcagcagccggcggtccgggtgtaagcggcgtgtgcgtgtgcaagagccgctacccggtgtgcggcagcgacggcaccacctacccgagcggctgccagctgcgcgccgccagccagagggccgagagccgcggggagaaggccatcacccaggtcagcaagggcacctgcgagcaaggtccttccatagtgacgccccccaaggacatctggaatgtcactggtgcccaggtgtacttgagctgtgaggtcatcggaatcccgacacctgtcctcatctggaacaaggtaaaaaggggtcactatggagttcaaaggacagaactcctgcctggtgaccgggacaacctggccattcagacccggggtggcccagaaaagcatgaagtaactggctgggtgctggtatctcctctaagtaaggaagatgctggagaatatgagtgccatgcatccaattcccaaggacaggcttcagcatcagcaaaaattacagtggttgatgccttacatgaaataccagtgaaaaaaggtgaaggtgccgagctataaacctccagaatattattagtctgcatggttaaaagtagtcatggataactacattacctgttcttgcctaataagtttcttttaatccaatccactaacactttagttatattcactggttttacacagagaaatacaaaataaagatcacacatcaagactatctacaaaaatttattatatatttacagaagaaaagcatgcatatcattaaacaaataaaatactttttatcacaaaaaaaaaaaaaaaa

SEQ ID NO: 631 - DNA, 1887 bp, Homo sapiens
  ref <308>: DATABASE ACCESSION NUMBER: NM_001554
  ref <309>: DATABASE ENTRY DATE: 2001-06-18
gcgcacggcctgtccgctgcacaccagcttgttggcgtcttcgtcgccgcgctcgccccgggctactcctgcgcgccacaatgagctcccgcatcgccagggcgctcgccttagtcgtcacccttctccacttgaccaggctggcgctctccacctgccccgctgcctgccactgccccctggaggcgcccaagtgcgcgccgggagtcgggctggtccgggacggctgcggctgctgtaaggtctgcgccaagcagctcaacgaggactgcagcaaaacgcagccctgcgaccacaccaaggggctggaatgcaacttcggcgccagctccaccgctctgaaggggatctgcagagctcagtcagagggcagaccctgtgaatataactccagaatctaccaaaacggggaaagtttccagcccaactgtaaacatcagtgcacatgtattgatggcgccgtgggctgcattcctctgtgtccccaagaactatctctccccaacttgggctgtcccaaccctcggctggtcaaagttaccgggcagtgctgcgaggagtgggtctgtgacgaggatagtatcaaggaccccatggaggaccaggacggcctccttggtaaggagctgggattcgatgcctccgaggtggagttgacgagaaacaatgaattgattgcagttggaaaaggcagctcactgaagcggatccctgtttttggaatggagcctcgcatccgatacaaccctttacaaggccagaaatgtattgttcaaacaacttcatggtcccagtgctcaaagacctgtggaactggtatctccacacgagttaccaatgacaaccctgagtgccgccttgtgaaagaaacccggatttgtgaggtgcggccttgtggacagccagtgtacagcagcctgaaaaagggcaagaaatgcagcaagaccaagaaatcccccgaaccagtcaggtttacttacgctggatgtttgagtgtgaagaaataccggcccaagtactgcggttcctgcgtggacggccgatgctgcacgccccagctgaccaggactgtgaagatgcggttccgctgcgaagatggggagacattttccaagaacgtcatgatgatccagtcctgcaaatgcaactacaactgcccgcatgccaatgaagcagcgtttcccttctacaggctgttcaatgacattcacaaatttagggactaaatgctacctgggtttccagggcacacctagacaaacaagggagaagagtgtcagaatcagaatcatggagaaaatgggcgggggtggtgtgggtgatgggactcattgtagaaaggaagccttgctcattcttgaggagcattaaggtatttcgaaactgccaagggtgctggtgcggatggacactaatgcagccacgattggagaatactttgcttcatagtattggagcacatgttactgcttcattttggagcttgtggagttgatgactttctgttttctgtttgtaaattatttgctaagcatattttctctaggcttttttccttttggggttctacagtcgtaaaagagataataagattagttggacagtttaaagcttttattcgtcctttgacaaaagtaaatgggagggcattccatcccttcctgaagggggacactccatgagtgtctgtgagaggcagctatctgcactctaaactgcaaacagaaatcaggtgttttaagactgaatgttttatttatcaaaatgtagcttttggggagggaggggaaatgtaatactggaataatttgtaaatgattttaattttatattcagtgaaaagattttatttatggaattaaccatttaataaagaaatatttacct

SEQ ID NO: 632 - DNA, 3632 bp, Homo sapiens
  ref <308>: DATABASE ACCESSION NUMBER: NM_001558
  ref <309>: DATABASE ENTRY DATE: 2001-06-18
aaagagctggaggcgcgcaggccggctccgctccggccccggacgatgcggcgcgcccaggatgctgccgtgcctcgtagtgctgctggcggcgctcctcagcctccgtcttggctcagacgctcatgggacagagctgcccagccctccgtctgtgtggtttgaagcagaatttttccaccacatcctccactggacacccatcccaaatcagtctgaaagtacctgctatgaagtggcgctcctgaggtatggaatagagtcctggaactccatctccaactgtagccagaccctgtcctatgaccttaccgcagtgaccttggacctgtaccacagcaatggctaccgggccagagtgcgggctgtggacggcagccggcactccaactggaccgtcaccaacacccgcttctctgtggatgaagtgactctgacagttggcagtgtgaacctagagatccacaatggcttcatcctcgggaagattcagctacccaggcccaagatggcccccgcgaatgacacatatgaaagcatcttcagtcacttccgagagtatgagattgccattcgcaaggtgccgggaaacttcacgttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtatttcaccgtgaccaacgtcatcatcttctttgcctttgtcctgctgctctccggagccctcgcctactgcctggccctccagctgtatgtgcggcgccgaaagaagctacccagtgtcctgctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacggggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcaggggccccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggccctggggcagaagttaggcacgaggcagtctgggcacttttctgcaagtccactggggctggcccagccaggctgcagggctggtcagggtgtctggggcaggaggaggccaactcactgaactagtgcagggtatgtgggtggcactgacctgttctgttgactggggccctgcagactctggcagagctgagaagggcagggaccttctccctcctaggaactctttcctgtatcataaaggattatttgctcaggggaaccatggggctttctggagttgtggtgaggccaccaggctgaagtcagctcagacccagacctccctgcttaggccactcgagcatcagagcttccagcaggaggaagggctgtaggaatggaagcttcagggccttgctgctggggtcatttttaggggaaaaaggaggatatgatggtcacatggggaacctcccctcatcgggcctctggggcaggaagcttgtcactggaagatcttaaggtatatattttctggacactcaaacacatcataatggattcactgaggggagacaaagggagccgagaccctggatggggcttccagctcagaacccatccctctggtgggtacctctggcacccatctgcaaatatctccctctctccaacaaatggagtagcatccccctggggcacttgctgaggccaagccactcacatcctcactttgctgccccaccatcttgctgacaacttccagagaagccatggttttttgtattggtcataactcagccctttgggcggcctctgggcttgggcaccagctcatgccagccccagagggtcagggttggaggcctgtgcttgtgtttgctgctaatgtccagctacagacccagaggataagccactgggcactgggctggggtccctgccttgttggtgttcagctgtgtgattttggactagccacttgtcagagggcctcaatctcccatctgtgaaataaggactccacctttaggggaccctccatgtttgctgggtattagccaagctggtcctgggagaatgcagatactgtccgtggactaccaagctggcttgtttcttatgccagaggctaacagatccaatgggagtccatggtgtcatgccaagacagtatcagacacagccccagaagggggcattatgggccctgcctccccataggccatttggactctgccttcaaacaaaggcagttcagtccacaggcatggaagctgtgaggggacaggcctgtgcgtgccatccagagtcatctcagccctgcctttctctggagcattctgaaaacagatattctggcccagggaatccagccatgacccccacccctctgccaaagtactcttaggtgccagtctggtaactgaactccctctggaggcaggcttgagggaggattcctcagggttcccttgaaagctttatttatttattttgttcatttatttattggagaggcagcattgcacagtgaaagaattctggatatctcaggagccccgaaattctagctctgactttgctgtttccagtggtatgaccttggagaagtcacttatcctcttggagcctcagtttcctcatctgcagaataatgactgacttgtctaattcatagggatgtgaggttctgctgaggaaatgggtatgaatgtgccttgaacacaaagctctgtcaataagtgatacatgttttttattccaataaattgtcaagaccaca

SEQ ID NO: 633 - DNA, 4039 bp, Homo sapiens
  ref <308>: DATABASE ACCESSION NUMBER: NM_001560
  ref <309>: DATABASE ENTRY DATE: 2001-06-18
tgccaaggctccagcccggccgggctccgaggcgagaggctgcatggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtccaagaggctaaatgtgagaatccagaatttgagagaaatgtggagaatacatcttgtttcatggtccctggtgttcttcctgatactttgaacacagtcagaataagagtcaaaacaaataagttatgctatgaggatgacaaactctggagtaattggagccaagaaatgagtataggtaagaagcgcaattccacactctacataaccatgttactcattgttccagtcatcgtcgcaggtgcaatcatagtactcctgctttacctaaaaaggctcaagattattatattccctccaattcctgatcctggcaagatttttaaagaaatgtttggagaccagaatgatgatactctgcactggaagaagtacgacatctatgagaagcaaaccaaggaggaaaccgactctgtagtgctgatagaaaacctgaagaaagcctctcagtgatggagataatttatttttaccttcactgtgaccttgagaagattcttcccattctccatttgttatctgggaacttattaaatggaaactgaaactactgcaccatttaaaaacaggcagctcataagagccacaggtctttatgttgagtcgcgcaccgaaaaactaaaaataatgggcgctttggagaagagtgtggagtcattctcattgaattataaaagccagcaggcttcaaactaggggacaaagcaaaaagtgatgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtctgggctgggtccggtggctcacgcctgtaatcccagcaatttgggagtccgaggcgggcggatcactcgaggtcaggagttccagaccagcctgaccaaaatggtgaaacctcctctctactaaaactacaaaaattaactgggtgtggtggcgcgtgcctgtaatcccagctactcgggaagctgaggcaggtgaattgtttgaacctgggaggtggaggttgcagtgagcagagatcacaccactgcactctagcctgggtgacagagcaagactctgtctaaaaaacaaaacaaaacaaaacaaaacaaaaaaacctcttaatattctggagtcatcattcccttcgacagcattttcctctgctttgaaagccccagaaatcagtgttggccatgatgacaactacagaaaaaccagaggcagcttctttgccaagacctttcaaagccattttaggctgttaggggcagtggaggtagaatgactccttgggtattagagtttcaaccatgaagtctctaacaatgtattttcttcacctctgctactcaagtagcatttactgtgtctttggtttgtgctaggcccccgggtgtgaagcacagaccccttccaggggtttacagtctatttgagactcctcagttcttgccacttttttttttaatctccaccagtcatttttcagaccttttaactcctcaattccaacactgatttccccttttgcattctccctccttcccttccttgtagccttttgactttcattggaaattaggatgtaaatctgctcaggagacctggaggagcagaggataattagcatctcaggttaagtgtgagtaatctgagaaacaatgactaattcttgcatattttgtaacttccatgtgagggttttcagcattgatatttgtgcattttctaaacagagatgaggtggtatcttcacgtagaacattggtattcgcttgagaaaaaaagaatagttgaacctatttctctttctttacaagatgggtccaggattcctcttttctctgccataaatgattaattaaatagcttttgtgtcttacattggtagccagccagccaaggctctgtttatgcttttggggggcatatattgggttccattctcacctatccacacaacatatccgtatatatcccctctactcttacttcccccaaatttaaagaagtatgggaaatgagaggcatttcccccaccccatttctctcctcacacacagactcatattactggtaggaacttgagaactttatttccaagttgttcaaacatttaccaatcatattaatacaatgatgctatttgcaattcctgctcctaggggaggggagataagaaaccctcactctctacaggtttgggtacaagtggcaacctgcttccatggccgtgtagaagcatggtgccctggcttctctgaggaagctggggttcatgacaatggcagatgtaaagttattcttgaagtcagattgaggctgggagacagccgtagtagatgttctactttgttctgctgttctctagaaagaatatttggttttcctgtataggaatgagattaattcctttccaggtattttataattctgggaagcaaaacccatgcctccccctagccatttttactgttatcctatttagatggccatgaagaggatgctgtgaaattcccaacaaacattgatgctgacagtcatgcagtctgggagtggggaagtgatcttttgttcccatcctcttcttttagcagtaaaatagctgagggaaaagggagggaaaaggaagttatgggaatacctgtggtggttgtgatccctaggtcttgggagctcttggaggtgtctgtatcagtggatttcccatcccctgtgggaaattagtaggctcatttactgttttaggtctagcctatgtggattttttcctaacatacctaagcaaacccagtgtcaggatggtaattcttattctttcgttcagttaagtttttcccttcatctgggcactgaagggatatgtgaaacaatgttaacatttttggtagtcttcaaccagggattgtttctgtttaacttcttataggaaagcttgagtaaaataaatattgtctttttgtatgtcaagcgggccgccaccgcggtggaaactccagctt

SEQ ID NO: 634 - DNA, 1172 bp, Homo sapiens
  ref <308>: DATABASE ACCESSION NUMBER: NM_001565
  ref <309>: DATABASE ENTRY DATE: 2001-06-18
gagacattcctcaattgcttagacatattctgagcctacagcagaggaacctccagtctcagcaccatgaatcaaactgcgattctgatttgctgccttatctttctgactctaagtggcattcaaggagtacctctctctagaaccgtacgctgtacctgcatcagcattagtaatcaacctgttaatccaaggtctttagaaaaacttgaaattattcctgcaagccaattttgtccacgtgttgagatcattgctacaatgaaaaagaagggtgagaagagatgtctgaatccagaatcgaaggccatcaagaatttactgaaagcagttagcaaggaaatgtctaaaagatctccttaaaaccagaggggagcaaaatcgatgcagtgcttccaaggatggaccacacagaggctgcctctcccatcacttccctacatggagtatatgtcaagccataattgttcttagtttgcagttacactaaaaggtgaccaatgatggtcaccaaatcagctgctactactcctgtaggaaggttaatgttcatcatcctaagctattcagtaataactctaccctggcactataatgtaagctctactgaggtgctatgttcttagtggatgttctgaccctgcttcaaatatttccctcacctttcccatcttccaagggtactaaggaatctttctgctttggggtttatcagaattctcagaatctcaaataactaaaaggtatgcaatcaaatctgctttttaaagaatgctctttacttcatggacttccactgccatcctcccaaggggcccaaattctttcagtggctacctacatacaattccaaacacatacaggaaggtagaaatatctgaaaatgtatgtgtaagtattcttatttaatgaaagactgtacaaagtataagtcttagatgtatatatttcctatattgttttcagtgtacatggaataacatgtaattaagtactatgtatcaatgagtaacaggaaaattttaaaaatacagatagatatatgctctgcatgttacataagataaatgtgctgaatggttttcaaataaaaatgaggtactctcctggaaatattaagaaagactatctaaatgttgaaagatcaaaaggttaataaagtaattataact

SEQ ID NO: 635 - DNA, 3583 bp, Homo sapiens
  ref <308>: DATABASE ACCESSION NUMBER: NM_001569
  ref <309>: DATABASE ENTRY DATE: 2001-06-18
cgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtgcgagcgctccgggcagcgcacggccagcgtcctgtggccctggatcaaccgcaacgcccgtgtggccgacctcgtgcacatcctcacgcacctgcagctgctccgtgcgcgggacatcatcacagcctggcaccctcccgccccgcttccgtccccaggcaccactgccccgaggcccagcagcatccctgcacccgccgaggccgaggcctggagcccccggaagttgccatcctcagcctccaccttcctctccccagcttttccaggctcccagacccattcagggcctgagctcggcctggttccaagccctgcttccctgtggcctccaccgccatctccagccccttcttctaccaagccaggcccagagagctcagtgtccctcctgcagggagcccgcccctctccgttttgctggcccctctgtgagatttcccggggcacccacaacttctcggaggagctcaagatcggggagggtggctttgggtgcgtgtaccgggcggtgatgaggaacacggtgtatgctgtgaagaggctgaaggagaacgctgacctggagtggactgcagtgaagcagagcttcctgaccgaggtggagcagctgtccaggtttcgtcacccaaacattgtggactttgctggctactgtgctcagaacggcttctactgcctggtgtacggcttcctgcccaacggctccctggaggaccgtctccactgccagacccaggcctgcccacctctctcctggcctcagcgactggacatccttctgggtacagcccgggcaattcagtttctacatcaggacagccccagcctcatccatggagacatcaagagttccaacgtccttctggatgagaggctgacacccaagctgggagactttggcctggcccggttcagccgctttgccgggtccagccccagccagagcagcatggtggcccggacacagacagtgcggggcaccctggcctacctgcccgaggagtacatcaagacgggaaggctggctgtggacacggacaccttcagctttggggtggtagtgctagagaccttggctggtcagagggctgtgaagacgcacggtgccaggaccaagtatctgaaagacctggtggaagaggaggctgaggaggctggagtggctttgagaagcacccagagcacactgcaagcaggtctggctgcagatgcctgggctgctcccatcgccatgcagatctacaagaagcacctggaccccaggcccgggccctgcccacctgagctgggcctgggcctgggccagctggcctgctgctgcctgcaccgccgggccaaaaggaggcctcctatgacccaggtgtacgagaggctagagaagctgcaggcagtggtggcgggggtgcccgggcatttggaggccgccagctgcatccccccttccccgcaggagaactcctacgtgtccagcactggcagagcccacagtggggctgctccatggcagcccctggcagcgccatcaggagccagtgcccaggcagcagagcagctgcagagaggccccaaccagcccgtggagagtgacgagagcctaggcggcctctctgctgccctgcgctcctggcacttgactccaagctgccctctggacccagcacccctcagggaggccggctgtcctcagggggacacggcaggagaatcgagctgggggagtggcccaggatcccggcccacagccgtggaaggactggcccttggcagctctgcatcatcgtcgtcagagccaccgcagattatcatcaaccctgcccgacagaagatggtccagaagctggccctgtacgaggatggggccctggacagcctgcagctgctgtcgtccagctccctcccaggcttgggcctggaacaggacaggcaggggcccgaagaaagtgatgaatttcagagctgatgtgttcacctgggcagatcccccaaatccggaagtcaaagttctcatggtcagaagttctcatggtgcacgagtcctcagcactctgccggcagtgggggtgggggcccatgcccgcgggggagagaaggaggtggccctgctgttctaggctctgtgggcataggcaggcagagtggaaccctgcctccatgccagcatctgggggcaaggaaggctggcatcatccagtgaggaggctggcgcatgttgggaggctgctggctgcacagacccgtgaggggaggagaggggctgctgtgcaggggtgtggagtagggagctggctcccctgagagccatgcagggcgtctgcagcccaggcctctggcagcagctctttgcccatctctttggacagtggccaccctgcacaatggggccgacgaggcctagggccctcctacctgcttacaatttggaaaagtgtggccgggtgcggtggctcacgcctgtaatcccagcactttgggaggccaaggcaggaggatcgctggagcccagtaggtcaagaccagccagggcaacatgatgagaccctgtctctgccaaaaaattttttaaactattagcctggcgtggtagcgcacgcctgtggtcccagctgctggggaggctgaagtaggaggatcatttatgcttgggaggtcgaggctgcagtgagtcatgattgtatgactgcactccagcctgggtgacagagcaagaccctgtttcaaaaagaaaaaccctgggaaaagtgaagtatggctgtaagtctcatggttcagtcctagcaagaagcgagaattctgagatcctccagaaagtcgagcagcacccacctccaacctcgggccagtgtcttcaggctttactggggacctgcgagctggcctaatgtggtggcctgcaagccaggccatccctgggcgccacagacgagctccgagccaggtcaggcttcggaggccacaagctcagcctcaggcccaggcactgattgtggcagaggggccactacccaaggtctagctaggcccaagacctagttacccagacagtgagaagcccctggaaggcagaaaagttgggagcatggcagacagggaagggaaacattttcagggaaaagacatgtatcacatgtcttcagaagcaagtcaggtttcatgtaaccgagtgtcctcttgcgtgtccaaaagtagcccagggctgtagcacaggcttcacagtgattttgtgttcagccgtgagtcacactacatgcccccgtgaagctgggcattggtgacgtccaggttgtccttgagtaataaaaacgtatgttccctaaaaaaaaaaaaa

SEQ ID NO: 636 - DNA, 3344 bp, Homo sapiens
  ref <308>: DATABASE ACCESSION NUMBER: NM_001605
  ref <309>: DATABASE ENTRY DATE: 2001-06-18
ggtacagctgcgcgtctgcgggaataggtgcagcgggcccttggcgggggactctgagggaggagctggggacggcgaccctaggagagttctttggggtgactttcaagatggactctactctaacagcaagtgaaatccggcagcgatttatagatttcttcaagaggaacgagcatacgtatgttcactcgtctgccaccatcccattggatgaccccactttgctctttgccaatgcaggcatgaaccagtttaaacccattttcctgaacacaattgacccatctcaccccatggcaaagctgagcagagctgccaatacccagaagtgcatccgggctgggggcaaacaaaatgacctggacgatgtgggcaaggatgtctatcatcacaccttcttcgagatgctgggctcttggtcttttggagattactttaaggaattggcatgtaagatggctctggaactcctcacccaagagtttggcattcccattgaaagactttatgttacttactttggcggggatgaagcagctggcttagaagcagatctggaatgcaaacagatctggcaaaatttggggctggatgacaccaaaatcctcccaggcaacatgaaggataacttctgggagatgggtgacacgggcccctgtggtccttgcagtgagatccactacgaccggattggtggtcgggacgccgcacatcttgtcaaccaggacgaccctaatgtgctggagatctggaaccttgtgttcatccagtataacagggaagctgatggcattctgaaacctcttcccaagaaaagcattgacacagggatgggcctggaacgactggtatctgtgctgcagaataagatgtccaactatgacactgacctttttgtcccttactttgaagccattcagaagggcacaggtgcccgaccatacactgggaaagttggtgctgaggatgccgatgggattgacatggcctaccgggtgctggctgaccatgctcggaccatcactgtggcactggctgatggtggccggcctgacaacacagggcgtggatatgtgttgagacggattctccgccgagctgtccgatacgcccatgaaaagctcaatgccagcaggggcttctttgctacgttagtggatgttgtcgtccagtccctgggagatgcatttcctgagctgaagaaggacccagacatggtgaaggacatcattaatgaagaagaggtgcagtttctcaagactctcagcagagggcgtcgcatcctggacaggaaaattcagagcctgggagacagcaagaccattcccggagacactgcttggctcctctatgacacctatgggtttccagtggatctgactggactgattgctgaagagaagggcctggtggtagacatggatggctttgaagaggagaggaaactggcccagctgaaatcacagggcaagggagctggtggggaagacctcattatgctggacatttacgctatcgaagagctccgggcacggggtctggaggtcacagatgattccccaaagtacaattaccatttggactccagtggtagctatgtatttgagaacacagtggctacggtgatggctctgcgcagggagaagatgttcgtggaagaggtgtccacaggccaggagtgtggagtggtgctggacaagacctgtttctatgctgagcaaggaggccagatctatgacgaaggctacctggtgaaggtggatgacagcagtgaagataaaacagagtttacagtgaagaatgctcaggtccgaggagggtatgtgctacacattggaaccatctacggtgacctgaaagtgggggatcaggtctggctgtttattgatgagccccgacgaagacccatcatgagcaaccacacagctacgcacattctgaacttcgccctgcgctcagtgcttggggaagctgaccagaaaggctcattggttgctcctgaccgcctcagatttgactttactgccaagggagccatgtccacccaacagatcaagaaggctgaagagattgctaatgagatgattgaggcagccaaggccgtctatacccaggattgccccctggcagcagcgaaagccatccagggcctacgggctgtgtttgatgagacctatcctgaccctgtgcgagtcgtctccattggggtcccggtgtccgagttgctggatgacccctctgggcctgctggctccctgacttctgttgagttctgtgggggaacgcacctgcggaactcgagtcatgcaggagcttttgtgatcgtgacggaagaagccattgccaagggtatccggaggattgtggctgtcacaggtgccgaggcccagaaggccctcaggaaagcagagagcttgaagaaatgtctctctgtcatggaagccaaagtgaaggctcagactgctccaaacaaggatgtgcagagggagatcgctgaccttggagaggccctggccactgcagtcatcccccagtggcagaaggatgaattgcgggagactctcaaatccctaaagaaggtcatggatgacttggaccgagccagcaaagccgatgtccagaaacgagtgttagagaagacgaagcagttcatcgacagcaaccccaaccagcctcttgtcatcctggagatggagagcggcgcctcagccaaggccctgaatgaagccttgaagctcttcaagatgcactcccctcagacttctgccatgctcttcacggtggacaatgaggctggcaagatcacgtgcctgtgtcaagtcccccagaatgcagccaatcggggcttaaaagccagcgagtgggtgcagcaggtgtcaggcttgatggacggtaaaggtggtggcaaggatgtgtctgcacaggccacaggcaagaacgttggctgcctgcaggaggcgctgcagctggccacttccttcgcccagctgcgcctcggggatgtaaagaactgagtggggaaggaggaggctcccactggatccatccgtccagccaagagctcttcatctgctacaagaacatttgaatcttgggacctttaaagagcccctcctaacccagcagtaactggaacacacttgggagcagtcctatgtctcagtgccccttaaatttctgccctgagccctccacgtcagtgccatcggtctagaaccactaaccccgcattgctgttgatcgtcacgctcgcatctatagataacggctctccagacctgagctttccgcgtcagcaagtaggaatcgtttttgctgcagagaataaaaggaccacgtgc

SEQ ID NO: 637 - DNA, 2682 bp, Homo sapiens
  ref <308>: DATABASE ACCESSION NUMBER: NM_001609
  ref <309>: DATABASE ENTRY DATE: 2001-06-18
attcctgcgccgaggatggagggcctggcagtgcggttgctgcgcggcagcaggctgctaagaagaaatttcctgacttgtttgtcttcttggaagattcctcctcatgtctcaaaatcttcccagtcagaagctctactcaatataacaaataatggaatacactttgctcccctgcaaacatttacagatgaggaaatgatgataaagagttcagttaaaaaatttgctcaggaacaaattgcacctttggtttcaaccatggatgaaaattcgaaaatggagaaatcagtaatacaaggattatttcaacaagggttgatgggtattgaagttgacccagaatatggaggcacaggagcttcttttttatccactgtgctcgtgatagaggaattagccaaagttgatgcatctgtggctgtcttttgtgagatccagaacacattaattaacacactgattagaaaacatggaacagaagaacaaaaggccacctatttgcctcagctcactacagaaaaagtaggaagtttctgcctttcagaggctggagcaggtagtgactcatttgctttgaagaccagagctgataaagagggagattattatgtcctcaatggatcaaagatgtggatcagcagtgctgagcatgcagggctctttctggtgatggcaaatgtagaccctaccattggatataagggaattacctccttcttagtagatcgtgatactccgggccttcatatagggaaacctgaaaacaaattggggctcagagcttcttccacctgcccgttaacattcgaaaatgtcaaggttccagaagccaatatcttgggacaaattggacatggctataagtatgccatagggagtctcaatgaaggtagaataggaattgctgcacagatgctgggactggcgcaaggatgttttgactacactattccatatattaaagaaaggatacaatttggcaaaagactatttgattttcagggcctccaacaccaagtggctcacgtggccacccagctggaagctgcaagattactaacatacaatgctgctaggcttttagaagctggaaagccattcataaaagaagcgtcaatggccaaatactatgcatcagagattgcaggacaaacaacgagtaaatgtatcgagtggatggggggagtaggctacaccaaagattaccctgtggagaaatacttccgagatgcaaagattggtacgatatatgaaggagcttccaacatccagttgaacaccattgcaaagcatatcgatgcagaatactgacgtctataggagtgggacccctccctggtgtcactgctgtaaaattttaaacggttgtgtcttgttgggagtaagtgccttgcgtgggaataaacttccacagcattcgaatattttaatgaagcccttagtcagggtcctggtgttggcctttttggttttctcttttcaggctgtttaacttaggcacaggagatccacttttaaacttgggaaataagcacctgtatttttttccaaaactgtttttaaagctgtatacgcatacatatatatatttttactctgtcttactctgtcacccaggctagagtgcagtggcgcgatctcagctcactgcagccttgacctcctgggttccggtgattctcatgcctcatcctcccaagtagctggaactacaggtgtgcaccaccatgcctggttcatttttgtgtttttagtagagatggggttttaccatattgcccaggctggtcttctggcttctggatatcgcccaccttggcctcccaaagtgctgggattacagggatgagccaccatgcctggctgggtatttatattatcattctagtttcagagtatacagaagtttcatcccatcatttggaaaaataaaggcatctgaagtacaatattacttatagaaatagtttatattcctattaaatcttaatcttgtggcatcagggaaatatttgttacatagtaggcaatttttatccgtactttatagattcaactctaagttgcaagcgaagtcaaaactgatgaaaatttatttagaaaaatctaaaaattctggttttaaatatgagaatcagtggaaaataagggtataattttgtaggtcatatgattgaagaaaatattattttaacaatgtaaagcaatatgatttgttactataattaacctgtataaaagatacattttatggtggtttcagtaggtcattttaaaaaccaatgtgcattagttttcaagtataaggtttaagtaatttggtttaataatcagaaaatattcaatacagtgttggatatctgtcatgcactattttcagttgacaatttctgtattttaattgaatactgtttcttcagtcatggttattattgcactttatcctgaataatagttcagaaattgggttttggttcagtgattctcaagaaaaagatctcttgcccattaagaagtgtatcaaaatctcataaggaatgagggagagaagggggctgtacagtttgaaaaagcatattcaatattaaaatagttttatatttgggaaggcaaaaatgaatctattgttttgcaatataggttatacaggaaaatgcaataaaatatatatctggttgt

SEQ ID NO: 638 - DNA, 1288 bp, Homo sapiens
  ref <308>: DATABASE ACCESSION NUMBER: NM_001615
  ref <309>: DATABASE ENTRY DATE: 2001-06-18
acaccagccctcagtcactgggagaagaacctctcataccctcggtgctccagtccccagctcactcagccacacacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagggtgtgatggtgggaatgggccagaaagacagctatgtgggggatgaggctcagagcaagcgagggatcctaactctcaaataccccattgaacacggcatcatcaccaactgggatgacatggagaagatctggcaccactccttctacaatgagctgcgtgtagcacctgaagagcaccccaccctgctcacagaggctcccctaaatcccaaggccaacagggaaaagatgacccagatcatgtttgaaaccttcaatgtccctgccatgtacgtcgccattcaagctgtgctctccctctatgcctctggccgcacgacaggcatcgtcctggattcaggtgatggcgtcacccacaatgtccccatctatgaaggctatgccctgccccatgccatcatgcgcctggacttggctggccgtgacctcacggactacctcatgaagatcctcacagagagaggctattcctttgtgaccacagctgagagagaaattgtgcgagacatcaaggagaagctgtgctatgtggccctggattttgagaatgagatggccacagcagcttcctcttcctccctggagaagagctatgagctgccagatgggcaggttatcaccattggcaatgagcgcttccgctgccctgagaccctcttccagccttcctttattggcatggagtccgctggaattcatgagacaacctacaattccatcatgaagtgtgacattgacatccgtaaggacttatatgccaacaatgtcctctctgggggcaccaccatgtaccctggcattgctgacaggatgcagaaggagatcacagccctggcccccagcaccatgaagatcaagattattgctcccccagagcggaagtactcagtctggatcgggggctctatcctggcctctctctccaccttccagcagatgtggatcagcaagcctgagtatgatgaggcagggccctccattgtccacaggaagtgcttctaaagtcagaacaggttctccaaggatcccctcgagactactctgttaccagtcatgaaacattaaaacctacaagcctt

SEQ ID NO: 639 - DNA, 639 bp, Homo sapiens
  ref <308>: DATABASE ACCESSION NUMBER: NM_001623
  ref <309>: DATABASE ENTRY DATE: 2001-06-18
ggacggagggcacgagagaaggagacgctgcagaaagaggcctccagcttggtctgtctcccacctctaccagatctgctgagctatgagccaaaccagggatttacagggaggaaaagctttcggactgctgaaggcccagcaggaagagaggctggatgagatcaacaagcaattcctacacgatcccaaatatagcagtgatgaggatctgccctccaaactggaaggcttcaaagagaaatacatggagtttgaccttaatggaaatggcgatattgatatcatgtccttgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgatcctgatgtatgaggaaaaagcgagagaaaggaaaaccaacacgccccccagccaagaaagccctatctgagatgcctgatttgagggaaaagggatgatgggattgaaggggttctaatacccagatatggaaacagaagacaaaatcgtaagccagagtcaacaaattaaataaatttaccccaaaaaaaa

SEQ ID NO: 640 - DNA, 2539 bp, Homo sapiens
  ref <308>: DATABASE ACCESSION NUMBER: NM_001627
  ref <309>: DATABASE ENTRY DATE: 2001-06-18
cgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgatggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcagtggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatt

SEQ ID NO: 641 - DNA, 1367 bp, Homo sapiens
  ref <308>: DATABASE ACCESSION NUMBER: NM_001628
  ref <309>: DATABASE ENTRY DATE: 2001-06-18
gaaggccgcaccgtactgggcgggggtctggggagcgcagcagccatggcaagccgtctcctgctcaacaacggcgccaagatgcccatcctggggttgggtacctggaagtcccctccagggcaggtgactgaggccgtgaaggtggccattgacgtcgggtaccgccacatcgactgtgcccatgtgtaccagaatgagaatgaggtgggggtggccattcaggagaagctcagggagcaggtggtgaagcgtgaggagctcttcatcgtcagcaagctgtggtgcacgtaccatgagaagggcctggtgaaaggagcctgccagaagacactcagcgacctgaagctggactacctggacctctaccttattcactggccgactggctttaagcctgggaaggaatttttcccattggatgagtcgggcaatgtggttcccagtgacaccaacattctggacacgtgggcggccatggaagagctggtggatgaagggctggtgaaagctattggcatctccaacttcaaccatctccaggtggagatgatcttaaacaaacctggcttgaagtataagcctgcagttaaccagattgagtgccacccatatctcactcaggagaagttaatccagtactgccagtccaaaggcatcgtggtgaccgcctacagccccctcggctctcctgacaggccctgggccaagcccgaggacccttctctcctggaggatcccaggatcaaggcgatcgcagccaagcacaataaaactacagcccaggtcctgatccggttccccatgcagaggaacttggtggtgatccccaagtctgtgacaccagaacgcattgctgagaactttaaggtctttgactttgaactgagcagccaggatatgaccaccttactcagctacaacaggaactggagggtctgtgccttgttgagctgtacctcccacaaggattaccccttccatgaagagttttgaagctgtggttgcctgctcgtccccaagtgacctatacctgtgtttcttgcctcatttttttccttgcaaatgtagtatggcctgtgtcactcagcagtgggacagcaacctgtagagtggccagcgagggcgtgtctagcttgatgttggatctcaagagccctgtcagtagagtagaagtctcttccagtttgctttgcccttctttctaccctgctggggaaagtacaacctgaatacccttttctgaccaaagagaagcaaaatctaccaggtcaaaatagtgccactaacggttgagttttgactgcttggaactggaatcctttcagcaagacttctctttgcctcaaataaaaagtgcttttgtg

SEQ ID NO: 642 - DNA, 1940 bp, Homo sapiens
  ref <308>: DATABASE ACCESSION NUMBER: NM_001630
  ref <309>: DATABASE ENTRY DATE: 2001-06-18
aggcctgctcactcctcagctgcaggagccagacgtgtggagtcccagcagaggccaacctgtgtctcttcatctccgtgagaaaggtgcccccgaagtgaaagagatggcctggtggaaagcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtatccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccggcactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggcgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagaggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaatgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactc

SEQ ID NO: 643 - DNA, 3414 bp, Homo sapiens
  ref <308>: DATABASE ACCESSION NUMBER: NM_001634
  ref <309>: DATABASE ENTRY DATE: 2001-06-18
gcttacacagtatggccggcgacattagctagcgctcgctctactctctctaacgggaaagcagcggaatacaagagactgaactgtatctgcctctatttccaaaagactcacgttcaactttcgctcacacaaagccgggaaaattttattagtcctttttttaaaaaaagttaatataaaattatagcaaaaaaaaaaaggaacctgaactttagtaacacagctggaacaatcgcagcggcggcggcagcggcgggagaagaggtttaatttagttgattttctgtggttgttggttgttcgctagtctcacggtgatggaagctgcacattttttcgaagggaccgagaagctgctggaggtttggttctcccggcagcagcccgacgcaaaccaaggatctggggatcttcgcactatcccaagatctgagtgggacatacttttgaaggatgtgcaatgttcaatcataagtgtgacaaaaactgacaagcaggaagcttatgtactcagtgagagtagcatgtttgtctccaagagacgtttcattttgaagacatgtggtaccaccctcttgctgaaagcactggttcccctgttgaagcttgctagggattacagtgggtttgactcaattcaaagcttcttttattctcgtaagaatttcatgaagccttctcaccaagggtacccacaccggaatttccaggaagaaatagagtttcttaatgcaattttcccaaatggagcaggatattgtatgggacgtatgaattctgactgttggtacttatatactctggatttcccagagagtcgggtaatcagtcagccagatcaaaccttggaaattctgatgagtgagcttgacccagcagttatggaccagttctacatgaaagatggtgttactgcaaaggatgtcactcgtgagagtggaattcgtgacctgataccaggttctgtcattgatgccacaatgttcaatccttgtgggtattcgatgaatggaatgaaatcggatggaacttattggactattcacatcactccagaaccagaattttcttatgttagctttgaaacaaacttaagtcagacctcctatgatgacctgatcaggaaagttgtagaagtcttcaagccaggaaaatttgtgaccaccttgtttgttaatcagagttctaaatgtcgcacagtgcttgcttcgccccagaagattgaaggttttaagcgtcttgattgccagagtgctatgttcaatgattacaattttgtttttaccagttttgctaagaagcagcaacaacagcagagttgattaagaaaaatgaagaaaaaacgcaaaaagagaacacatgtagaaggtggtggatgctttctagatgtcgatgctgggggcagtgctttccataaccaccactgtgtagttgcagaaagccctagatgtaatgatagtgtaatcattttgaattgtatgcattattatatcaaggagttagatatcttgcatgaatgctctcttctgtgtttaggtattctctgccactcttgctgtgaaattgaagtggatgtagaaaaaaccttttactatatgaaactttacaacacttgtgaaagcaactcaatttggtttatgcacagtgtaatatttctccaagtatcatccaaaattccccacagacaaggctttcgtcctcattaggtgttggcctcagcctaaccctctaggactgttctattaaattgctgccagaattttacatccagttacctccactttctagaacatattctttactaatgttattgaaaccaatttctacttcatactgatgtttttggaaacagcaattaaagtttttcttccatagttgagtccttagaaaatgattccagttactcattttgcatattgctatttaacattattggaccctgcatttatagtcctttgatttcttccctctccctggtgtctcccccaagaccccaaataaagcaataccctgttaacactgtgggtttatatactaattctataccccagatggggaattaggggggagatggtccctgggcttaatattctttaaagggcatgggaatttagcctctcttttattgtaatgtgctcttttggaaaatagttggttagcagggagaccagagttgtagattgagattgggtgtactggctgttctgtggaaaacatacattctgtgttcctcgaataagtgaaattgagcttctaatgagatgcacccctttactaacttgatgatgatataaaattcatttttatttagttaattaccagagagatttagcataattttgcttctggattcagtaaatcaagtcagcttggatcattcaccttaacttttcctttagcagccctttccactagtttcccattaagtagtgttctataaactttgatccaaagcagaatcaatgtcttttccatctcgtgacttaaagttctgtgactgtgatgcatgtgagtgttccgacttcatctgttcctcttaactacggtgtttcccttaccgatcggcattcataggatgaaatgaatgactgtcccagaatgagaatttgtccagattattcagataaacatcataaagagaataacattataaataagtagaatatgaataaatagaataataaaattccaaaatactcaatgggaaatgactagtaatataggctttcaagagttggtacctttacgtatatttgcagattctctgggattttaaggaactgagaaaacagaaaagttgactaaattttatatttcttgtcctctaaatattttgataatttctggattgatgcagtgatgtttttcgttccttgtatttataaatgaaaacctttttttggtgtttctaaacctaaaatctacttggtttgaaatcaagtggttggaacactgtttgacttttatttgaagcatgttgttgattgaaaatttcattgaggaagttttcaatcagtgtgatcagtttgattctgtaatgagcacagcacctaatattttgaggagctctgttttgaggaccaatgcttaaggtggaccttgttgctaaacaatatcccaatagatttgttgacttgaggtctggtttggttttgtttttgttttgttttggttttgttttgtttcccaatagaattaagaattctaatgttgaaaaactgtataaatttttatgggacaaagcctagaaaagagaaatgtagtttgaatcataatctaaatcatcgtatgataggaaggaaaagttttggtgccataatttctcctttcactggtgttggacttaaatcagttgaaatgtatttctgtaccacaatttacgcttcaataaaagtttaattgtctagtgag

SEQ ID NO: 644 - DNA, 3334 bp, Homo sapiens
  ref <308>: DATABASE ACCESSION NUMBER: NM_001656
  ref <309>: DATABASE ENTRY DATE: 2001-06-18
ctgtggcgcttcccctgcgaggatggctaccctggttgtaaacaagctcggagcgggagtagacagtggccggcagggcagccgggggacagctgtagtgaaggtgctagagtgtggagtttgtgaagatgtcttttctttgcaaggagacaaagttccccgtcttttgctttgtggccataccgtctgtcatgactgtctcactcgcctacctcttcatggaagagcaatccgttgcccatttgatcgacaagtaacagacctaggtgattcaggtgtctggggattgaaaaaaaattttgctttattggagcttttggaacgactgcagaatgggcctattggtcagtatggagctgcagaagaatccattgggatatctggagagagcatcattcgttgtgatgaagatgaagctcaccttgcctctgtatattgcactgtgtgtgcaactcatttgtgctctgagtgttctcaagttactcattctacaaagacattagcaaagcacaggcgagttcctctagctgataaacctcatgagaaaactatgtgctctcagcaccaggtgcatgccattgagtttgtttgcttggaagaaggttgtcaaactagcccactcatgtgctgtgtctgcaaagaatatggaaaacaccagggtcacaagcattcagtattggaaccagaagctaatcagatccgagcatcaattttagatatggctcactgcatacggaccttcacagaggaaatctcagattattccagaaaattagttggaattgtgcagcacattgaaggaggagaacaaatcgtggaagatggaattggaatggctcacacagaacatgtaccagggactgcagagaatgcccggtcatgtattcgagcttatttttatgatctacatgaaactctgtgtcgtcaagaagaaatggctctaagtgttgttgatgctcatgttcgtgaaaaattgatttggctcaggcagcaacaagaagatatgactattttgttgtcagaggtttctgcagcctgcctccactgtgaaaagactttgcagcaggatgattgtagagttgtcttggcaaaacaggaaattacaaggttactggaaacattgcagaaacagcagcagcagtttacagaagttgcagatcacattcagttggatgccagcatccctgtcacttttacaaaggataatcgagttcacattggaccaaaaatggaaattcgggtcgttacgttaggattggatggtgctggaaaaactactatcttgtttaagttaaaacaggatgaattcatgcagcccattccaacaattggttttaacgtggaaactgtagaatataaaaatctaaaattcactatttgggatgtaggtggaaaacacaaattaagaccattgtggaaacattattacctcaatactcaagctgttgtgtttgttgtagatagcagtcatagagacagaattagtgaagcacacagcgaacttgcaaagttgttaacggaaaaagaactccgagatgctctgctcctgatttttgctaacaaacaggatgttgctggagcactgtcagtagaagaaatcactgaactactcagtctccataaattatgctgtggccgtagctggtatattcagggctgtgatgctcgaagtggtatgggactgtatgaagggttggactggctctcacggcaacttgtagctgctggagtattggatgttgcttgattttaaaggcagcagttgtttgaagttttgtggttaaaagtaactttgcacatagtatgttttaagaaattatacatctcaaaagatggtaatttaggatgcatatatatatatatatatataaaggaatcttggattgggaattcagtactttgctttaaaaaaattttgtggcagaattaaatttctaattgagcagattagattgaattaaatagaaacttattgaatatacattcttttaaaaagtatatttgttatttaagtttttcagataatatgtgaccaatatactgggaaagaggtagtcacagagaaagggtaagtgaaggtttattctttcagtgaaaaaagaatagccaattgagtgcctaatgagacctctgtgtgaagcaagtgaagtatagctgcttcttttaacctgccttttcactgaatgttggcagcatttagtagtagaaatgacagttgcttaatgaaatagaatccaaactacatatttggataataggattactttatgtttatgttcagagttaacagaacacctttaatgctaagaactataaggtacagaaaattaatactttatatagtgttttattaactttctcctacagcattttgtataaaacacaatgagggagtgaaatgttacccaattaggcttgtcaggttagtaataaactgaacagtaataaaactgtggaagtaattggatctgaatttatgaaagacccatttccaggactgaacctaggtcagagctctaaattggtccttctatttttcaacaaatttaaagtaatatttctttctaatataatattgcatcctttgtgggaatgactataggtaaaatgtagtaagtaacgcagaaccagggttggctttatttaaaagctagtgacctaaatagaaagcgaacttcaagagaagttgtaagtacagtggcaaatgcttattacttacttcaaactgtttcccaaaataagtgcatttattttgacaataaaacttaaggctgttcatgagaaggccttgaaaagttactctagaggaaaaatgtctaaagaaaaaaaaaattcaaaaagtttacattaattattcagtgttgtgagtaaataaaaatgtgtgctctttactgtttttcatttttaaagaatattattatggaagcacgatttatttaaataggtacattgagacttttttttttaatgttctgatacattaggatgaagttaaatcttaaatcttattagttgaattgttgtaaggacagtgatgtctggtaacaagatgtgactttttggtagcactgttgtggttcattcttttcaaatctatttttgtttaaaaacaatacaagttttagaaaacaaagcattaaaaaaaaagcctatcagtattatgggcaatatgtaaataaataaatgtaatatttcatcctttatttttcaggtaaaaggtcatgctgttacaggtgtagtttgtgtgcataaataatacttccgaattaaattatttaatatttgactgatttcaataactgtgaaaataaaaaggtgttgtattgcttgtgag

SEQ ID NO: 645 - DNA, 1992 bp, Homo sapiens
  ref <308>: DATABASE ACCESSION NUMBER: NM_001673
  ref <309>: DATABASE ENTRY DATE: 2001-06-18
aaacttcccgcacgcgttacaggagccaggtcggtataagcgccacgcctcgccgcccgtcaagctgtccacatccctggcctcagcccgccacatcaccctgacctgcttacgcccagattttcttcaatcacatctgaataaatcacttgaagaaagcttatagcttcattgcaccatgtgtggcatttgggcgctgtttggcagtgatgattgcctttctgttcagtgtctgagtgctatgaagattgcacacagaggtccagatgcattccgttttgagaatgtcaatggatacaccaactgctgctttggatttcaccggttggcggtagttgacccgctgtttggaatgcagccaattcgagtgaagaaatatccgtatttgtggctctgttacaatggtgaaatctacaaccataagaagatgcaacagcattttgaatttgaataccagaccaaagtggatggtgagataatccttcatctttatgacaaaggaggaattgagcaaacaatttgtatgttggatggtgtgtttgcatttgttttactggatactgccaataagaaagtgttcctgggtagagatacatatggagtcagacctttgtttaaagcaatgacagaagatggatttttggctgtatgttcagaagctaaaggtcttgttacattgaagcactccgcgactccctttttaaaagtggagccttttcttcctggacactatgaagttttggatttaaagccaaatggcaaagttgcatccgtggaaatggttaaatatcatcactgtcgggatgtacccctgcacgccctctatgacaatgtggagaaactctttccaggttttgagatagaaactgtgaagaacaacctcaggatcctttttaataatgctgtaaagaaacgtttgatgacagacagaaggattggctgccttttatcagggggcttggactccagcttggttgctgccactctgttgaagcagctgaaagaagcccaagtacagtatcctctccagacatttgcaattggcatggaagacagccccgatttactggctgctagaaaggtggcagatcatattggaagtgaacattatgaagtcctttttaactctgaggaaggcattcaggctctggatgaagtcatattttccttggaaacttatgacattacaacagttcgtgcttcagtaggtatgtatttaatttccaagtatattcggaagaacacagatagcgtggtgatcttctctggagaaggatcagatgaacttacgcagggttacatatattttcacaaggctccttctcctgaaaaagccgaggaggagagtgagaggcttctgagggaactctatttgtttgatgttctccgcgcagatcgaactactgctgcccatggtcttgaactgagagtcccatttctagatcatcgatttttttcctattacttgtctctgccaccagaaatgagaattccaaagaatgggatagaaaaacatctcctgagagagacgtttgaggattccaatctgatacccaaagagattctctggcgaccaaaagaagccttcagtgatggaataacttcagttaagaattcctggtttaagattttacaggaatacgttgaacatcaggttgatgatgcaatgatggcaaatgcagcccagaaatttcccttcaatactcctaaaaccaaagaaggatattactaccgtcaagtctttgaacgccattacccaggccgggctgactggctgagccattactggatgcccaagtggatcaatgccactgacccttctgcccgcacgctgacccactacaagtcagctgtcaaagcttaggtggtctttatgctgtaatgtgaaagcaaatatttcttcgtgttggatggggactgtgggtagataggggaacaatgagagtcaactcaggctaacttgggtttgaaaaaaataaaattcctaaattt

SEQ ID NO: 646 - DNA, 1914 bp, Homo sapiens
  ref <308>: DATABASE ACCESSION NUMBER: NM_001674
  ref <309>: DATABASE ENTRY DATE: 2001-06-18
gcagccaggcgcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggagcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagaaagagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttagattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggaacagaattctcccagcgttaacacaaaatccatgggcagcatgatggcaggtcctctgttgcaaactcagttccaaagtcacaggaagaaagcagaaagttcaacttccaaagggttaggactctccactcaatgtcttaggtcaggagttgtgtctaggctggaagagccaaagaaatattccattttcctttccttgtggttgaaaccacagtcagtggagagatgtttggaacacagtcagtggagctggtggtaccaggtttagcattattggatgtcaaaagcattttttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattgtggtaaaa

SEQ ID NO: 647 - DNA, 2015 bp, Homo sapiens
  ref <308>: DATABASE ACCESSION NUMBER: NM_001675
  ref <309>: DATABASE ENTRY DATE: 2001-06-18
gttttctactttgcccgcccacagatgtagttttctctgcgcgtgtgcgttttccctcctcccccgccctcagggtccacggccaccatggcgtattaggggcagcagtgcctgcggcagcattggcctttgcagcggcggcagcagcaccaggctctgcagcggcaacccccagcggcttaagccatggcgtgagtaccggggcgggtcgtccagctgtgctcctggggccggcgcgggttttggattggtggggtgcggcctggggccagggcggtgccgccaagggggaagcgatttaacgagcgcccgggacgcgtggtctttgcttgggtgtccccgagacgctcgcgtgcctgggatcgggaaagcgtagtcgggtgcccggactgcttccccaggagccctacagccctcggaccccgagccccgcaaggtcccaggggtcttggctgttgccccacgaaacgtgcaggaaccaagatggcggcggcagggcggcggcgcgggcgtgagtcaagggcgggcggtgggcggggcgcggccgctggccgtatttggacgtggggacggagcgctttcctcttggcggccggtggaagaatcccctggtctccgtgagcgtccattttgtggaacctgagttgcaagcagggaggggcaaatacaactgccctgttcccgattctctagatggccgatctagagaagtcccgcctcataagtggaaggatgaaattctcagaacagctaacctctaatgggagttggcttctgattctcattcaggcttctcacggcattcagcagcagcgttgctgtaaccgacaaagacaccttcgaattaagcacattcctcgattccagcaaagcaccgcaacatgaccgaaatgagcttcctgagcagcgaggtgttggtgggggacttgatgtcccccttcgacccgtcgggtttgggggctgaagaaagcctaggtctcttagatgattacctggaggtggccaagcacttcaaacctcatgggttctccagcgacaaggctaaggcgggctcctccgaatggctggctgtggatgggttggtcagtccctccaacaacagcaaggaggatgccttctccgggacagattggatgttggagaaaatggatttgaaggagttcgacttggatgccctgttgggtatagatgacctggaaaccatgccagatgaccttctgaccacgttggatgacacttgtgatctctttgcccccctagtccaggagactaataagcagcccccccagacggtgaacccaattggccatctcccagaaagtttaacaaaacccgaccaggttgcccccttcaccttcttacaacctcttcccctttccccaggggtcctgtcctccactccagatcattcctttagtttagagctgggcagtgaagtggatatcactgaaggagataggaagccagactacactgcttacgttgccatgatccctcagtgcataaaggaggaagacaccccttcagataatgatagtggcatctgtatgagcccagagtcctatctggggtctcctcagcacagcccctctaccaggggctctccaaataggagcctcccatctccaggtgttctctgtgggtctgcccgtcccaaaccttacgatcctcctggagagaagatggtagcagcaaaagtaaagggtgagaaactggataagaagctgaaaaaaatggagcaaaacaagacagcagccactaggtaccgccagaagaagagggcggagcaggaggctcttactggtgagtgcaaagagctggaaaagaagaacgaggctctaaaagagagggcggattccctggccaaggagatccagtacctgaaagatttgatagaagaggtccgcaaggcaagggggaagaaaagggtcccctagttgaggatagtcaggagcgtcaatgtgcttgtacatagagtgctgtagctgtgtgttccaataaattattttgtaggg

SEQ ID NO: 648 - DNA, 1679 bp, Homo sapiens
  ref <308>: DATABASE ACCESSION NUMBER: NM_001679
  ref <309>: DATABASE ENTRY DATE: 2001-06-18
atgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtggactgtaataaagtatataaattgtgaaatataaaaacttggaacttattcaaagctt

SEQ ID NO: 649 - DNA, 826 bp, Homo sapiens
  ref <308>: DATABASE ACCESSION NUMBER: NM_001689
  ref <309>: DATABASE ENTRY DATE: 2001-06-18
aattccggaattccccggcctggccagggcggagcggcgcccagtagggacccattcattgtgccggcgcctcactgggcacggggcccaagctgacggcgtgcacgggagcctgcggagcctgggtgggaagaacaggcccctggagggcacttgaccttaagcctcttttcctccgcagagaggaagcgggagaggagcccacgtcgcctgtcacccaatatctccagccgcgcagtcccgaagagtgtaagatgttcgcctgcgccaagctcgcctgcaccccctctctgatccgagctggatccagagttgcatacagaccaatttctgcatcagtgttatctcgaccagaggctagtaggactggagagggctctacggtatttaatggggcccagaatggtgtgtctcagctaatccaaagggagtttcagaccagtgcaatcagcagagacattgatactgctgccaaatttattggtgcaggtgctgcaacagtaggagtggctggttctggtgctggtattggaacagtctttggcagccttatcattggttatgccagaaacccttcgctgaagcagcagctgttctcatatgctatcctgggatttgccttgtctgaagctatgggtctcttttgtttgatggttgctttcttgattttgtttgccatgtaacaaattactgcttgacatgttggcattcatattaattacggatgtaattctgtgtatcttactgtgactccgaaaactgtagtattggtgtcatgggaatgtacgttatttccaaagtcatttcattaaagatgaaaacttta

SEQ ID NO: 650 - DNA, 5399 bp, Homo sapiens
  ref <308>: DATABASE ACCESSION NUMBER: NM_001703
  ref <309>: DATABASE ENTRY DATE: 2001-06-18
gccgcgcgggagagcgggagcctcggccctccgcgcggctgcagctacctaccctgcgcccggccaggtccccgacttagggatggcaaacttgcgccccgtggccgcccccgccagcgccggcccccgctcctgctgctgacggcgcccaggaaatccacagcagtgatacatgtgacgtccacactgacagtgccctcctgtgggcatggctcaggttgtgcgcagttcctggcacactggctgtaactccgcccctttctctccctctcagtaaagcaagattacgcggtgacatgcctcacagctgatcacgacacacggggatggagagcaagagttatggagaatacaggttggatgggcaagggacataggatgaccccagcctgtcccctcttactgtctgtgattctgtccctgcgcctggccaccgccttcgaccccgcccccagtgcctgctctgccctggcctcgggtgtgctctacggggccttctcgctgcaggacctctttcctaccatcgcctcgggctgctcctggaccctggagaaccctgaccccaccaagtactccctctacctgcgcttcaaccgccaggagcaggtgtgcgcacactttgccccccgcctgctgcccctggaccactacctggtcaactttacctgcctgcggcctagccccgaggaggcggtggcccaggcggagtcagaggtggggcggccagaagaggaggaggcagaggcggcagcggggttggagctgtgcagcggctcaggcccctttaccttcctgcacttcgacaagaacttcgtgcagctgtgcctgtcggctgagccctccgaggccccgcgcctgctggcgcccgctgccctagccttccgctttgtcgaggtcttgctcatcaacaacaacaactctagccaattcacctgtggtgtgctctgccgctggagtgaggagtgtggccgcgctgccggcagggcctgcggctttgctcagccaggctgcagctgccctggagaggcgggggccggctccaccaccaccacatctccaggccctcctgctgcccacaccctgtccaatgccctggtgcccgggggcccagccccacctgctgaggccgatttgcactcggggagcagcaatgatctgttcacaaccgagatgagatatggtgaggagccggaagaggaaccgaaagtgaaaacccagtggccgaggtctgcagatgagcctgggctatacatggcgcagacaggcgacccggcggctgaggagtggtccccgtggagcgtgtgttccctgacgtgtgggcagggtctgcaggtgcggacccgctcctgtgtgtcctccccctatgggaccctgtgcagcgggcccctgcgggagaccaggccctgcaacaattcagccacctgcccagtgcacggcgtgtgggaggagtgggggtcctggagcctgtgctcccgcagctgcgggcgggggtcccggagccggatgcggacctgcgtgcccccccagcacggcggcaaggcctgcgagggtcctgagctgcagactaagctctgcagtatggctgcctgcccggtggaaggccagtggttagaatggggtccctggggcccatgctccacgtcctgtgccaatgggacccaacagcgcagccggaagtgcagcgtggcgggcccagcctgggccacatgcacgggtgccctcactgacacccgggagtgcagcaacctcgagtgcccggccactgatagcaagtgggggccatggaatgcgtggagcctgtgctctaagacgtgtgacacaggctggcagcgccgcttccgcatgtgccaggccacgggcacgcagggctacccctgcgagggcaccggagaggaggtgaagccttgtagtgagaagaggtgtccagccttccatgagatgtgcagggatgagtacgtgatgctgatgacgtggaagaaggcagctgctggcgagatcatctacaacaagtgccccccgaatgcctcagggtctgccagccgccgctgtctcctcagtgcccaaggcgtggcgtactgggggctgcccagctttgctcgctgcatctcccatgagtaccgctacctgtatctgtcacttagggagcacctggccaaggggcagcgcatgctggcaggcgagggcatgtcgcaggtggtgcgcagcctgcaggagctactggcccggcgcacctactatagtggggacctgctcttctctgtggacattctgaggaatgtcactgacacctttaagagggccacctacgtgccctcggctgatgatgtgcagcgcttcttccaggtggtgagcttcatggtggatgcggaaaacaaggagaagtgggacgatgctcagcaggtgtcccctggctctgtgcacctgctccgtgtcgtggaggacttcattcacctggtgggcgatgctctcaaggccttccagagctctctgattgtcacagataatctagtgatcagcattcagcgagagcccgtctcagctgtgtccagtgacatcacgttccccatgcggggccgccggggcatgaaggactgggtgcggcactcagaggaccgcctcttcctgcccaaggaggtgctcagcctctcctccccagggaagccagccacatctggggcagcaggcagccctggcagggggaggggcccaggaacggtgcctcctggcccaggccactcccaccagcgcctcctcccagcagaccctgatgagtcctcctactttgtgatcggtgctgtactctaccgcacccttggcctcatcctgccgcctcccaggcccccgctggccgtcacatcccgggtgatgacagtgactgtgcgcccccctacccagcctccagctgagcccctcatcactgtggagctctcctacatcatcaatgggaccacggatccccattgcgccagctgggactactccagagcagatgccagctcaggagactgggacactgaaaattgccagaccctggagacccaggcagctcacacccgctgccagtgccagcacctgtccacctttgctgtactagcccagccgcccaaggacctgaccctggagctggcgggctccccctcggtccccctggtgatcggctgtgcagtgtcgtgcatggcgctgctcaccctgctcgccatctatgccgccttttggaggttcataaaatctgaacgctccatcatcttgctgaacttctgcctgtccatcttggcatccaacatcctgatcctcgtgggccagtcccgggtgctgagcaagggcgtgtgcaccatgacggctgccttcctgcacttcttctttctctcctccttttgctgggtgcttaccgaggcctggcagtcctacctggctgtcattgggcggatgcgcacccgcctcgttcgcaagcgcttcctctgcctgggctggggtctgcctgccctggtggtggccgtgtctgttggctttacccgaacgaaaggatacggtacatccagctactgctggctctccctggagggcggcctgctctacgcctttgtgggccctgcagccgtcattgtcctggtgaacatgctcatcggaatcatcgtcttcaacaagctcatggcacgtgatggcatctccgacaaatccaagaagcagagggccgggtcggagcggtgcccctgggccagcctgctcctcccctgctcagcgtgtggagcggtccccagccccctgctcagctcagcctcggccaggaacgccatggcctcactctggagctcctgcgtggtgctgcccctgctggcgctcacctggatgtctgccgtcctggctatgacagaccgccgttccgtcctcttccaggccctctttgctgtcttcaactccgcgcagggctttgtcatcactgctgtgcactgcttcctgcgccgagaggtccaggatgtggtgaagtgccagatgggggtgtgccgggctgatgagagcgaagactcccctgactcgtgtaagaacgggcagctgcagatcctgtcagactttgaaaaggatgtggatctggcttgtcaaacagtgctgttcaaggaggtcaacacttgcaacccgtccaccatcacgggcacactatcccgcctgtccctggatgaggatgaggagcccaagtcctgcctcgtgggccctgagggcagcctcagcttctcaccactgcctgggaatatcctggtgcccatggcagcctcaccagggctgggggagcctccgcccccacaggaggccaaccctgtttacatgtgtggggagggtggcctgcggcagctggacctcacatggctgcggcccactgagccaggctctgagggagactacatggtgctgccccggcggactttgagcctgcagcctggcggtgggggtggaggtggtgaggatgcccccagggcccggcccgaggggaccccccggcgagctgccaagacagtggcccacactgaaggctaccccagcttcctgtccgtggaccactcgggcctggggctgggccctgcctatggatctctccagaatccctatggaatgaccttccaaccgccaccgccgacacccagcgcccgccaagtgcccgagccaggggagcgcagccggaccatgcctcgcaccgtgcccggctctaccatgaagatgggctccctggagcgaaagaaattacggtattcagacctggactttgaggtgatgcacacccggaaacggcattcagaactctaccacgagctcaaccagaagttccacactttcgaccgctaccgcagccagtccacggccaagagggagaagcggtggagtgtgtcctcgggtggggcggccgagcggagcgtgtgcaccgataagcccagccctggggagcgccccagcttgtcccaacatcggcgccatcagagctggagcaccttcaaatctatgacactgggctcgctgccccccaagccccgagaacggctgactctgcaccgggcagcagcctgggagcccacagaaccaccggatggtgacttccagacagaggtgtgagtgccacgctggactgcccactgcatataaatatatatatctctctattttcacactccactttggaactacccaggagccagcgccctctcccctctcccgagggctgggcagggaggcgccgtggactcagccaggctgggggagccggacatggcttggcctggggtcccagggcccttccttgtttctcagaggcccctcagccactggaaccccatcttcagcccagcctgtccgtccctgtcccgggctggggaggggggaggggaactttgttgggaataaacttcactctgtgg

SEQ ID NO: 651 - DNA, 2388 bp, Homo sapiens
  ref <308>: DATABASE ACCESSION NUMBER: NM_001710
  ref <309>: DATABASE ENTRY DATE: 2001-06-18
tcctgccccaggcccagcttctctcctgccttccaacgccatggggagcaatctcagcccccaactctgcctgatgccctttatcttgggcctcttgtctggaggtgtgaccaccactccatggtctttggcccagccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccggtggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaac

SEQ ID NO: 652 - DNA, 1813 bp, Homo sapiens
  ref <308>: DATABASE ACCESSION NUMBER: NM_001725
  ref <309>: DATABASE ENTRY DATE: 2001-06-18
caggccttgaggttttggcagctctggaggatgagagagaacatggccaggggcccttgcaacgcgccgagatgggtgtccctgatggtgctcgtcgccataggcaccgccgtgacagcggccgtcaaccctggcgtcgtggtcaggatctcccagaagggcctggactacgccagccagcaggggacggccgctctgcagaaggagctgaagaggatcaagattcctgactactcagacagctttaagatcaagcatcttgggaaggggcattatagcttctacagcatggacatccgtgaattccagcttcccagttcccagataagcatggtgcccaatgtgggccttaagttctccatcagcaacgccaatatcaagatcagcgggaaatggaaggcacaaaagagattcttaaaaatgagcggcaattttgacctgagcatagaaggcatgtccatttcggctgatctgaagctgggcagtaaccccacgtcaggcaagcccaccatcacctgctccagctgcagcagccacatcaacagtgtccacgtgcacatctcaaagagcaaagtcgggtggctgatccaactcttccacaaaaaaattgagtctgcgcttcgaaacaagatgaacagccaggtctgcgagaaagtgaccaattctgtatcctccaagctgcaaccttatttccagactctgccagtaatgaccaaaatagattctgtggctggaatcaactatggtctggtggcacctccagcaaccacggctgagaccctggatgtacagatgaagggggagttttacagtgagaaccaccacaatccacctccctttgctccaccagtgatggagtttcccgctgcccatgaccgcatggtatacctgggcctctcagactacttcttcaacacagccgggcttgtataccaagaggctggggtcttgaagatgacccttagagatgacatgattccaaaggagtccaaatttcgactgacaaccaagttctttggaaccttcctacctgaggtggccaagaagtttcccaacatgaagatacagatccatgtctcagcctccaccccgccacacctgtctgtgcagcccaccggccttaccttctaccctgccgtggatgtccaggcctttgccgtcctccccaactcctccctggcttccctcttcctgattggcatgcacacaactggttccatggaggtcagcgccgagtccaacaggcttgttggagagctcaagctggataggctgctcctggaactgaagcactcaaatattggccccttcccggttgaattgctgcaggatatcatgaactacattgtacccattcttgtgctgcccagggttaacgagaaactacagaaaggcttccctctcccgacgccggccagagtccagctctacaacgtagtgcttcagcctcaccagaacttcctgctgttcggtgcagacgttgtctataaatgaaggcaccaggggtgccgggggctgtcagccgcacctgttcctgatgggctgtggggcaccggctgcctttccccagggaatcctctccagatcttaaccaagagccccttgcaaacttcttcgactcagattcagaaatgatctaaacacgaggaaacattattcattggaaaagtgcatggtgtgtattttagggattatgagcttctttcaagggctaaggctgcagagatatttcctccaggaatcgtgtttcaattgtaaccaagaaatttccatttgtgcttcatgaaaaaaaacttctggtttttttcatgtg

SEQ ID NO: 653 - DNA, 3359 bp, Homo sapiens
  ref <308>: DATABASE ACCESSION NUMBER: NM_001730
  ref <309>: DATABASE ENTRY DATE: 2001-06-18
ggtacgtgcgctcgcggttctctcgcggaggtcggcggtggcgggagcgggctccggagagcctgagagcacggtggggcggggcgggagaaagtggccgcccggaggacgttggcgtttacgtgtggaagagcggaagagttttgcttttcgtgcgcgccttcgaaaactgcctgccgctgtctgaggagtccacccgaaacctcccctcctccgccggcagccccgcgctgagctcgccgacccaagccagcgtgggcgaggtgggaagtgcgcccgacccgcgcctggagctgcgcccccgagtgcccatggctacaagggtgctgagcatgagcgcccgcctgggacccgtgccccagccgccggcgccgcaggacgagccggtgttcgcgcagctcaagccggtgctgggcgccgcgaatccggcccgcgacgcggcgctcttccccggcgaggagctgaagcacgcgcaccaccgcccgcaggcgcagcccgcgcccgcgcaggccccgcagccggcccagccgcccgccaccggcccgcggctgcctccagaggacctggtccagacaagatgtgaaatggagaagtatctgacacctcagcttcctccagttcctataattccagagcataaaaagtatagacgagacagtgcctcagtcgtagaccagttcttcactgacactgaagggttaccttacagtatcaacatgaacgtcttcctccctgacatcactcacctgagaactggcctctacaaatcccagagaccgtgcgtaacacacatcaagacagaacctgttgccattttcagccaccagagtgaaacgactgcccctcctccggccccgacccaggccctccctgagttcaccagtatattcagctcacaccagaccgcagctccagaggtgaacaatattttcatcaaacaagaacttcctacaccagatcttcatctttctgtccctacccagcagggccacctgtaccagctactgaatacaccggatctagatatgcccagttctacaaatcagacagcagcaatggacactcttaatgtttctatgtcagctgccatggcaggccttaacacacacacctctgctgttccgcagactgcagtgaaacaattccagggcatgcccccttgcacatacacaatgccaagtcagtttcttccacaacaggccacttactttcccccgtcaccaccaagctcagagcctggaagtccagatagacaagcagagatgctccagaatttaaccccacctccatcctatgctgctacaattgcttctaaactggcaattcacaatccaaatttacccaccaccctgccagttaactcacaaaacatccaacctgtcagatacaatagaaggagtaaccccgatttggagaaacgacgcatccactactgcgattaccctggttgcacaaaagtttataccaagtcttctcatttaaaagctcacctgaggactcacactggtgaaaagccatacaagtgtacctgggaaggctgcgactggaggttcgcgcgatcggatgagctgacccgccactaccggaagcacacaggcgccaagcccttccagtgcggggtgtgcaaccgcagcttctcgcgctctgaccacctggccctgcatatgaagaggcaccagaactgagcactgcccgtgtgacccgttccaggtcccctgggctccctcaaatgacagacctaactattcctgtgtaaaaacaacaaaaacaaaaaaaaaacaagaaaaccacaactaaaactggaaatgtatattttgtatatttgagaaaacagggaatacattgtattaataccaaagtgtttggtcattttaagaatctggaatgcttgctgtaatgtatatggctttactcaagcagatctcatctcatctcatgacaggcagccagtctcaacatgggtaaggggtgggggtgaaggggagtgtgtgcagcgtttttacctaggcaccatcatttaatgtgacagtgttcagtaaacaaatcagttggcaggcaccagaagaagaatggattgtatgtcaagattttacttggcattgagtagtttttttcaatagtaggtaattccttagagatacagtatacctggcaattcacaaatagccattgaacaaatgtgtgggtttttaaaaattatatacatatatgagttgcctatatttgctattcaaaattttgtaaatatgcaaatcagctttataggtttattacaagttttttaggattcttttggggaagagtcataattcttttgaaaataaccatgaatacacttacagttaggatttgtggtaaggtacctctcaacattaccaaaatcatttctttagagggaaggaataatcattcaaatgaactttaaaaaagcaaatttcatgcactgattaaaataggattattttaaatacaaaaggcattttatatgaattataaactgaagagcttaaagatagttacaaaatacaaaagttcaacctcttacaataagctaaacgcaatgtcatttttaaaaagaaggacttaggggtcgttttcacatatgacaatgttgcatttatgatgcagttttcaagtaccaaaacgttgaattgatgatgcagttttcatatatcgagatgttcgctcgtgcagtactgttggttaaatgacaatttatgtggattttgcatgtaatacacagtgagacacagtaattttatctaaattacagtgcagtttagttaatctattaatactgactcagtgtctgcctttaaatataaatgatatgttgaaaacttaaggaagcaaatgctacatatatgcaatataaaatagtaatgtgatgctgatgctgttaaccaaagggcagaataaataagcaaaatgccaaaaggggtcttaattgaaatgaaaatttaattttgtttttaaaatattgtttatctttatttattttgtggtaatatagtaagtttttttagaagacaattttcataacttgataaattatagttttgtttgttagaaaagttgctcttaaaagatgtaaatagatgacaaacgatgtaaataattttgtaagaggcttcaaaatgtttatacgtggaaacacacctacatgaaaagcagaaatcggttgctgttttgcttctttttccctcttatttttgtattgtggtcatttcctatgcaaataatggagcaaacagctgtatagttgtagaattttttgagagaatgagatgtttatatattaacgacaattttttttttggaaaataaaaagtgcctaaaagaaaaaaaaaaaaaaaaaa

SEQ ID NO: 654 - DNA, 2386 bp, Homo sapiens
  ref <308>: DATABASE ACCESSION NUMBER: NM_001733
  ref <309>: DATABASE ENTRY DATE: 2001-06-18
tgcacgaagacgctgtcgggagagcccaggattcaacacgggccttgagaaatgtggctcttgtacctcctggtgccggccctgttctgcagggcaggaggctccattcccatccctcagaagttatttggggaggtgacttcccctctgttccccaagccttaccccaacaactttgaaacaaccactgtgatcacagtccccacgggatacagggtgaagctcgtcttccagcagtttgacctggagccttctgaaggctgcttctatgattatgtcaagatctctgctgataagaaaagcctggggaggttctgtgggcaactgggttctccactgggcaaccccccgggaaagaaggaatttatgtcccaagggaacaagatgctgctgaccttccacacagacttctccaacgaggagaatgggaccatcatgttctacaagggcttcctggcctactaccaagctgtggaccttgatgaatgtgcttcccggagcaaattaggggaggaggatccccagccccagtgccagcacctgtgtcacaactacgttggaggctacttctgttcctgccgtccaggctatgagcttcaggaagacaggcattcctgccaggctgagtgcagcagcgagctgtacacggaggcatcaggctacatctccagcctggagtaccctcggtcctacccccctgacctgcgctgcaactacagcatccgggtggagcggggcctcaccctgcacctcaagttcctggagccttttgatattgatgaccaccagcaagtacactgcccctatgaccagctacagatctatgccaacgggaagaacattggcgagttctgtgggaagcaaaggccccccgacctcgacaccagcagcaatgctgtggatctgctgttcttcacagatgagtcgggggacagccggggctggaagctgcgctacaccaccgagatcatcaagtgcccccagcccaagaccctagacgagttcaccatcatccagaacctgcagcctcagtaccagttccgtgactacttcattgctacctgcaagcaaggctaccagctcatagaggggaaccaggtgctgcattccttcacagctgtctgccaggatgatggcacgtggcatcgtgccatgcccagatgcaagatcaaggactgtgggcagccccgaaacctgcctaatggtgacttccgttacaccaccacaatgggagtgaacacctacaaggcccgtatccagtactactgccatgagccatattacaagatgcagaccagagctggcagcagggagtctgagcaaggggtgtacacctgcacagcacagggcatttggaagaatgaacagaagggagagaagattcctcggtgcttgccagtgtgtgggaagcccgtgaaccccgtggaacagaggcagcgcatcatcggagggcaaaaagccaagatgggcaacttcccctggcaggtgttcaccaacatccacgggcgcgggggcggggccctgctgggcgaccgctggatcctcacagctgcccacaccctgtatcccaaggaacacgaagcgcaaagcaacgcctctttggatgtgttcctgggccacacaaatgtggaagagctcatgaagctaggaaatcaccccatccgcagggtcagcgtccacccggactaccgtcaggatgagtcctacaattttgagggggacatcgccctgctggagctggaaaatagtgtcaccctgggtcccaacctcctccccatctgcctccctgacaacgataccttctacgacctgggcttgatgggctatgtcagtggcttcggggtcatggaggagaagattgctcatgacctcaggtttgtccgtctgcccgtagctaatccacaggcctgtgagaactggctccggggaaagaataggatggatgtgttctctcaaaacatgttctgtgctggacacccatctctaaagcaggacgcctgccagggggatagtgggggcgtttttgcagtaagggacccgaacactgatcgctgggtggccacgggcatcgtgtcctggggcatcgggtgcagcaggggctatggcttctacaccaaagtgctcaactacgtggactggatcaagaaagagatggaggaggaggactgagcccagaattcactaggttcgaatccagagagcagtgtggaaaaaaaaaaacaaaaaacaactgaccagttgttgataaccactaagagtctctattaaaattactgatgcagaaagaccgtgtgtgaaattctctttcctgtagtcccattgatgtactttacctgaaacaaccaaagggcccctttctttcttctgaggattgcagaggatatag

SEQ ID NO: 655 - DNA, 2647 bp, Homo sapiens
  ref <308>: DATABASE ACCESSION NUMBER: NM_001734
  ref <309>: DATABASE ENTRY DATE: 2001-06-18
gggccggagttcctgcagagggagcgtcaaggccctgtgctgctgtccctgggggccagaggggttgcccagcatgcccactggcaggagagagggaactgacccacttgctcctaccagcttctgaaggctccaaagtccggagtgcagaaagccaggaccaagagacaggcagctcaccagggtggacaaatcgccagagatgtggtgcattgtcctgttttcacttttggcatgggtttatgctgagcctaccatgtatggggagatcctgtcccctaactatcctcaggcatatcccagtgaggtagagaaatcttgggacatagaagttcctgaagggtatgggattcacctctacttcacccatctggacattgagctgtcagagaactgtgcgtatgactcagtgcagataatctcaggagacactgaagaagggaggctctgtggacagaggagcagtaacaatccccactctccaattgtggaagagttccaagtcccatacaacaaactccaggtgatctttaagtcagacttttccaatgaagagcgttttacggggtttgctgcatactatgttgccacagacataaatgaatgcacagattttgtagatgtcccttgtagccacttctgcaacaatttcattggtggttacttctgctcctgccccccggaatatttcctccatgatgacatgaagaattgcggagttaattgcagtggggatgtattcactgcactgattggggagattgcaagtcccaattatcccaaaccatatccagagaactcaaggtgtgaataccagatccggttggagaaagggttccaagtggtggtgaccttgcggagagaagattttgatgtggaagcagctgactcagcgggaaactgccttgacagtttagtttttgttgcaggagatcggcaatttggtccttactgtggtcatggattccctgggcctctaaatattgaaaccaagagtaatgctcttgatatcatcttccaaactgatctaacagggcaaaaaaagggctggaaacttcgctatcatggagatccaatgccctgccctaaggaagacactcccaattctgtttgggagcctgcgaaggcaaaatatgtctttagagatgtggtgcagataacctgtctggatgggtttgaagttgtggagggacgtgttggtgcaacatctttctattcgacttgtcaaagcaatggaaagtggagtaattccaaactgaaatgtcaacctgtggactgtggcattcctgaatccattgagaatggtaaagttgaagacccagagagcactttgtttggttctgtcatccgctacacttgtgaggagccatattactacatggaaaatggaggaggtggggagtatcactgtgctggtaacgggagctgggtgaatgaggtgctgggcccggagctgccgaaatgtgttccagtctgtggagtccccagagaaccctttgaagaaaaacagaggataattggaggatccgatgcagatattaaaaacttcccctggcaagtcttctttgacaacccatgggctggtggagcgctcattaatgagtactgggtgctgacggctgctcatgttgtggagggaaacagggagccaacaatgtatgttgggtccacctcagtgcagacctcacggctggcaaaatccaagatgctcactcctgagcatgtgtttattcatccgggatggaagctgctggaagtcccagaaggacgaaccaattttgataatgacattgcactggtgcggctgaaagacccagtgaaaatgggacccaccgtctctcccatctgcctaccaggcacctcttccgactacaacctcatggatggggacctgggactgatctcaggctggggccgaacagagaagagagatcgtgctgttcgcctcaaggcggcaaggttacctgtagctcctttaagaaaatgcaaagaagtgaaagtggagaaacccacagcagatgcagaggcctatgttttcactcctaacatgatctgtgctggaggagagaagggcatggatagctgtaaaggggacagtggtggggcctttgctgtacaggatcccaatgacaagaccaaattctacgcagctggcctggtgtcctgggggccccagtgtgggacctatgggctctacacacgggtaaagaactatgttgactggataatgaagactatgcaggaaaatagcaccccccgtgaggactaatccagatacatcccaccagcctctccaagggtggtgaccaatgcattaccttctgttccttatgatattctcattatttcatcatgactgaaagaagacacgagcgaatgatttaaatagaacttgattgttgagacgccttgctagaggtagagtttgatcatagaattgtgctggtcatacatttgtggtctgactccttggggtcctttccccggagtacctattgtagataacactatgggtggggcactcctttcttgcactattccacagggataccttaattctttgtttcctctttacctgttcaaaattccatttacttgatcattctcagtatccactgtctatgtacaataaaggatgtttataagc

SEQ ID NO: 656 - DNA, 1453 bp, Homo sapiens
  ref <308>: DATABASE ACCESSION NUMBER: NM_001740
  ref <309>: DATABASE ENTRY DATE: 2001-06-18
agcgcgagtgccagagcccagccggcgcggagcgggagcggtgcaggctgaggtctccgagcggctcgccatggctggcccgcagcagcagcccccttacctgcacctggccgagctgacggcgtcccagttcctggaaatatggaagcactttgacgcagacggaaatgggtatattgaaggtaaagagctagaaaactttttccaagagctggagaaggcaaggaaaggctctggcatgatgtcaaagagtgacaactttggagaaaagatgaaggagttcatgcagaagtatgataaaaactcagatgggaaaatcgagatggcagagctggcgcagatcctgccaaccgaagagaacttccttctgtgcttcaggcagcacgtgggctccagcgccgagtttatggaggcttggcggaagtacgacacagacaggagtggctacatcgaagccaatgagctcaagggattcctgtcagacctgctgaagaaggcgaaccggccgtacgatgagcccaagctccaggaatacacccaaaccatactacggatgtttgacttgaacggggatggcaaattgggcctctcagagatgtcccgactcctgcctgtccaggaaaacttcctgcttaaatttcagggcatgaagctgacctcagaggagtttaacgcgatcttcacattttacgacaaggatagaagcggctacattgacgagcatgagctggatgcccttttgaaggatctgtacgagaaaaacaaaaaggaaatcaatattcaacagctcaccaactacagaaagagcgtcatgtccttggcagaggcagggaagctctaccgcaaggacctggagattgtgctctgcagcgagccccccatgtaaagtggggacgggggctgcttctccacctcccccaaaccctgcttctgctgccctgatgcgtctacccagactcagagaccgtgagcgccccgcccccacccctacagcctgcacacacctgcctgcagagcaggaaacgagagatagaggatgggcagctggggggctgtcctgagccccctgcacccacccctgcccaggcagtctttgctcagtggatcacacacatggaaggtgatgggggcatgggtggagggtccctaattctcttcgctgtgatgcatgagctccctcgctgtatgatttaggcttctatgtccaacagagtggactcttccctctcgctcccctctgccggtcccccatgccaccacccaccccaaacttccaggttccatccaccaccttgccaatggtgtagctgtcctctcagaactcctgtgtgtggaaggcacccgccctttccttgccttctttactcggcgtgctccttttctctttgggtttcttgtttaccaaagaagagtttacagacaataaaatggaaaggtcctgctgtggaaactt

SEQ ID NO: 657 - DNA, 1350 bp, Homo sapiens
  ref <308>: DATABASE ACCESSION NUMBER: NM_001745
  ref <309>: DATABASE ENTRY DATE: 2001-06-18
cgccactgccacccctcccagactgtggacgggaggatggagtcgatggccgtcgctaccgacggcggggagaggccgggggtcccagcgggctcaggtctgtcggcttcccagcgtcgggcggagctgcgtcggagaaagctgctcatgaactcggaacagcgcatcaaccggatcatgggctttcacaggcccgggagcggcgcggaagaagaaagtcaaacaaaatcaaagcagcaggacagtgataaactgaactccctcagcgttccttccgtttcaaagcgagtagtgctgggtgattcagtcagtacaggaacaactgaccagcagggtggtgtggccgaggtaaaggggacccaactgggagacaaattggactcgttcattaaaccacctgagtgcagtagtgatgtcaaccttgagctccggcagcggaacagaggggacctgacagcggactcggtccagaggggttcccgccatggcctagagcagtacctttccagattcgaagaagcaatgaagctaaggaaacagctgattagtgaaaaacccagtcaagaggatggaaatacaacagaagaatttgactcttttcgaatatttagattggtgggatgtgctcttcttgctcttggagtcagagcttttgtttgcaaatacttgtccatatttgctccatttcttactttacaacttgcgtacatgggattatacaaatattttcccaagagtgaaaagaagataaagacaacagtactaacagctgcacttctattgtcgggaattcctgccgaagtgataaatcgatcaatggatacctatagcaaaatgggcgaagtcttcacagatctctgtgtctactttttcacttttatcttttgtcatgaactgcttgattattggggctctgaagtaccatgaagcctgtagaactgagaaggagaagcttacgaaaaaaatcctcttctatattgcagtgtctctaaaggaggcaaattggtttacaccttcatgtaattcttttactttaggggttgtaaagctactttattagatatagaatggcagattctctgatttaaaagggctgagtttgtattattactgatatgaagaatagagtaccaatgtcattaattgatttttcttgttaatcagaattcctattctgtacctttcctctaacttctcagatttgtaattcttcttttcgggagctgagctagtgcttttaggagaacagataaatgtggtctcagccagccctagagactgcttcttgtgtttgtgtcattctgtcctgagaaatgaagtcatctgaaaaataaaaatgcagaaacccaa

SEQ ID NO: 658 - DNA, 1221 bp, Homo sapiens
  ref <308>: DATABASE ACCESSION NUMBER: NM_001747
  ref <309>: DATABASE ENTRY DATE: 2001-06-18
cgcaggctggaaggaagacgaacctacgaagcagagatctgaagacagcatgtacacagccattccccagagtggctctccattcccaggctcagtgcaggatccaggcctgcatgtgtggcgggtggagaagctgaagccggtgcctgtggcgcaagagaaccagggcgtcttcttctcgggggactcctacctagtgctgcacaatggcccagaagaggtttcccatctgcacctgtggataggccagcagtcatcccgggatgagcagggggcctgtgccgtgctggctgtgcacctcaacacgctgctgggagagcggcctgtgcagcaccgcgaggtgcagggcaatgagtctgacctcttcatgagctacttcccacggggcctcaagtaccaggaaggtggtgtggagtcagcatttcacaagacctccacaggagccccagctgccatcaagaaactctaccaggtgaaggggaagaagaacatccgtgccaccgagcgggcactgaactgggacagcttcaacactggggactgcttcatcctggacctgggccagaacatcttcgcctggtgtggtggaaagtccaacatcctggaacgcaacaaggcgagggacctggccctggccatccgggacagtgagcgacagggcaaggcccaggtggagattgtcactgatggggaggagcctgctgagatgatccaggtcctgggccccaagcctgctctgaaggagggcaaccctgaggaagacctcacagctgacaaggcaaatgcccaggccgcagctctgtataaggtctctgatgccactggacagatgaacctgaccaaggtggctgactccagcccctttgcccttgaactgctgatatctgatgactgctttgtgctggacaacgggctctgtggcaagatctatatctggaaggggcgaaaagcgaatgagaaggagcggcaggcagccctgcaggtggccgagggcttcatctcgcgcatgcagtacgccccgaacactcaggtggagattctgcctcagggccgtgagagtcccatcttcaagcaatttttcaaggactggaaatgagggtgggcgtcttcctgccccatgctcccctgccccccaccacctgcctgcttgcttctctggctgcctggtcagtgcagaggtgccccctgcagatgttcaataaaggagacaagtgctttccc

SEQ ID NO: 659 - DNA, 1476 bp, Homo sapiens
  ref <308>: DATABASE ACCESSION NUMBER: NM_001756
  ref <309>: DATABASE ENTRY DATE: 2001-06-18
actgtacacatgctagggtccaggacagcaggaccaagccagcagaaacagcctcagcctaccgcagactggcctggctatactggacaatgccactcctcctgtacacctgtcttctctggctgcccaccagcggcctctggaccgtccaggccatggatcctaacgctgcttatgtgaacatgagtaaccatcaccggggcctggcttcagccaacgttgactttgccttcagcctgtataagcacctagtggccttgagtcccaaaaagaacattttcatctcccctgtgagcatctccatggccttagctatgctgtccctgggcacctgtggccacacacgggcccagcttctccagggcctgggtttcaacctcactgagaggtctgagactgagatccaccagggtttccagcacctgcaccaactctttgcaaagtcagacaccagcttagaaatgactatgggcaatgccttgtttcttgatggcagcctggagttgctggagtcattctcagcagacatcaagcactactatgagtcagaggtcttggctatgaatttccaggactgggcaacagccagcagacagatcaacagctatgtcaagaataagacacaggggaaaattgtcgacttgttttcagggctggatagcccagccatcctcgtcctggtcaactatatcttcttcaaaggcacatggacacagccctttgacctggcaagcaccagggaggagaacttctatgtggacgagacaactgtggtgaaggtgcccatgatgttgcagtcgagcaccatcagttaccttcatgactcagagctcccctgccagctggtgcagatgaactacgtgggcaatgggactgtcttcttcatccttccggacaaggggaagatgaacacagtcatcgctgcactgagccgggacacgattaacaggtggtccgcaggcctgaccagcagccaggtggacctgtacattccaaaggtcaccatctctggagtctatgaccttggagatgtgctggaggaaatgggcattgcagacttgttcaccaaccaggcaaatttctcacgcatcacccaggacgcccagctgaagtcatcaaaggtggtccataaagctgtgctgcaactcaatgaggagggtgtggacacagctggctccactggggtcaccctaaacctgacgtccaagcctatcatcttgcgtttcaaccagcccttcatcatcatgatcttcgaccacttcacctggagcagccttttcctggcgagggttatgaacccagtgtaagagaccacccacccagagcctcagcactgtctgactttgggaaccagggatcccacagaaatgttttggagagcgggaggtttcccccaatctcctccaagttcttctccctccaaccagagttgtgtctaactttaggcatcttttaataaatgtcattgcgactctg

SEQ ID NO: 660 - DNA, 1209 bp, Homo sapiens
  ref <308>: DATABASE ACCESSION NUMBER: NM_001757
  ref <309>: DATABASE ENTRY DATE: 2001-06-18
cagactcgagcagtctctggaacacgctgcggggctcccgggcctgagccaggtctgttctccacgcaggtgttccgcgcgccccgttcagccatgtcgtccggcatccatgtagcgctggtgactggaggcaacaagggcatcggcttggccatcgtgcgcgacctgtgccggctgttctcgggggacgtggtgctcacggcgcgggacgtgacgcggggccaggcggccgtacagcagctgcaggcggagggcctgagcccgcgcttccaccagctggacatcgacgatctgcagagcatccgcgccctgcgcgacttcctgcgcaaggagtacgggggcctggacgtgctggtcaacaacgcgggcatcgccttcaaggttgctgatcccacaccctttcatattcaagctgaagtgacgatgaaaacaaatttctttggtacccgagatgtgtgcacagaattactccctctaataaaaccccaagggagagtggtgaacgtatctagcatcatgagcgtcagagcccttaaaagctgcagcccagagctgcagcagaagttccgcagtgagaccatcactgaggaggagctggtggggctcatgaacaagtttgtggaggatacaaagaagggagtgcaccagaaggagggctggcccagcagcgcatacggggtgacgaagattggcgtcaccgttctgtccaggatccacgccaggaaactgagtgagcagaggaaaggggacaagatcctcctgaatgcctgctgcccagggtgggtgagaactgacatggcgggacccaaggccaccaagagcccagaagaaggtgcagagacccctgtgtacttggcccttttgcccccagatgctgagggtccccatggacaatttgtttcagagaagagagttgaacagtggtgagctgggctcacagctccatccatgggccccattttgtaccttgtcctgagttggtccaaagggcatttacaatgtcataaatatccttatataagaaaaaaaatgatctcttatcaattagcactcactaatgtactactaattgagcaacctacgcactcagttgactacgtaaatctgtcaggtcttttgtgatttcctctgatgcaggagaggaaaaattgtaattgatgaaaataatgaatgaaaatcaacagatgaataaatggttctttataagtg

SEQ ID NO: 661 - DNA, 1325 bp, Homo sapiens
  ref <308>: DATABASE ACCESSION NUMBER: NM_001758
  ref <309>: DATABASE ENTRY DATE: 2001-06-18
gcagtagcagcgagcagcagagtccgcacgctccggcgaggggcagaagagcgcgagggagcgcggggcagcagaagcgagagccgagcgcggacccagccaggacccacagccctccccagctgcccaggaagagccccagccatggaacaccagctcctgtgctgcgaagtggaaaccatccgccgcgcgtaccccgatgccaacctcctcaacgaccgggtgctgcgggccatgctgaaggcggaggagacctgcgcgccctcggtgtcctacttcaaatgtgtgcagaaggaggtcctgccgtccatgcggaagatcgtcgccacctggatgctggaggtctgcgaggaacagaagtgcgaggaggaggtcttcccgctggccatgaactacctggaccgcttcctgtcgctggagcccgtgaaaaagagccgcctgcagctgctgggggccacttgcatgttcgtggcctctaagatgaaggagaccatccccctgacggccgagaagctgtgcatctacaccgacggctccatccggcccgaggagctgctgcaaatggagctgctcctggtgaacaagctcaagtggaacctggccgcaatgaccccgcacgatttcattgaacacttcctctccaaaatgccagaggcggaggagaacaaacagatcatccgcaaacacgcgcagaccttcgttgcctcttgtgccacagatgtgaagttcatttccaatccgccctccatggtggcagcggggagcgtggtggccgcagtgcaaggcctgaacctgaggagccccaacaacttcctgtcctactaccgcctcacacgcttcctctccagagtgatcaagtgtgacccagactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgaggggcccaggcaggcgggcgccaccgccacccgcagcgagggcggagccggccccaggtgctccacatgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaaaaaaaaaaaaaaaaaaaaaaaaaaaaaaaaaaaaaaaaaaaaaaaaaaaaaaaaaaaaa

SEQ ID NO: 662 - DNA, 2010 bp, Homo sapiens
  ref <308>: DATABASE ACCESSION NUMBER: NM_001762
  ref <309>: DATABASE ENTRY DATE: 2001-06-18
cgagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgctcgtttctggcgctggagacatcaaacttactaaagacggcaatgtgctgcttcacgaaatgcaaattcaacacccaacagcttccttaatagcaaaggtagcaacagcccaggatgatataactggtgatggtacgacttctaatgtcctaatcattggagagctgctgaaacaggcggatctctacatttctgaaggccttcatcctagaataatcactgaaggatttgaagctgcaaaggaaaaggcccttcagtttttggaagaagtcaaagtaagcagagagatggacagggaaacacttatagatgtggccagaacatctcttcgtactaaagttcatgctgaacttgcagatgtcttaacagaggctgtagtggactccattttggccattaaaaagcaagatgaacctattgatctcttcatgattgagatcatggagatgaaacataaatctgaaactgatacaagcttaatcagagggcttgttttggaccacggagcacggcatcctgatatgaagaaaagggtggaggatgcatacatcctcacttgtaacgtgtcattagagtatgagaaaacagaagtgaattctggctttttttacaagagtgcagaagagagagaaaaactcgtgaaagctgaaagaaaattcattgaagatagggttaaaaaaataatagaactgaaaaggaaagtctgtggcgattcagataaaggatttgttgttattaatcaaaagggaattgaccccttttccttagatgctctttcaaaagaaggcatagtcgctctgcgcagagctaaaaggagaaatatggagaggctgactcttgcttgtggtggggtagccctgaattcttttgacgacctaagtcctgactgcttgggacatgcaggacttgtatatgagtatacattgggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggctgtgtggttccaggtgctggtgccgtggaagtggcaatggcagaagccctgattaaacataagcccagtgtaaagggcagggcacagcttggagtccaagcatttgctgatgcattgctcattattcccaaggttcttgctcagaactctggttttgaccttcaggaaacattagttaaaattcaagcagaacattcagaatcaggtcagcttgtgggtgtggacctgaacacaggtgagccaatggtggcagcagaagtaggcgtatgggataactattgtgtaaagaaacagcttcttcactcctgcactgtgattgccaccaacattctcttggttgatgagatcatgcgagctggaatgtcttctctgaaaggttgaattgaagcttcctctgtatctgaatcttgaagactgcaaagtgatcctgaggattacagctgtggaatttttgtccaagcttcaaataattttgaaagaaattttcccatatgaaaaaaggagagaacactggcatctgttgaaatttggaagttctgaaattatagtatttttaaaaattgcactgaagtgtatacacataaagcaggtcttttatccagtgaacaggatgttttgctttagcagcagtgacataaaattccatgttagataagcatatgttacttaccttgttattaaatatttcttgaaaagcaggccacgaagg

SEQ ID NO: 663 - DNA, 1504 bp, Homo sapiens
  ref <308>: DATABASE ACCESSION NUMBER: NM_001767
  ref <309>: DATABASE ENTRY DATE: 2001-06-18
cctaagatgagctttccatgtaaatttgtagccagcttccttctgattttcaatgtttcttccaaaggtgcagtctccaaagagattacgaatgccttggaaacctggggtgccttgggtcaggacatcaacttggacattcctagttttcaaatgagtgatgatattgacgatataaaatgggaaaaaacttcagacaagaaaaagattgcacaattcagaaaagagaaagagactttcaaggaaaaagatacatataagctatttaaaaatggaactctgaaaattaagcatctgaagaccgatgatcaggatatctacaaggtatcaatatatgatacaaaaggaaaaaatgtgttggaaaaaatatttgatttgaagattcaagagagggtctcaaaaccaaagatctcctggacttgtatcaacacaaccctgacctgtgaggtaatgaatggaactgaccccgaattaaacctgtatcaagatgggaaacatctaaaactttctcagagggtcatcacacacaagtggaccaccagcctgagtgcaaaattcaagtgcacagcagggaacaaagtcagcaaggaatccagtgtcgagcctgtcagctgtccagagaaaggtctggacatctatctcatcattggcatatgtggaggaggcagcctcttgatggtctttgtggcactgctcgttttctatatcaccaaaaggaaaaaacagaggagtcggagaaatgatgaggagctggagacaagagcccacagagtagctactgaagaaaggggccggaagccccaacaaattccagcttcaacccctcagaatccagcaacttcccaacatcctcctccaccacctggtcatcgttcccaggcacctagtcatcgtcccccgcctcctggacaccgtgttcagcaccagcctcagaagaggcctcctgctccgtcgggcacacaagttcaccagcagaaaggcccgcccctccccagacctcgagttcagccaaaacctccccatggggcagcagaaaactcattgtccccttcctctaattaaaaaagatagaaactgtctttttcaataaaaagcactgtggatttctgccctcctgatgtgcatatccgtacttccatgaggtgttttctgtgtgcagaacattgtcacctcctgaggctgtgggccacagccacctctgcatcttcgaactcagccatgtggtcaacatctggagtttttggtctcctcagagagctccatcacaccagtaaggagaagcaatataagtgtgattgcaagaatggtagaggaccgagcacagaaatcttagagatttcttgtcccctctcaggtcatgtgtagatgcgataaatcaagtgattggtgtgcctgggtctcactacaagcagcctatctgcttaagagactctggagtttcttatgtgccctggtggacacttgcccaccatcctgtgagtaaaagtgaaataaaagctttgac

SEQ ID NO: 664 - DNA, 1922 bp, Homo sapiens
  ref <308>: DATABASE ACCESSION NUMBER: NM_001770
  ref <309>: DATABASE ENTRY DATE: 2001-06-18
ggagagtctgaccaccatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtgtcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgactgaccccaccaggagattcttcaaagtgacgcctcccccaggaagcgggccccagaaccagtacgggaacgtgctgtctctccccacacccacctcaggcctcggacgcgcccagcgttgggccgcaggcctggggggcactgccccgtcttatggaaacccgagcagcgacgtccaggcggatggagccttggggtcccggagccgccgggagtgggcccagaagaagaggaaggggagggctatgaggaacctgacagtgaggaggactccgagttctatgagaacgactccaaccttgggcaggaccagctctcccaggatggcagcggctacgagaaccctgaggatgagcccctgggtcctgaggatgaagactccttctccaacgctgagtcttatgagaacgaggatgaagagctgacccagccggtcgccaggacaatggacttcctgagccctcatgggtcagcctgggaccccagccgggaagcaacctccctggggtcccagtcctatgaggatatgagaggaatcctgtatgcagccccccagctccgctccattcggggccagcctggacccaatcatgaggaagatgcagactcttatgagaacatggataatcccgatgggccagacccagcctggggaggagggggccgcatgggcacctggagcaccaggtgatcctcaggtggccagcctggatctcctcaagtccccaagattcacacctgactctgaaatctgaagacctcgagcagatgatgccaacctctggagcaatgttgcttaggatgtgtgcatgtgtgtaagtgtgtgtgtgtgtgtgtgtgtgtgtgtgtgtgtatacatgccagtgacacttccagtcccctttgtattccttaaataaactcaatgagctcttccaaaaaaaaaaa

SEQ ID NO: 665 - DNA, 1285 bp, Homo sapiens
  ref <308>: DATABASE ACCESSION NUMBER: NM_001777
  ref <309>: DATABASE ENTRY DATE: 2001-06-18
gggctgcctgtgacgcgcggcgcggtcggtcctgcctgtaacggcggcggcggctgctgctccagacacctgcggcggcggcggcgaccccgcggcgggcgcggagatgtggcccctggtagcggcgctgttgctgggctcggcgtgctgcggatcagctcagctactatttaataaaacaaaatctgtagaattcacgttttgtaatgacactgtcgtcattccatgctttgttactaatatggaggcacaaaacactactgaagtatacgtaaagtggaaatttaaaggaagagatatttacacctttgatggagctctaaacaagtccactgtccccactgactttagtagtgcaaaaattgaagtctcacaattactaaaaggagatgcctctttgaagatggataagagtgatgctgtctcacacacaggaaactacacttgtgaagtaacagaattaaccagagaaggtgaaacgatcatcgagctaaaatatcgtgttgtttcatggttttctccaaatgaaaatattcttattgttattttcccaatttttgctatactcctgttctggggacagtttggtattaaaacacttaaatatagatccggtggtatggatgagaaaacaattgctttacttgttgctggactagtgatcactgtcattgtcattgttggagccattcttttcgtcccaggtgaatattcattaaagaatgctactggccttggtttaattgtgacttctacagggatattaatattacttcactactatgtgtttagtacagcgattggattaacctccttcgtcattgccatattggttattcaggtgatagcctatatcctcgctgtggttggactgagtctctgtattgcggcgtgtataccaatgcatggccctcttctgatttcaggtttgagtatcttagctctagcacaattacttggactagtttatatgaaatttgtggcttccaatcagaagactatacaacctcctaggaaagctgtagaggaaccccttaatgcattcaaagaatcaaaaggaatgatgaatgatgaataactgaagtgaagtgatggactccgatttggagagtagtaagacgtgaaaggaatacacttctgtttaagcaccatggccttgatgattcactgttggggagaagaaacaagaaaagtaactggttgtcacctatgagacccttacgtgattgttagttaagtttttattcaaagcagctgtaatttagttaataaaataattatgatc

SEQ ID NO: 666 - DNA, 933 bp, Homo sapiens
  ref <308>: DATABASE ACCESSION NUMBER: NM_001778
  ref <309>: DATABASE ENTRY DATE: 2001-06-18
aactgtctcctgcgttgctgggaagttctggaaagcatgtgctccagaggttgggattcgtgtctggctctggaattgctactgctgcctctgtcactcctggtgaccagcattcaaggtcacttggtacatatgaccgtggtctccggcagcaacgtgactctgaacatctctgagagcctgcctgagaactacaaacaactaacctggttttatactttcgaccagaagaatgtagaatgggattccagaaaatctaagtactttgaatccaaatttaaaggcagggtcagacttgatcctcagagtggcgcactgtacatctctaaggtccagaaagaggacaacagcacctacatcatgagggtgttgaaaaagactgggaatgagcaagaatggaagatcaagctgcaagtgcttgaccctgtacccaagcctgtcatcaaaattgagaagatagaagacatggatgacaactgttatctgaaactgtcatgtgtgatacctggcgagtctgtaaactacacctggtatggggacaaaaggcccttcccaaaggagctccagaacagtgtgcttgaaaccacccttatgccacataattactccaggtgttatacttgccaagtcagcaattctgtgagcagcaagaatggcacggtctgcctcagtccaccctgtaccctggcccggtcctttggagtagaatggattgcaagttggctagtggtcacggtgcccaccattcttggcctgttacttacctgagatgagctcttttaactcaagcgaaacttcaaggccagaagatcttgcctgttggtgatcatgctcctcagcaggacagagactgtataggctgaccagaagcatgctgctgaattatcaacgaggattttcaagttaacttttaaatactggttattatttaat

SEQ ID NO: 667 - DNA, 1702 bp, Homo sapiens
  ref <308>: DATABASE ACCESSION NUMBER: NM_001781
  ref <309>: DATABASE ENTRY DATE: 2001-06-18
agactcaacaagagctccagcaaagactttcactgtagcttgacttgacctgagattaactagggaatcttgagaataaagatgagctctgaaaattgtttcgtagcagagaacagctctttgcatccggagagtggacaagaaaatgatgccaccagtccccatttctcaacacgtcatgaagggtccttccaagttcctgtcctgtgtgctgtaatgaatgtggtcttcatcaccattttaatcatagctctcattgccttatcagtgggccaatacaattgtccaggccaatacacattctcaatgccatcagacagccatgtttcttcatgctctgaggactgggttggctaccagaggaaatgctactttatttctactgtgaagaggagctggacttcagcccaaaatgcttgttctgaacatggtgctactcttgctgtcattgattctgaaaaggacatgaactttctaaaacgatacgcaggtagagaggaacactgggttggactgaaaaaggaacctggtcacccatggaagtggtcaaatggcaaagaatttaacaactggttcaacgttacagggtctgacaagtgtgtttttctgaaaaacacagaggtcagcagcatggaatgtgagaagaatttatactggatatgtaacaaaccttacaaataataaggaaacatgttcacttattgactattatagaatggaactcaaggaaatctgtgtcagtggatgctgctctgtggtccgaagtcttccatagagactttgtgaaaaaaaattttatagtgtcttgggaattttcttccaaacagaactatggaaaaaaaggaagaaattccaggaaaatctgcactgtgggcttttattgccatgagctagaagcatcacaggttgaccaataaccatgcccaagaatgagaagaatgactatgcaacctttggatgcactttatattattttgaatccagaaataatgaaataactaggcgtggacttactatttattgctgaatgactaccaacagtgagagcccttcatgcatttgcactactggaaggagttagatgttggtactagatactgaatgtaaacaaaggaattatggctggtaacataggtttttagtctaattgaatcccttaaactcagggagcatttataaatggacaaatgcttatgaaactaagatttgtaatatttctctctttttagagaaatttgccaatttactttgttatttttccccaaaaagaatgggatgatcgtgtatttatttttttacttcctcagctgtagacaggtccttttcgatggtacatatttctttgcctttataatcttttatacagtgtcttacagagaaaagacataagcaaagactatgaggaatatttgcaagacatagaatagtgttggaaaatgtgcaatatgtgatgtggcaaatctctattaggaaatattctgtaatcttcagacctagaataatactagtcttataataggtttgtgactttcctaaatcaattctattacgtgcaatacttcaatacttcatttaaaatatttttatgtgcaataaaatgtatttgtttgtattttgtgttcagtacaattataagctgtttttatatatgtgaaataaaagtagaataaacacaaaaaaaaaaaaaaaaaaaaaaaaaaaa

SEQ ID NO: 668 - DNA, 1050 bp, Homo sapiens
  ref <308>: DATABASE ACCESSION NUMBER: NM_001786
  ref <309>: DATABASE ENTRY DATE: 2001-06-18
ggggggggggggcacttggcttcaaagctggctcttggaaattgagcggagacgagcggcttgttgtagctgccgtgcggccgccgcggaataataagccgggatctaccataccattgactaactatggaagattataccaaaatagagaaaattggagaaggtacctatggagttgtgtataagggtagacacaaaactacaggtcaagtggtagccatgaaaaaaatcagactagaaagtgaagaggaaggggttcctagtactgcaattcgggaaatttctctattaaaggaacttcgtcatccaaatatagtcagtcttcaggatgtgcttatgcaggattccaggttatatctcatctttgagtttctttccatggatctgaagaaatacttggattctatccctcctggtcagtacatggattcttcacttgttaagagttatttataccaaatcctacaggggattgtgttttgtcactctagaagagttcttcacagagacttaaaacctcaaaatctcttgattgatgacaaaggaacaattaaactggctgattttggccttgccagagcttttggaatacctatcagagtatatacacatgaggtagtaacactctggtacagatctccagaagtattgctggggtcagctcgttactcaactccagttgacatttggagtataggcaccatatttgctgaactagcaactaagaaaccacttttccatggggattcagaaattgatcaactcttcaggattttcagagctttgggcactcccaataatgaagtgtggccagaagtggaatctttacaggactataagaatacatttcccaaatggaaaccaggaagcctagcatcccatgtcaaaaacttggatgaaaatggcttggatttgctctcgaaaatgttaatctatgatccagccaaacgaatttctggcaaaatggcactgaatcatccatattttaatgatttggacaatcagattaagaagatgtagctttctgacaaaaagtttccatatgttatg

SEQ ID NO: 669 - DNA, 3171 bp, Homo sapiens
  ref <308>: DATABASE ACCESSION NUMBER: NM_001793
  ref <309>: DATABASE ENTRY DATE: 2001-06-18
gcggaacaccggcccgccgtcgcggcagctgcttcacccctctctctgcagccatggggctccctcgtggacctctcgcgtctctcctccttctccaggtttgctggctgcagtgcgcggcctccgagccgtgccgggcggtcttcagggaggctgaagtgaccttggaggcgggaggcgcggagcaggagcccggccaggcgctggggaaagtattcatgggctgccctgggcaagagccagctctgtttagcactgataatgatgacttcactgtgcggaatggcgagacagtccaggaaagaaggtcactgaaggaaaggaatccattgaagatcttcccatccaaacgtatcttacgaagacacaagagagattgggtggttgctccaatatctgtccctgaaaatggcaagggtcccttcccccagagactgaatcagctcaagtctaataaagatagagacaccaagattttctacagcatcacggggccgggggcagacagcccccctgagggtgtcttcgctgtagagaaggagacaggctggttgttgttgaataagccactggaccgggaggagattgccaagtatgagctctttggccacgctgtgtcagagaatggtgcctcagtggaggaccccatgaacatctccatcatcgtgaccgaccagaatgaccacaagcccaagtttacccaggacaccttccgagggagtgtcttagagggagtcctaccaggtacttctgtgatgcaggtgacagccacagatgaggatgatgccatctacacctacaatggggtggttgcttactccatccatagccaagaaccaaaggacccacacgacctcatgttcacaattcaccggagcacaggcaccatcagcgtcatctccagtggcctggaccgggaaaaagtccctgagtacacactgaccatccaggccacagacatggatggggacggctccaccaccacggcagtggcagtagtggagatccttgatgccaatgacaatgctcccatgtttgacccccagaagtacgaggcccatgtgcctgagaatgcagtgggccatgaggtgcagaggctgacggtcactgatctggacgcccccaactcaccagcgtggcgtgccacctaccttatcatgggcggtgacgacggggaccattttaccatcaccacccaccctgagagcaaccagggcatcctgacaaccaggaagggtttggattttgaggccaaaaaccagcacaccctgtacgttgaagtgaccaacgaggccccttttgtgctgaagctcccaacctccacagccaccatagtggtccacgtggaggatgtgaatgaggcacctgtgtttgtcccaccctccaaagtcgttgaggtccaggagggcatccccactggggagcctgtgtgtgtctacactgcagaagaccctgacaaggagaatcaaaagatcagctaccgcatcctgagagacccagcagggtggctagccatggacccagacagtgggcaggtcacagctgtgggcaccctcgaccgtgaggatgagcagtttgtgaggaacaacatctatgaagtcatggtcttggccatggacaatggaagccctcccaccactggcacgggaacccttctgctaacactgattgatgtcaacgaccatggcccagtccctgagccccgtcagatcaccatctgcaaccaaagccctgtgcgccacgtgctgaacatcacggacaaggacctgtctccccacacctcccctttccaggcccagctcacagatgactcagacatctactggacggcagaggtcaacgaggaaggtgacacagtggtcttgtccctgaagaagttcctgaagcaggatacatatgacgtgcacctttctctgtctgaccatggcaacaaagagcagctgacggtgatcagggccactgtgtgcgactgccatggccatgtcgaaacctgccctggaccctggaaaggaggtttcatcctccctgtgctgggggctgtcctggctctgctgttcctcctgctggtgctgcttttgttggtgagaaagaagcggaagatcaaggagcccctcctactcccagaagatgacacccgtgacaacgtcttctactatggcgaagaggggggtggcgaagaggaccaggactatgacatcacccagctccaccgaggtctggaggccaggccggaggtggttctccgcaatgacgtggcaccaaccatcatcccgacacccatgtaccgtcctaggccagccaacccagatgaaatcggcaactttataattgagaacctgaaggcggctaacacagaccccacagccccgccctacgacaccctcttggtgttcgactatgagggcagcggctccgacgccgcgtccctgagctccctcacctcctccgcctccgaccaagaccaagattacgattatctgaacgagtggggcagccgcttcaagaagctggcagacatgtacggtggcggggaggacgactaggcggcctgcctgcagggctggggaccaaacgtcaggccacagagcatctccaaggggtctcagttcccccttcagctgaggacttcggagcttgtcaggaagtggccgtagcaacttggcggagacaggctatgagtctgacgttagagtggttgcttccttagcctttcaggatggaggaatgtgggcagtttgacttcagcactgaaaacctctccacctgggccagggttgcctcagaggccaagtttccagaagcctcttacctgccgtaaaatgctcaaccctgtgtcctgggcctgggcctgctgtgactgacctacagtggactttctctctggaatggaaccttcttaggcctcctggtgcaacttaatttttttttttaatgctatcttcaaaacgttagagaaagttcttcaaaagtgcagcccagagctgctgggcccactggccgtcctgcatttctggtttccagaccccaatgcctcccattcggatggatctctgcgtttttatactgagtgtgcctaggttgccccttattttttattttccctgttgcgttgctatagatgaagggtgaggacaatcgtgtatatgtactagaacttttttattaaagaaa

SEQ ID NO: 670 - DNA, 2625 bp, Homo sapiens
  ref <308>: DATABASE ACCESSION NUMBER: NM_001797
  ref <309>: DATABASE ENTRY DATE: 2001-06-18
cggcagccctgacgtgatgagctcaaccagcagagacattccatcccaagagaggtctgcgtgacgcgtccgggaggccaccctcagcaagaccaccgtacagttggtggaaggggtgacagctgcattctcctgtgcctaccacgtaaccaaaaatgaaggagaactactgtttacaagccgccctggtgtgcctgggcatgctgtgccacagccatgcctttgccccagagcggcgggggcacctgcggccctccttccatgggcaccatgagaagggcaaggaggggcaggtgctacagcgctccaagcgtggctgggtctggaaccagttcttcgtgatagaggagtacaccgggcctgaccccgtgcttgtgggcaggcttcattcagatattgactctggtgatgggaacattaaatacattctctcaggggaaggagctggaaccatttttgtgattgatgacaaatcagggaacattcatgccaccaagacgttggatcgagaagagagagcccagtacacgttgatggctcaggcggtggacagggacaccaatcggccactggagccaccgtcggaattcattgtcaaggtccaggacattaatgacaaccctccggagttcctgcacgagacctatcatgccaacgtgcctgagaggtccaatgtgggaacgtcagtaatccaggtgacagcttcagatgcagatgaccccacttatggaaatagcgccaagttagtgtacagtatcctcgaaggacaaccctatttttcggtggaagcacagacaggtatcatcagaacagccctacccaacatggacagggaggccaaggaggagtaccacgtggtgatccaggccaaggacatgggtggacatatgggcggactctcagggacaaccaaagtgacgatcacactgaccgatgtcaatgacaacccaccaaagtttccgcagaggctataccagatgtctgtgtcagaagcagccgtccctggggaggaagtaggaagagtgaaagctaaagatccagacattggagaaaatggcttagtcacatacaatattgttgatggagatggtatggaatcgtttgaaatcacaacggactatgaaacacaggagggggtgataaagctgaaaaagcctgtagattttgaaaccgaaagagcctatagcttgaaggtagaggcagccaacgtgcacatcgacccgaagtttatcagcaatggccctttcaaggacactgtgaccgtcaagatctcagtagaagatgctgatgagccccctatgttcttggccccaagttacatccacgaagtccaagaaaatgcagctgctggcaccgtggttgggagagtgcatgccaaagaccctgatgctgccaacagcccgataaggtattccatcgatcgtcacactgacctcgacagatttttcactattaatccagaggatggttttattaaaactacaaaacctctggatagagaggaaacagcctggctcaacatcactgtctttgcagcagaaatccacaatcggcatcaggaagcccaagtcccagtggccattagggtccttgatgtcaacgataatgctcccaagtttgctgccccttatgaaggtttcatctgtgagagtgatcagaccaagccactttccaaccagccaattgttacaattagtgcagatgacaaggatgacacggccaatggaccaagatttatcttcagcctaccccctgaaatcattcacaatccaaatttcacagtcagagacaaccgagataacacagcaggcgtgtacgcccggcgtggagggttcagtcggcagaagcaggacttgtaccttctgcccatagtgatcagcgatggcggcatcccgcccatgagtagcaccaacaccctcaccatcaaagtctgcgggtgcgacgtgaacggggcactgctctcctgcaacgcagaggcctacattctgaacgccggcctgagcacaggcgccctgatcgccatcctcgcctgcatcgtcattctcctggtcattgtagtattgtttgtgaccctgagaaggcaaaagaaagaaccactcattgtctttgaggaagaagatgtccgtgagaacatcattacttatgatgatgaagggggtggggaagaagacacagaagcctttgatattgccaccctccagaatcctgatggtatcaatggatttatcccccgcaaagacatcaaacctgagtatcagtacatgcctagacctgggctccggccagcgcccaacagcgtggatgtcgatgacttcatcaacacgagaatacaggaggcagacaatgaccccacggctcctccttatgactccattcaaatctacggttatgaaggcaggggctcagtggccgggtccctgagctccctagagtcggccaccacagattcagacttggactatgattatctacagaactggggacctcgttttaagaaactagcagatttgtatggttccaaagacacttttgatgacgattcttaacaataacgatacaaatttggccttaagaactgtgtctggcgttctcaagaatctagaagatgtgtaacaggtatttttt

SEQ ID NO: 671 - DNA, 430 bp, Homo sapiens
  ref <308>: DATABASE ACCESSION NUMBER: NM_001803
  ref <309>: DATABASE ENTRY DATE: 2001-06-18
gacagccacgaagatcctaccaaaatgaagcgcttcctcttcctcctactcaccatcagcctcctggttatggtacagatacaaactggactctcaggacaaaacgacaccagccaaaccagcagcccctcagcatccagcagcatgagcggaggcattttccttttcttcgtggccaatgccataatccacctcttctgcttcagttgaggtgacacgtctcagccttagccctgtgccccctgaaacagctgccaccatcactcgcaagagaatcccctccatctttgggaggggttgatgccagacatcaccaggttgtagaagttgacaggcagtgccatgggggcaacagccaaaataggggggtaatgatgtaggggccaagcagtgcccagctgggggagaataaagttacccttgtactgca

SEQ ID NO: 672 - DNA, 1001 bp, Homo sapiens
  ref <308>: DATABASE ACCESSION NUMBER: NM_001806
  ref <309>: DATABASE ENTRY DATE: 2001-06-18
gccgcggctgcggaacgggcggaggctgccggtttcgtaaccgtcgctcctcctcgctgactcgcgggctgtgaggcctgggtcggctcgggccgcaccgcgcggggccgctcggagtggaggccgcctgggggcaggcgggctagaggagcaggtacatgtgaagattttttggcagcttagcgtggaaaccattgatcaccctgctctcatttctacctgttctgtgttggcaagggagagtgcccaaatgagcaagatatcgcagcaaaacagcactccaggggtgaacggaattagtgttatccatacccaggcacatgccagcggcttacagcaggttcctcagctggtgcctgctggccctgggggaggaggcaaagctgtggctcccagcaagcagagcaaaaagagttcgcccatggatcgaaacagtgacgagtatcggcaacgccgagagaggaacaacatggctgtgaaaaagagccggttgaaaagcaagcagaaagcacaagacacactgcagagagtcaatcagctcaaagaagagaatgaacggttggaagcaaaaatcaaattgctgaccaaggaattaagtgtactcaaagatttgtttcttgagcatgcacacaaccttgcagacaacgtacagtccattagcactgaaaatacgacagcagatggcgacaatgcaggacagtagacctcaccctttccagactttagagcttgtggcttgaatgttaaaggtgtgaccaccgacaccactcatgtcaatggctgaaagttgtccatttccatgactcaaagacccattggaggctattttctgggatcagcactgaagagttgattagctaaaaatgttagccttgtaattcgaatatctggttttaaatgatagaggtttttgtgggaatcaaaatcccccaaatgttaaggtatatggtaaaaaaagaaatatctgggatcccgatgttcttaataaatcctgacttccc

SEQ ID NO: 673 - DNA, 1389 bp, Homo sapiens
  ref <308>: DATABASE ACCESSION NUMBER: NM_001809
  ref <309>: DATABASE ENTRY DATE: 2001-06-18
cgcggacttctgccaagcaccggctcatgtgaggctcgcggcacagcgttctctgggctccccagaagccagcctttcgctcccggacccggcagcccgagcaggagccgtgggaccgggcgccagcaccctctgcggcgtgtcatgggcccgcgccgccggagccgaaagcccgaggccccgaggaggcgcagcccgagcccgaccccgacccccggcccctcccggcggggcccctccttaggcgcttcctcccatcaacacagtcggcggagacaaggttggctaaaggagatccgaaagcttcagaagagcacacacctcttgataaggaagctgcccttcagccgcctggcaagagaaatatgtgttaaattcactcgtggtgtggacttcaattggcaagcccaggccctattggccctacaagaggcagcagaagcatttctagttcatctctttgaggacgcctatctcctcaccttacatgcaggccgagttactctcttcccaaaggatgtgcaactggcccggaggatccggggccttgaggagggactcggctgagctcctgcacccagtgtttctgtcagtctttcctgctcagccaggggggatgataccggggactctccagagccatgactagatccaatggattctgcgatgctgtctggactttgctgtctctgaacagtatgtgtgtgttgctttaaatatttttcttttttttgagaaggagaagactgcatgactttcctctgtaacagaggtaatatatgagacaatcaacaccgttccaaaggcctgaaaataattttcagataaagagactccaaggttgactttagtttgtgagttactcatgtgactatttgaggattttgaaaacatcagatttgctgtggtatgggagaaaaggttatgtacttattattttagctctttctgtaatatttacattttttaccatatgtacatttgtacttttattttacacataagggaaaaaataagaccactttgagcagttgcctggaaggctgggcatttccatcatatagacctctgcccttcagagtagcctcaccattagtggcagcatcatgtaactgagtggactgtgcttgtcaacggatgtgtagcttttcagaaacttaattggggatgaatagaaaacctgtaagctttgatgttctggttacttctagtaaattcctgtcaaaatcaattcagaaattctaacttggagaatttaacattttactcttgtaaatcatagaagatgtatcataacagttcagaattttaaagtacattttcgatgcttttatgggtatttttgtagtttctttgtagagagataataaaaatcaaaatatttaatga

SEQ ID NO: 674 - DNA, 1838 bp, Homo sapiens
  ref <308>: DATABASE ACCESSION NUMBER: NM_001814
  ref <309>: DATABASE ENTRY DATE: 2001-06-18
aattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaagtataaagaagagggcagcaaggtgaccacttactgcaacgagacaatgactgggtgggtgcatgatgtgttgggccggaactgggcttgtttcaccggaaagaaggtgggaactgcctctgagaatgtgtatgtcaacacagcacaccttaagaattctcaggaaaagtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggcccaaacctgcaccactgactgctgaaatacagcaaaagattttgcatttgccaacatcttgggactggagaaatgttcatggtatcaattttgtcagtcctgttcgaaaccaagcatcctgtggcagctgctactcatttgcttctatgggtatgctagaagcgagaatccgtatactaaccaacaattctcagaccccaatcctaagccctcaggaggttgtgtcttgtagccagtatgctcaaggctgtgaaggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaacatgctatattttttaaaatcaatgtgaaaacatagacttatttttaaattgtaccaatcacaagaaaataatggcaataattatcaaaacttttaaaatagatgctcatatttttaaaataaagttttaaaaataactgc

SEQ ID NO: 675 - DNA, 717 bp, Homo sapiens
  ref <308>: DATABASE ACCESSION NUMBER: NM_001826
  ref <309>: DATABASE ENTRY DATE: 2001-06-18
agagcgatcatgtcgcacaaacaaatttactattcggacaaatacgacgacgaggagtttgagtatcgacatgtcatgctgcccaaggacatagccaagctggtccctaaaacccatctgatgtctgaatctgaatggaggaatcttggcgttcagcagagtcagggatgggtccattatatgatccatgaaccagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttctgccgggtgttgtatgtgtggtgacttgcggatttatgtttcagtgtactggaaactttccattttattcaagaaatctgttcatgttaaaagccttgattaaagaggaagtttttataat

SEQ ID NO: 676 - DNA, 627 bp, Homo sapiens
  ref <308>: DATABASE ACCESSION NUMBER: NM_001827
  ref <309>: DATABASE ENTRY DATE: 2001-06-18
agtctccggcgagttgttgcctgggctggacgtggttttgtctgctgcgcccgctcttcgcgctctcgtttcattttctgcagcgcgccacgaggatggcccacaagcagatctactactcggacaagtacttcgacgaacactacgagtaccggcatgttatgttacccagagaactttccaaacaagtacctaaaactcatctgatgtctgaagaggagtggaggagacttggtgtccaacagagtctaggctgggttcattacatgattcatgagccagaaccacatattcttctctttagacgacctcttccaaaagatcaacaaaaatgaagtttatctggggatcgtcaaatctttttcaaatttaatgtatatgtgtatataaggtagtattcagtgaatacttgagaaatgtacaaatctttcatccatacctgtgcatgagctgtattcttcacagcaacagagctcagttaaatgcaactgcaagtaggttactgtaagatgtttaagataaaagttcttccagtcagtttttctcttaagtgcctgtttgagtttactgaaacagtttacttttgttcaataaagtttgtatgttgcatttaaaaaaaaaaaaaaa

SEQ ID NO: 677 - DNA, 4562 bp, Homo sapiens
  ref <308>: DATABASE ACCESSION NUMBER: NM_001830
  ref <309>: DATABASE ENTRY DATE: 2001-06-18
ccgagaggcaaatgagcttgtcagtttctgcctccattagaccctcaacccaaaggagcaggagatttcggtagcgttttaactttatctcagaatctgaaagcggaaggccaggcaagctgcacacatcaagcgaaacgcctgaggggcggccagcgcgagggtttctggccatcgaccctcacctcccgggacttccagggtcttccccccaccccgcgcacacctccctgcctcgccccgagggcgtcacgtggcagcgtggggcccgcctcctggtgatgtcacggcgctcgcagccgtcgcgctgaagaaaggatgctcgaggatgctgtccaggtgggcggccgcgggcgcgatgcggcactgcaggtgtaattagcatggtcaatgcgggagcgatgagtggctctggaaacctgatggatttcctcgatgagccgttccctgatgtggggacgtatgaggacttccacaccatcgactggctaagggaaaagtcacgggacaccgacagacacaggaagatcaccagcaagagcaaggagtccatatgggagttcatcaagagcctgctggatgcctggtcgggatgggtggtgatgctgctcatcggcctgctggcgggcaccttggctggggtcatcgatctcgccgtggactggatgacggacctgaaggagggggtctgcctgtctgccttctggtatagccatgagcagtgttgctggacttctaacgagaccacttttgaggacagagacaagtgtcccctgtggcagaaatggtcggagctgctggtgaatcagtcagagggtgccagtgcttacattctgaattacttaatgtacatcctatgggcgctgctgtttgcatttttggctgtctccctggtgcgtgtatttgcaccatatcgctgtggctctggcataccagagataaagaccattttgagcggctttatcatcaggggctacttggggaagtggaccctgctaatcaagacagtcacgctggtgctggtagtgtcctccggtctgagccttgggaaggaagggccgctagtgcacgtggcttgttgctgtggcaacttcttcagcagccttttctccaagtacagcaagaatgagggcaagaggcgggaggtgctttcagctgcagcggctgctggagtctctgttgcctttggtgcaccaattggaggcgtgcttttcagtctagaagaggtcagttactactttcccctgaagaccttgtggaggtcatttttcgcagccctggtggcggcctttacgctgagatccatcaatccctttgggaatagccgtctcgttctcttttatgtggaataccacacgccctggtacatggctgaactcttccccttcatcctgcttggggtcttcgggggcttgtggggaaccctcttcatccgctgcaacatcgcctggtgcaggaggcgcaagaccaccaggctggggaagtacccggtgctggaggtcattgtggtgactgccatcactgccatcattgcctaccccaatccctacacacgccagagcaccagcgagctcatttctgagctgttcaatgactgtggagcccttgagtcttcccagctctgtgactacatcaatgaccccaacatgactcggcctgtggatgacattccagaccggccggctggtgtcggtgtttacacggccatgtggcagctggccctggcactgatcttcaaaatcgtcgttaccatatttacctttggcatgaagatcccgtcgggcctcttcatccccagcatggctgtgggcgcgatagcgggcaggatggtgggaattggcgtggagcagctggcctaccatcaccatgactggtactacttcaggaactggtgcagacccggtgcagactgtgtcacgccagggctgtacgcaatggtgggagctgcggcctgcctcggtggagttaccaggatgacggtgtcattggtggtcatcatgtttgaattaaccgggggtctggagtacatcgtgcccctgatggcggcggctgtgaccagcaagtgggtagctgatgcatttgggaaagaaggcatctacgaggcccacatccacttaaatgggtaccctttccttgacgtgaaggacgagtttactcaccgcacactggccaccgacgtcatgcggccccggcggggagagccgccactgtcggtgctcacccaggacagcatgactgtcgaggacgtggagacgctcatcaaggagaccgactacaacggcttccccgtggtggtctccagagactccgagcgcctcattggatttgcccagaggagggaactgattctcgcaataaataacgccagacagaggcaggagggcattgtgagcaattccatcatgtacttcacggaggaaccccccgagctgccggccaacagcccacatcccctgaagctgcggcgcatcctgaacctcagcccgtttacagtgacagaccacactccgatggaaacggtggtggatatcttccggaaactggggcttcggcagtgcctggtgacgcggagcgggagacttcttggcatcatcacaaaaaaggatgttctgagacatatggcccagatggcaaaccaggaccccgaatccatcatgtttaattagcaacaaggtggcaattattttcagaaaaacactgactgtgtcatttaaaaagaaataaatgatatgttattatcccaatgaaagatcatgcattggggacagcagaaacaaaagcttttttggaaaggcggggaagaaggatgaaacctttaaaaacaaaaacaaaaacatcaatgagtaggcattttatagctttaaccccgtatgagtttcaagctgtgtttcctaatgagtttgctactgctgtgggggcatgtgggtgggtaaatgatgtaaatgatgtgatctgtacaagtatgtggagcatgaatgctgactcaagaaacttttactccttctgctcaaggctgatgtttgtaacttatgaacacacgtgaagtgttgagtccaaaagacaaaggggcatcggcatgtcagcgtccttatttattggttcttgaagttttgctgctatgttactgaatcatactaaagacatttgcgcttactttgttgaaaaagaaaaagaaattaaatttgaacacagtgaaagctgcaagtatgccagtgggtccgctcacgaccgtcctgtttcttgctcctgttctcagcctgttatctggcttatccatcagtttctgaaccaacatcaggggcacctgccatgatgagtgtgaagaaatcatttctctatgcaagactggcatcctgggactgcacgatgaactattggagcatacagtactgcggtgtgtctcctcccatacaaagggacacatccttattttgagggtatactcacccgatcattgatttgcatccccatggcatttgcttcatttatttattgcttttgcccatgcattcaatattgatcagctcagcacttccatgggccatagccggtatgcccccagcctgccataagcgtgctttcattttcaagtagcatatgcaagagtccaaacaggctacccaatgttactacttatttttcctctcaggtcttatcagatacggctgtggagaggatgaggcatatgcgttgtcagttggaatccctccaaatggattgcaagagaaatactaaattgattctaaatctgttccattatcttctctgtaggatgcaaaacatccagttgtaatgtataagcatgcacttcatactagcaatcacagcacaggaggacagcattaaattttatatagccaatttgggcactgggcatctttgtatttgaacttaacgacacatttactcttttagtcaggatttcggtcttttctgcgggaaggaattaagctatgtattaggtccaccatacgatctgtgtaagtaagattatcccacttgccctttctctttagtctttgtcccttccttttcactaagtgcccctcatccttttcaatctcattgtcactggatagtgctgtatcacttaggtgtgcattcggctgcaaataacagaaaacccagcaaacactgaagggctggataagaaccctgagagggggtactccaggactgtctccataacatcattgggatccccatcccgttgctatttctttttcaccgtttttaccttttgtcctctggcttattgcctcagagttgcaagatggttcctgaactgtcaggtatcatgtctgctttctaagtgggaagaggaagggagaggcaagcaactaggtacaatgtctatcaggaaagcaaagcttccccagagacgctcagcttgtatccattgactggaagtctgtcacgtggctccccctagccgcacactagtgtgggaaggaaaatattgagctaggcacattactctctgaacgaaattcatattatcttattaaggaagagtgttggtcttcaggaggggaagtttgctgtattggatgccatcatcg

SEQ ID NO: 678 - DNA, 2139 bp, Homo sapiens
  ref <308>: DATABASE ACCESSION NUMBER: NM_001838
  ref <309>: DATABASE ENTRY DATE: 2001-06-18
gtgagacaggggtagtgcgaggccgggcacagccttcctgtgtggttttaccgcccagagagcgtcatggacctggggaaaccaatgaaaagcgtgctggtggtggctctccttgtcattttccaggtatgcctgtgtcaagatgaggtcacggacgattacatcggagacaacaccacagtggactacactttgttcgagtctttgtgctccaagaaggacgtgcggaactttaaagcctggttcctccctatcatgtactccatcatttgtttcgtgggcctactgggcaatgggctggtcgtgttgacctatatctatttcaagaggctcaagaccatgaccgatacctacctgctcaacctggcggtggcagacatcctcttcctcctgacccttcccttctgggcctacagcgcggccaagtcctgggtcttcggtgtccacttttgcaagctcatctttgccatctacaagatgagcttcttcagtggcatgctcctacttctttgcatcagcattgaccgctacgtggccatcgtccaggctgtctcagctcaccgccaccgtgcccgcgtccttctcatcagcaagctgtcctgtgtgggcatctggatactagccacagtgctctccatcccagagctcctgtacagtgacctccagaggagcagcagtgagcaagcgatgcgatgctctctcatcacagagcatgtggaggcctttatcaccatccaggtggcccagatggtgatcggctttctggtccccctgctggccatgagcttctgttaccttgtcatcatccgcaccctgctccaggcacgcaactttgagcgcaacaaggccatcaaggtgatcatcgctgtggtcgtggtcttcatagtcttccagctgccctacaatggggtggtcctggcccagacggtggccaacttcaacatcaccagtagcacctgtgagctcagtaagcaactcaacatcgcctacgacgtcacctacagcctggcctgcgtccgctgctgcgtcaaccctttcttgtacgccttcatcggcgtcaagttccgcaacgatctcttcaagctcttcaaggacctgggctgcctcagccaggagcagctccggcagtggtcttcctgtcggcacatccggcgctcctccatgagtgtggaggccgagaccaccaccaccttctccccataggcgactcttctgcctggactagagggacctctcccagggtccctggggtggggatagggagcagatgcaatgactcaggacatccccccgccaaaagctgctcagggaaaagcagctctcccctcagagtgcaagccctgctccagaagttagcttcaccccaatcccagctacctcaaccaatgccgaaaaagacagggctgataagctaacaccagacagacaacactgggaaacagaggctattgtcccctaaaccaaaaactgaaagtgaaagtccagaaactgttcccacctgctggagtgaaggggccaaggagggtgagtgcaaggggcgtgggagtggcctgaagagtcctctgaatgaaccttctggcctcccacagactcaaatgctcagaccagctcttccgaaaaccaggccttatctccaagaccagagatagtggggagacttcttggcttggtgaggaaaagcggacatcagctggtcaaacaaactctctgaacccctccctccatcgttttcttcactgtcctccaagccagcgggaatggcagctgccacgccgccctaaaagcacactcatcccctcacttgccgcgtcgccctcccaggctctcaacaggggagagtgtggtgtttcctgcaggccaggccagctgcctccgcgtgatcaaagccacactctgggctccagagtggggatgacatgcactcagctcttggctccactgggatgggaggagaggacaagggaaatgtcaggggcggggagggtgacagtggccgcccaaggccacgagcttgttctttgttctttgtcacagggactgaaaacctctcctcatgttctgctttcgattcgttaagagagcaacattttacccacacacagataaagttttcccttgaggaaacaacagctttaaaag

SEQ ID NO: 679 - DNA, 1607 bp, Homo sapiens
  ref <308>: DATABASE ACCESSION NUMBER: NM_001839
  ref <309>: DATABASE ENTRY DATE: 2001-06-18
gctctgtagcacccaggagcggggaagcgaagtgcgagagaccccggaccccagcgctgtctcttcccgccgcccgaaccaccatgacccacttcaacaagggcccttcctatgggctctcggccgaagtcaagaacaagattgcttccaagtatgatcatcaggcagaagaagatcttcgcaattggatagaagaggtgacaggcatgagcattggccccaacttccagctgggcttaaaggatggcatcatcctctgcgaacttataaacaagctacagccaggctcagtgaagaaggtcaacgagtcctcactgaactggcctcagttggagaatattggcaactttattaaagctattcaggcttatggtatgaagccacatgacatattcgaagcaaatgatctttttgagaatggaaacatgacccaggttcagactactctggtggctctagcaggtctggctaaaacaaaaggattccatacaaccattgacattggagttaagtatgcagaaaaacaaacaagacgttttgatgaaggaaaattaaaagctggccaaagtgtaattggtctgcagatgggaaccaacaaatgtgccagccaggcaggtatgacagcttacgggactaggaggcatctttatgatcccaaaatgcaaactgacaaaccttttgaccagaccacaattagtctgcagatgggcactaataaaggagccagccaggcagggatgttagcaccaggtaccagaagagacatctatgatcagaagctaacattacagccggtggacaactcgacaatttccctacagatgggtaccaacaaagttgcttcccagaaaggaatgagtgtgtatgggcttgggcggcaagtatatgatcccaaatactgtgctgctcctacagaacctgtcattcacaacggaagccaaggaacaggaacaaatggttcggaaatcagtgatagtgattatcaggcagaataccctgatgagtatcatggcgagtaccaggatgactaccccagagattaccaatatagcgaccaaggcattgattattagatccacacagaaggagctcagtatttagtcctttgtttttattcagtgagaaccaagctagccttgagtaatttttatcttgtcttcctaaaacactattaagcttattgtacttttaagaaaaattgccttacgtacattcctttttcctttttctgcctcttccctcaatagttgccttttagtgctgtaataggttaaatcctacagcataatcaataactcgcatatgaagtaaaaaggaatactgtgaaaggggagtactcttgtacagccagttcttttatgcaaaaatctatgcatttttacaatcttatattaaactggtattttcaaacaataggaaactttttttttttttttttacagtttagtgtatctggtttctacatggaagactaaactcatgcttattgctaaatgtggtctttgccaactaaatttaagatgcagcattttagaaatttacatatcaatgtttctacagtattgtttgctaatttttaaataaagtcatgatcagtgtgaaaaaaa

SEQ ID NO: 680 - DNA, 5010 bp, Homo sapiens
  ref <308>: DATABASE ACCESSION NUMBER: NM_001845
  ref <309>: DATABASE ENTRY DATE: 2001-06-18
atggggccccggctcagcgtctggctgctgctgctgcccgccgcccttctgctccacgaggagcacagccgggccgctgcgaagggtggctgtgctggctctggctgtggcaaatgtgactgccatggagtgaagggacaaaagggtgaaagaggcctcccggggttacaaggtgtcattgggtttcctggaatgcaaggacctgaggggccacagggaccaccaggacaaaagggtgatactggagaaccaggactacctggaacaaaagggacaagaggacctccgggagcatctggctaccctggaaacccaggacttcccggaattcctggccaagacggcccgccaggccccccaggtattccaggatgcaatggcacaaagggggagagagggccgctcgggcctcctggcttgcctggtttcgcaggaaatcccggaccaccaggcttaccagggatgaagggtgatccaggtgagatacttggccatgtgcccgggatgctgttgaaaggtgaaagaggatttcccggaatcccagggactccaggcccaccaggactgccagggcttcaaggtcctgttgggcctccaggatttaccggaccaccaggtcccccaggccctcccggccctccaggtgaaaagggacaaatgggcttaagttttcaaggaccaaaaggtgacaagggtgaccaaggggtcagtgggcctccaggagtaccaggacaagctcaagttcaagaaaaaggagacttcgccaccaagggagaaaagggccaaaaaggtgaacctggatttcaggggatgccaggggtcggagagaaaggtgaacccggaaaaccaggacccagaggcaaacccggaaaagatggtgacaaaggggaaaaagggagtcccggttttcctggtgaacccgggtacccaggactcataggccgccagggcccgcagggagaaaagggtgaagcaggtcctcctggcccacctggaattgttataggcacaggacctttgggagaaaaaggagagaggggctaccctggaactccggggccaagaggagagccaggcccaaaaggtttcccaggactaccaggccaacccggacctccaggcctccctgtacctgggcaggctggtgcccctggcttccctggtgaaagaggagaaaaaggtgaccgaggatttcctggtacatctctgccaggaccaagtggaagagatgggctcccgggtcctcctggttcccccgggccccctgggcagcctggctacacaaatggaattgtggaatgtcagcccggacctccaggtgaccagggtcctcctggaattccagggcagccaggatttataggcgaaattggagagaaaggtcaaaaaggagagagttgcctcatctgtgatatagacggatatcgggggcctcccgggccacagggacccccgggagaaataggtttcccagggcagccaggggccaagggcgacagaggtttgcctggcagagatggtgttgcaggagtgccaggccctcaaggtacaccagggctgataggccagccaggagccaagggggagcctggtgagttttatttcgacttgcggctcaaaggtgacaaaggagacccaggctttccaggacagcccggcatgccagggagagcgggttctcctggaagagatggccatccgggtcttcctggccccaagggctcgccgggttctgtaggattgaaaggagagcgtggcccccctggaggagttggattcccaggcagtcgtggtgacaccggcccccctgggcctccaggatatggtcctgctggtcccattggtgacaaaggacaagcaggctttcctggaggccctggatccccaggcctgccaggtccaaagggtgaaccaggaaaaattgttcctttaccaggcccccctggagcagaaggactgccggggtccccaggcttcccaggtccccaaggagaccgaggctttcccggaaccccaggaaggccaggcctgccaggagagaagggcgctgtgggccagccaggcattggatttccagggccccccggccccaaaggtgttgacggcttacctggagacatggggccaccggggactccaggtcgcccgggatttaatggcttacctgggaacccaggtgtgcagggccagaagggagagcctggagttggtctaccgggactcaaaggtttgccaggtcttcccggcattcctggcacacccggggagaaggggagcattggggtaccaggcgttcctggagaacatggagcgatcggaccccctgggcttcaggggatcagaggtgaaccgggacctcctggattgccaggctccgtggggtctccaggagttccaggaataggcccccctggagctaggggtccccctggaggacagggaccaccggggttgtcaggccctcctggaataaaaggagagaagggtttccccggattccctggactggacatgccgggccctaaaggagataaaggggctcaaggactccctggcataacgggacagtcggggctccctggccttcctggacagcagggggctcctgggattcctgggtttccaggttccaagggagaaatgggcgtcatggggacccccgggcagccgggctcaccaggaccagtgggtgctcctggattaccgggtgaaaaaggggaccatggctttccgggctcctcaggacccaggggagaccctggcttgaaaggtgataagggggatgtcggtctccctggcaagcctggctccatggataaggtggacatgggcagcatgaagggccagaaaggagaccaaggagagaaaggacaaattggaccaattggtgagaagggatcccgaggagaccctgggaccccaggagtgcctggaaaggacgggcaggcaggacagcctgggcagccaggacctaaaggtgatccaggtataagtggaaccccaggtgctccaggacttccgggaccaaaaggatctgttggtggaatgggcttgccaggaacacctggagagaaaggtgtgcctggcatccctggcccacaaggttcacctggcttacctggagacaaaggtgcaaaaggagagaaagggcaggcaggcccacctggcataggcatcccaggactgcgtggtgaaaagggagatcaagggatagcgggtttcccaggaagccctggagagaagggagaaaaaggaagcattgggatcccaggaatgccagggtccccaggccttaaagggtctcccgggagtgttggctatccaggaagtcctgggctacctggagaaaaaggtgacaaaggcctcccaggattggatggcatccctggtgtcaaaggagaagcaggtcttcctgggactcctggccccacaggcccagctggccagaaaggggagccaggcagtgatggaatcccggggtcagcaggagagaagggtgaaccaggtctaccaggaagaggattcccagggtttccaggggccaaaggagacaaaggttcaaagggtgaggtgggtttcccaggattagccgggagcccaggaattcctggatccaaaggagagcaaggattcatgggtcctccggggccccagggacagccggggttaccgggatccccaggccatgccacggaggggcccaaaggagaccgcggacctcagggccagcctggcctgccaggacttccgggacccatggggcctccagggcttcctgggattgatggagttaaaggtgacaaaggaaatccaggctggccaggagcacccggtgtcccagggcccaagggagaccctggattccagggcatgcctggtattggtggctctccaggaatcacaggctctaagggtgatatggggcctccaggagttccaggatttcaaggtccaaaaggtcttcctggcctccagggaattaaaggtgatcaaggcgatcaaggcgtcccgggagctaaaggtctcccgggtcctcctggccccccaggtccttacgacatcatcaaaggggagcccgggctccctggtcctgagggccccccagggctgaaagggcttcagggactgccaggcccgaaaggccagcaaggtgttacaggattggtgggtatacctggacctccaggtattcctgggtttgacggtgcccctggccagaaaggagagatgggacctgccgggcctactggtccaagaggatttccaggtccaccaggccccgatgggttgccaggatccatggggcccccaggcaccccatctgttgatcacggcttccttgtgaccaggcatagtcaaacaatagatgacccacagtgtccttctgggaccaaaattctttaccacgggtactctttgctctacgtgcaaggcaatgaacgggcccatggacaggacttgggcacggccggcagctgcctgcgcaagttcagcacaatgcccttcctgttctgcaatattaacaacgtgtgcaactttgcatcacgaaatgactactcgtactggctgtccacccctgagcccatgcccatgtcaatggcacccatcacgggggaaaacataagaccatttattagtaggtgtgctgtgtgtgaggcgcctgccatggtgatggccgtgcacagccagaccattcagatcccaccgtgccccagcgggtggtcctcgctgtggatcggctactcttttgtgatgcacaccagcgctggtgcagaaggctctggccaagccctggcgtcccccggctcctgcctggaggagtttagaagtgcgccattcatcgagtgtcacggccgtgggacctgcaattactacgcaaacgcttacagcttttggctcgccaccatagagaggagcgagatgttcaagaagcctacgccgtccaccttgaaggcaggggagctgcgcacgcacgtcagccgctgccaagtctgtatgagaagaacataa

SEQ ID NO: 681 - DNA, 2480 bp, Homo sapiens
  ref <308>: DATABASE ACCESSION NUMBER: NM_001853
  ref <309>: DATABASE ENTRY DATE: 2001-06-18
atggccgggccgcgcgcgtgcgcgccgctcctgctcctgctcctcctcgggcagcttctggcggccgccggggcgcagagagtgggactccccggcccccccggccccccagggcgccctgggaagcccggccaggacggcattgacggagaagctggtcctccaggtctgcctggtcccccgggaccaaagggggccccaggaaagccggggaaaccaggagaggctgggctgccgggactgccgggtgtggatggtctgactggacgagatggaccccctggacccaagggtgcccctggggaacggggaagtctgggacccccggggccgcccgggctggggggcaaaggcctccctggaccccccggagaggcaggagtgagcggccccccaggtgggatcggcctccgcggccccccgggacctcctggactccccggcctccctggtcccccaggacctcccggaccccctggacacccaggagtcctccctgaaggcgctactgaccttcagtgcccaagtatctgcccgccaggtcccccagggccccctggaatgccagggttcaagggacccactggctacaaaggcgagcagggggaagtcggcaaggacggcgagaagggtgaccctggcccccctgggcccgccggcctcccgggcagcgtggggctgcagggcccccggggattacgaggactgccagggccactcgggccccctggggaccggggtcccattgggttccgagggccgcctgggatcccaggagcgcctgggaaagcgggtgaccgaggcgagaggggcccagaagggttccgcggccccaagggtgacctcggcagacctggtcccaagggaacccccggagtggccgggccaagcggagagccgggcatgccaggcaaggacggccagaatggcgtgccaggactcgatggccagaagggagaggctggtcgcaacggtgctccgggagagaagggccccaacgggctgccgggcctccctggacgagcggggtccaaaggcgagaagggagaacggggcagagctggggagctgggtgaggccggcccctctggagagccaggcgtccctggagatgctggcatgcctggggagcgcggtgaggctggccaccggggctcagcgggggccctcggcccacaaggccctcccggagcccctggtgtccgaggcttccagggccagaagggcagcatgggagaccccggccttccaggcccccagggcctccgaggtgacgtgggcgaccggggtccgggaggtgccgaaggccctaagggagaccagggtattgcaggttccgacggtcttcctggggataaaggagaactgggtcccagcggcctggtcggacccaaaggagagtctggcagtcgaggggagctgggccccaaaggcacccagggtcccaacggcaccagcggtgttcagggtgtccccgggccccccggtcctctgggcctgcagggcgtcccgggtgttcctggcatcacggggaagccgggagttccggggaaggaggccagcgagcagcgcatcagggagctgtgtggggggatgatcagcgaacaaattgcacagttagccgcgcacctaaggaagcctttggcacccgggtccattggtcggcccggtccagctggcccccctgggcccccaggacccccaggctccattggtcaccctggcgctcgaggaccccccggataccgcggtcccactggggagctgggagaccccgggcccagaggaaaccagggtgacagaggagacaaaggcgcggcaggagcagggctggacgggcctgaaggagaccaggggccccaaggaccccaaggcgtgcccggcaccagcaaggacggccaggacggtgctcccggcgagcctgggcctcccggagatcctgggcttccaggtgccattggggcccaggggacaccggggatctgcgacacctcagcctgccaaggagccgtgttaggaggggtcggggagaaatcaggctctcgaagctcataaaattcaacgtgaggaagcaagtgacaaggacgcccgaagcacagtggacggtcatgaaggagcgggggtgtggcaggcgggtgacgtccaggagagggagcgcccctggctgcccctcggccgccgactggacgcgtgggccttgccagcgagcaccctcattgggctgtcgcctgacagcatacctcaaaaggccctagctaataaacctgtaagcccagcatttgagagaaggtagggtgtgtatatataaaaggttgtgtacaactccacgaggtgaaaaatattcagtaacttgtttgcatagcatttgtgtaaagactatgatctcatcccaataaaatgatatattaaatcttcagattaatgactggctacagagtaacaaaaaataaacaatttaatgtacagtaaattctctccca

SEQ ID NO: 682 - DNA, 1804 bp, Homo sapiens
  ref <308>: DATABASE ACCESSION NUMBER: NM_001859
  ref <309>: DATABASE ENTRY DATE: 2001-06-18
gcggtggtggacacgtcgagccgggtagaagtggaggggccgttcgaagagtcgtgagggggtgacgggttaagattcggagagagaggtgctagtggctggacttgacctggaaagaatcttctgctgactctcaacttttcctggaaaaaatggatcattcccaccatatggggatgagctatatggactccaacagtaccatgcaaccttctcaccatcacccaaccacttcagcctcacactcccatggtggaggagacagcagcatgatgatgatgcctatgaccttctactttggctttaagaatgtggaactactgttttccggtttggtgatcaatacagctggagaaatggctggagcttttgtggcagtgtttttactagcaatgttctatgaaggactcaagatagcccgagagagcctgctgcgtaagtcacaagtcagcattcgctacaattccatgcctgtcccaggaccaaatggaaccatccttatggagacacacaaaactgttgggcaacagatgctgagctttcctcacctcctgcaaacagtgctgcacatcatccaggtggtcataagctacttcctcatgctcatcttcatgacctacaacgggtacctctgcattgcagtagcagcaggggccggtacaggatacttcctcttcagctggaagaaggcagtggtagtggatatcacagagcattgccattgacatcaaactctatggcgtggccttatcgattgcagtgggaagttgttgaagacttgaagacgtgattcctgctccaatcatcccttcttgctcctctttgtgcacgtacacacacacacacacacacacacacacacacacacccctgctcaacagaggtttagtttacagtctctgaactaaagtagtaacctcccaaattgttttttctaataagctgagattcccatttctcttaaggagaagccacccatgagatgtcttttccttctccatcatcttagagccaagttatatgttcttgtctaatccatgtagctttttgttcaatgacttgatcatctgcttcctttttgaatttttaacagatagtaagtaaatttggtggttttttcccctgggtcagtgatggaaaggggttaacttcagccaggattgatggcagctgagggaaattcttgcccaactaaacccagaactcaaacttaacattagaaaataaggtccagggccggacacagtggcccatgcctgtaatcccagcactttggggggccaaggcaggctggatcacctgaggacaggagttcgagaccagtctggccaacatggggaaaccccgtctctactaaaaatacaaaaattagccgggcatggtggtgggcgcctgtaatcccagctactcagaaggctgaggcaggagaatcacttgaacctaggaggcggaggttgcagtgagccaagatggcgccattgcactccagcctgggtgacaagagtgaaactccatctcaaaaaaaaagaaaagaaggtccagcttttggattcaatgagtgggaaatacattgtgcctttctctagatgtgatacgttataccaaaatctttgtagtgtgcagagcggtggtttgagactaaatacaggcttagaacttgcagagtgtgtattcttggatggctgatgcatcgacttgcattcccacttaacactttgattagccatgaacttgccaatcaaaaaatgacaatcaatttgagaaaatagaaatagatatttttaaataaaaccattcacagttt

SEQ ID NO: 683 - DNA, 799 bp, Homo sapiens
  ref <308>: DATABASE ACCESSION NUMBER: NM_001861
  ref <309>: DATABASE ENTRY DATE: 2001-06-18
cgacgttcgcagcgctacccttttccgctccacggtgacctccgtgcggccgggtgcgggcggagtcttcctcgatcccgtggtgctccgcggcgcggccttgctctcttccggtcgcgggacaccgggtgtagagggcggtcgcggcgggcagtggcggcagaatgttggctaccagggtatttagcctagttggcaagcgagcaatttccacctctgtgtgtgtacgagctcatgaaagtgttgtgaagagcgaagacttttcgctcccagcttatatggatcggcgtgaccaccccttgccggaggtggcccatgtcaagcacctgtctgccagccagaaggcactgaaggagaaggagaaggcctcctggagcagcctctccatggatgagaaagtcgagttgtatcgcattaagttcaaggagagctttgctgagatgaacaggggctcgaacgagtggaagacggttgtgggcggtgccatgttcttcatcggtttcaccgcgctcgttatcatgtggcagaagcactatgtgtacggccccctcccgcaaagctttgacaaagagtgggtggccaagcagaccaagaggatgctggacatgaaggtgaaccccatccagggcttagcctccaagtgggactacgaaaagaacgagtggaagaagtgagagatgctggcctgcgcctgcacctgcgcctggctctgtcaccgccatgcaactccatgcctatttactggaaacctgttatgccaaacagttgtaccactgctaataaatgaccagtttacctg

SEQ ID NO: 684 - DNA, 2443 bp, Homo sapiens
  ref <308>: DATABASE ACCESSION NUMBER: NM_001873
  ref <309>: DATABASE ENTRY DATE: 2001-06-18
aaatggcgtgcccgtctctccgccggccccctgcctcgcagtggtttctcctgcagctcccctgggctccgcggccagtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggcagacaaaagaggccgcccgcgtaggaaggcacggccggcggcggcggagcgcagcgatggccgggcgagggggcagcgcgctgctggctctgtgcggggcactggctgcctgcgggtggctcctgggcgccgaagcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagaccttgtggccaattatccatatgatgagacgcggagtggtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaacggtggtgcttggtacagcgtacctggagggatgcaagacttcaattaccttagcagcaactgttttgagatcaccgtggagcttagctgtgagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaaaaaaaatccccagtgaaaaaaaa

SEQ ID NO: 685 - DNA, 2085 bp, Homo sapiens
  ref <308>: DATABASE ACCESSION NUMBER: NM_001874
  ref <309>: DATABASE ENTRY DATE: 2001-06-18
gcatttcttccttctgcgtatgggacaggaccctttctggaatgggggtcttatgacctacaatcaaacaagaacatggacttcccgtgcctctggctagggctgttgctgcctttggtagctgcgctggatttcaactaccaccgccaggaagggatggaagcgtttttgaagactgttgcccaaaactacagttctgtcactcacttacacagtattgggaaatctgtgaaaggtagaaacctgtgggttcttgttgtggggcggtttccaaaggaacacagaattgggattccagagttcaaatacgtggcaaatatgcatggagatgagactgttgggcgggagctgctgctccatctgattgactatctcgtaaccagtgatggcaaagaccctgaaatcacaaatctgatcaatagtacccggatacacatcatgccttccatgaacccagatggatttgaagccgtcaaaaagcctgactgttactacagcatcggaagggaaaattataaccagtatgacttgaatcgaaatttccccgatgcttttgaatataataatgtctcaaggcagcctgaaactgtggcagtcatgaagtggctgaaaacagagacgtttgtcctctctgcaaacctccatggtggtgccctcgtggccagttacccatttgataatggtgttcaagcaactggggcattatactcccgaagcttaacgcctgatgatgatgtttttcaatatcttgcacatacctatgcttcaagaaatcccaacatgaagaaaggagacgagtgtaaaaacaaaatgaactttcctaatggtgttacaaatggatactcttggtatccactccaaggtggaatgcaagattacaactacatctgggcccagtgttttgaaattacgttggagctgtcatgctgtaaatatcctcgtgaggagaagcttccatccttttggaataataacaaagcctcattaattgaatatataaagcaggtgcacctaggtgtaaagggtcaagtttttgatcagaatggaaatccattacccaatgtaattgtggaagtccaagacagaaaacatatctgcccctatagaaccaacaaatatggagagtattatctccttctcttgcctgggtcttatattataaatgttacagtccctggacatgatccacacatcacaaaggtgattattccggagaaatcccagaacttcagtgctcttaaaaaggatattctacttccattccaagggcaattggattctatcccagtatcaaatccttcatgcccaatgattcctctatacagaaatttgccagaccactcagctgcaacaaagcctagtttgttcttatttttagtgagtcttttgcacatattcttcaaataaagtaaaatgtgaaactcaacccacatcaccacctggaatcagggattgctcactccaggttactgcaaccctaactcactctagtgggaccttgactggagaaactccacgatcttcctgaagaagagaaatggatgtttccaaattccacaataagcaatatgtggtgataatgaaaagaatgattcagtcttgacggtgaatggaagacacttacctaacaagtactgctcatttacactcaaattaatcttgaagtagtcttaaaatgtgtaagaagttaaaacttgagaagcaaaaaatgcctgcaaaaagaagatcattttgtatacagagaaccggatgaatataagcaatgaagatgaacatttattgatcttctacatacaagacttcaccataaggccaggagcagtgctcacgccttgtaatcccagcactttgggaggccaaggtgggcggatcaccttgaggtcaggagttcaagaccagcctgaccaacatggtgaaaccctgtctctactaaatattagcggggtgtggtggcgggcacctgtagtcgcagcctttcgggaggctgagacaggagaatcgcttgaaccctagaggcggagtttgcagtgagccgagatagtgccattgtactccagcttgggcaacagagtaagactctgtctc

SEQ ID NO: 686 - DNA, 691 bp, Homo sapiens
  ref <308>: DATABASE ACCESSION NUMBER: NM_001885
  ref <309>: DATABASE ENTRY DATE: 2001-06-18
gacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaac

SEQ ID NO: 687 - DNA, 1238 bp, Homo sapiens
  ref <308>: DATABASE ACCESSION NUMBER: NM_001888
  ref <309>: DATABASE ENTRY DATE: 2001-06-18
agactgaggttagaaggcacaggtggcgagatgagccgggtaccagcgttcctgagcgcggccgaggtggaggaacacctccgcagctccagcctcctcatcccgcctctagagacggccctggccaacttctccagcggtcccgaaggaggggtcatgcagcccgtgcgcaccgtggtgccggtgaccaagcacaggggctacctgggggtcatgcccgcctacagtgctgcagaggatgcactgaccaccaagttggtcaccttctacgaggaccgcggcatcacctcggtcgtcccttcccaccaggctactgtgctactctttgagcccagcaatggcaccctgctggcggtcatggatggaaatgtcataactgcaaagagaacagctgcagtttctgccattgccaccaagtttctgaaacctcccagcagtgaagtgctgtgcatccttggggctggggtccaggcctacagccattatgagatcttcacagagcagttctcctttaaggaggtgaggatatggaaccgcaccaaagaaaatgcagagaagtttgcagacacagtgcaaggagaggtacgggtctgttcttcggtccaggaggctgtggcaggtgcagatgtgatcatcacagtcaccctggcaacagagcccattttgtttggtgaatgggtgaagccaggggctcacatcaatgctgttggagccagcagacctgactggagagaactggatgatgagctcatgaaagaagctgtgctgtacgtggattcccaggaggctgccctgaaggagtctggagatgtcctgctgtcaggggccgagatctttgctgagctgggagaagtgattaagggagtgaaaccagcccactgtgagaagaccacggtgttcaagtctttgggaatggcagtggaagacacagttgcagccaaactcatctatgattcctggtcatctggtaaataaaacaaaggaacttgatgttgagatggatgcttgaggaatattgctgctggttctcataatttctagagtaaatgagggagtccagtccccagtgaactctccttttgtgcttatcatgttttaccttaaatgctgagatcctcatttatgtttgtagttggaaagcaaagctaggtagccatttcttctgttctaccaagttataatagcattcatttccctttatatttccctgaaataaagcacattccaattgtgcagtg

SEQ ID NO: 688 - DNA, 1259 bp, Homo sapiens
  ref <308>: DATABASE ACCESSION NUMBER: NM_001892
  ref <309>: DATABASE ENTRY DATE: 2001-06-18
ccgcctccgtgttccgtttcctgccgccctcctctcgtagccttgcctagtgtggagccccaggcctccgtcctcttcccagaggtgtcgaggcttggccccagcctccatcttcgtctctcaggatggcgagtagcagcggctccaaggctgaattcattgtcggtgggaaatataaactggtacggaagatcgggtctggctccttcggggacatctatttggcgatcaacatcaccaacggcgaggaagtggcactgaagctagaatctcagaaggccaggcatccccagttgctgtacgagagcaagctctataagattcttcaaggtggggttggcatcccccacatacggtggtatggtcaggaaaaagactacaatgtactagtcatggatcttctgggacctagcctcgaagacctcttcaatttctgttcaagaaggttcacaatgaaaactgtacttatgttagctgaccagatgatcagtagaattgaatatgtgcatacaaagaattttatacacagagacattaaaccagataacttcctaatgggtattgggcgtcactgtaataagttattccttattgattttggtttggccaaaaagtacagagacaacaggacaaggcaacacataccatacagagaagataaaaacctcactggcactgcccgatatgctagcatcaatgcacatcttggtattgagcagagtcgccgagatgacatggaatcattaggatatgttttgatgtattttaatagaaccagcctgccatggcaagggctaaaggctgcaacaaagaaacaaaaatatgaaaagattagtgaaaagaagatgtccacgcctgttgaagttttatgtaaggggtttcctgcagaatttgcgatgtacttaaactattgtcgtgggctacgctttgaggaagccccagattacatgtatctgaggcagctattccgcattcttttcaggaccctgaaccatcaatatgactacacatttgattggacaatgttaaagcagaaagcagcacagcaggcagcctcttcaagtgggcagggtcagcaggcccaaacccccacaggcaagcaaactgacaaatccaagagtaacatgaaaggtttctaatttctaagcatgaattgaggaacagaagaagcagacgagatgatcggagcagcatttgtttctccccaaatctagaaattttagttcatatgtacactagccagtggttgtggacaacca

SEQ ID NO: 689 - DNA, 7918 bp, Homo sapiens
  Modified_base 1 ... 7918: n = a,c,g, or t
  ref <308>: DATABASE ACCESSION NUMBER: NM_001897
  ref <309>: DATABASE ENTRY DATE: 2001-06-18
atgcagtccggccgcggccccccacttccagcccccggcctggccttggctttgaccctgactatgttggccagacttgcatccgcggcttccttcttcggtgagaaccacctggaggtgcctgtggccacggctctgaccgacatagacctgcagctgcagttctccacgtcccagcccgaagccctccttctcctggcagcaggcccagctgaccacctcctgctgcagctctactctggacgcctgcaggtcagacttgttctgggccaggaggagctgaggctgcagactccagcagagacgctgctgagtgactccatcccccacactgtggtgctgactgtcgtagagggctgggccacgttgtcagtcgatgggtttctgaacgcctcctcagcagtcccaggagcccccctagaggtcccctatgggctctttgttgggggcactgggacccttggcctgccctacctgaggggaaccagccgacccctgaggggttgcctccatgcagccaccctcaatggccgcagcctcctccggcctctgacccccgatgtgcatgagggctgtgctgaagagttttctgccagtgatgatgtggccctgggcttctctgggccccactctctggctgccttccctgcctggggcactcaggacgaaggaaccctagagtttacactcaccacacagagccggcaggcacccttggccttccaggcagggggccggcgtggggacttcatctatgtggacatatttgagggccacctgcgggccgtggtggagaagggccagggtaccgtattgctccacaacagtgtgcctgtggccgatgggcagccccatgaggtcagtgtccacatcaatgctcaccggctggaaatctccgtggaccagtaccctacgcatacttcgaaccgaggagtcctcagctacctggagccacggggcagtctccttctcggggggctggatgcagaggcctctcgtcacctccaggaacaccgcctgggcctgacaccagaggccaccaatgcctccctgctgggctgcatggaagacctcagtgtcaatggccagaggcgggggctgcgggaagctttgctgacgcgcaacatggcagccggctgcaggctggaggaggaggagtatgaggacgatgcctatggccattatgaagctttctccaccctggctcccgaggcttggccagccatggagctgcctgagccatgcgtgcctgagccagggctgcctcctgtctttgccaatttcacccagctgctgactatcagcccactggtggtggccgagggtggcacagcctggcttgagtggaggcatgtgcagcccacgctggacctgatggaggctgagctgcgcaaatcccaggtgctgttcagcgtgacccgaggggcacactatggcgagctcgagctggacatcctgggtgcccaggcacgaaaaatgttcaccctcctggacgtggtgaaccgcaaggcccgcttcatccacgatggctctgaggacacctccgaccagctggtgctggaggtgtcggtgacggctcgggtgcccatgccctcatgccttcggaggggccaaacatacctcctgcccatccaggtcaaccctgtcaatgacccaccccacatcatcttcccacatggcagcctcatggtgatcctggaacacacgcagaagccgctggggcctgaggttttccaggcctatgacccggactctgcctgtgagggcctcaccttccaggtccttggcacctcctctggcctccccgtggagcgccgagaccagcctggggagccggcgaccgagttctcctgccgggagttggaggccggcagcctagtctatgtccactgcggtggtcctgcacaggacttgacgttccgggtcagcgatggactgcaggccagccccccggccacgctgaaggtggtggccatccggccggccatacagatccaccgcagcacagggttgcgactggcccaaggctctgccatgcccatcttgcccgccaacctgtcggtggagaccaatgccgtggggcaggatgtgagcgtgctgttccgcgtcactggggccctgcagtttggggagctgcagaagcatagtacaggtggggtggagggtgctgagtggtgggccacacaggcgttccaccagcgggatgtggagcagggccgcgtgaggtacctgagcactgacccacagcaccacgcttacgacaccgtggagaacctggccctggaggtgcaggtgggccaggagatcctgagcaatctgtccttcccagtgaccatccagagagccactgtgtggatgctgcggctggagccactgcacactcagaacacccagcaggagaccctcaccacagcccacctggaggccaccctggaggaggcaggcccaagccccccaaccttccattatgaggtggttcaggctcccaggaaaggcaaccttcaactacagggcacaaggctgtcagatggccagggcttcacccaggatgacatacaggctggccgggtgacctatggggccacagctcgtgcctcagaggcagtcgaggacaccttccgtttccgtgtcacagctccaccatatttctccccactctataccttccccatccacattggtggtgacccagatgcgcctgtcctcaccaatgtcctcctcgtggtgcctgagggtggtgagggtgtcctctctgctgaccacctctttgtcaagagtctcaacagtgccagctacctctatgaggtcatggagcggccccgccttgggaggttggcttggcgtgggacacaggacaagaccactatggtgacatccttcaccaatgaagacctgttgcgtggccggctggtctaccagcatgatgactccgagaccacagaagatgatatcccatttgttgctacccgccagggcgagagcagtggtgacatggcctgggaggaggtacggggtgtcttccgagtggccatccagcccgtgaatgaccacgcccctgtgcagaccatcagccggatcttccatgtggcccggggtgggcggcggctgctgactacagacgacgtggccttcagcgatgctgactcgggctttgctgacgcccagctggtgcttacccgcaaggacctcctctttggcagtatcgtggccgtagatgagcccacgcggcccatctaccgcttcacccaggaggacctcaggaagaggcgagtactgttcgtgcactcaggggctgaccgtggctggatccagctgcaggtgtccgacgggcaacaccaggccactgcgctgctggaggtgcaggcctcggaaccctacctccgtgtggccaacggctccagccttgtggtccctcaaggaggccagggcaccatcgacacggccgtgctccacctggacaccaacctcgacatccgcagtggggatgaggtccactaccacgtcacagctggccctcgctggggacaactagtccgggctggtcagccagccacagccttctcccagcaggacctgctggatggggccgttctctatagccacaatggcagcctcagccccgaagacaccatggccttctccgtggaagcagggccagtgcacacggatgccaccctacaagtgaccattgccctagagggcccactggccccactgaagctggtccggcacaagaagatctacgtcttccagggagaggcagctgagatcagaagggaccagctggaggcagcccaggaggcagtgccacctgcagacatcgtattctcagtgaagagcccaccgagtgccggctacctggtgatggtgtcgcgtggcgccttggcagatgagccacccagcctggaccctgtgcagagcttctcccaggaggcagtggacacaggcagggtcctgtacctgcactcccgccctgaggcctggagcgatgccttctcgctggatgtggcctcaggcctgggtgctcccctcgagggcgtccttgtggagctggaggtgctgcccgctgccatcccactagaggcgcaaaacttcagcgtccctgagggtggcagcctcaccctggcccctccactgctccgtgtctccgggccctacttccccactctcctgggcctcagcctgcaggtgctggagccaccccagcatggacccctgcagaaggaggacggacctcaagccaggaccctcagcgccttctcctggagaatggtggaagagcagctgatccgctacgtgcatgacgggagcgagacactgacagacagttttgtcctgatggctaatgcctccgagatggatcgccagagccatcctgtggccttcactgtcactgtcctgcctgtcaatgaccaaccccccatcctcactacaaacacaggcctgcagatgtgggagggggccactgcgcccatccctgcggaggctctgaggagcacggacggcgactctgggtctgaggatctggtctacaccatcgagcagcccagcaacgggcgggtagtgctgcggggggcgccgggcactgaggtgcgcagcttcacgcaggcccagctggacggcgggctcgtgctgttctcacacagaggaaccctggatggaggcttcccgttccgcctctctgacggcgagcacacttcccccggacacttcttccgagtgacggcccagaagcaagtgctcctctcgctgaagggcagccagacactgactgtctgcccagggtccgtccagccactcagcagtcagaccctcagggccagctccagcgcaggcactgacccccagctcctgctctaccgtgtggtgcggggcccccagctaggccggctgttccacgcccagcaggacagcacaggggaggccctggtgaacttcactcaggcagaggtctacgctgggaatattctgtatgagcatgagatgccccccgagcccttttgggaggcccatgataccctagagctccagctgtcctcgccgcctgcccgggacgtggccgccacccttgctgtggctgtgtcttttgaggctgcctgtccccagcgccccagccacctctggaagaacaaaggtctctgggtccccgagggccagcgggccaggatcaccgtggctgctctggatgcctccaatctcttggccagcgttccatcaccccagcgctcagagcatgatgtgctcttccaggtcacacagttccccagccggggccagctgttggtgtccgaggagcccctccatgctgggcagccccacttcctgcagtcccagctggctgcagggcagctagtgtatgcccacggcggtgggggcacccagcaggatggcttccactttcgtgcccacctccaggggccagcaggggcctccgtggctggaccccaaacctcagaggcctttgccatcacggtgagggatgtaaatgagcggccccctcagccacaggcctctgtcccactccggctcacccgaggctctcgtgcccccatctcccgggcccagctgagtgtggtggacccagactcagctcctggggagattgagtacgaggtccagcgggcaccccacaacggcttcctcagcctggtgggtggtggcctggggcccgtgacccgcttcacgcaagccgatgtggattcagggcggctggccttcgtggccaacgggagcagcgtggcaggcatcttccagctgagcatgtctgatggggccagcccacccctgcccatgtccctggctgtggacatcctaccatccgccatcgaggtgcagctgcgggcacccctggaggtgccccaagctttggggcgctcctcactgagccagcagcagctccgggtggtttcagatcgggaggagccagaggcagcataccgcctcatccagggaccccagtatgggcatctcctggtgggcgggcggcccacctcggccttcagccaattccagatagaccagggcgaggtggtctttgccttcaccaacttctcctcctctcatgaccacttcagagtcctggcactggctaggggtgtcaatgcatcagccgtagtgaacgtcactgtgagggctctgctgcatgtgtgggcaggtgggccatggccccagggtgccaccctgcgcctggaccccaccgtcctagatgctggcgagctggccaaccgcacaggcagtgtgccgcgcttccgcctcctggagggaccccggcatggccgcgtggtccgcgtgccccgagccaggacggagcccgggggcagccagctggtggagcagttcactcagcaggaccttgaggacgggaggctggggctggaggtgggcaggccagaggggagggcccccggccccgcaggtgacagtctcactctggagctgtgggcacagggcgtcccgcctgctgtggcctccctggactttgccactgagccttacaatgctgcccggccctacagcgtggccctgctcagtgtccccgaggccgcccggacggaagcagggaagccagagagcagcacccccacaggcgagccaggccccatggcatccagccctgagcccgctgtggccaagggaggcttcctgagcttccttgaggccaacatgttcagcgtcatcatccccatgtgcctggtacttctgctcctggcgctcatcctgcccctgctcttctacctccgaaaacgcaacaagacgggcaagcatgacgtccaggtcctgactgccaagccccgcaacggcctggctggtgacaccgagacctttcgcaaggtggagccaggccaggccatcccgctcacagctgtgcctggccaggggccccctccaggaggccagcctgacccagagctgctgcagttctgccggacacccaaccctgcccttaagaatggccagtactgggtgtgaaggcctggcctgggcccagatgctgatcgggccagggacaggcttgcccatgtcccgggccccattgcttccatgcccggtgctgtctgagtatccccagagcaagagagacctggagacaccaggggtggagggtcctgggagatagtcccaggggtccgggacagagtggagtcaagagctggaacctccctcagctcactccgagcctggagaactgcaggggccaaggtggaggcaggcttaagttcagtcctcctgccctggagctggtttgggctgtcaaaaccagggtaacctcctacatgggtcatgactctgggtcctgggtctgtgaccttgggtaagtcgcgcctgacccaggctgctaagagggcaaggagaaggaagtaccctggggagggaagggacagaggaagctattcctggcttttctactccaacccaggccaccctttgtctctnccccagagttgagaaaaaaacttcctcccctggttttttagggagatggtatcccctggagtagagggcaagaggagagagcgcctccagtctagaaggcataagccaataggataatatattcagggtgcagggtgggtaggttgctctggggatgggtttatttaagggagattgcaaggaagctatttaacatggtgctgagctagccaggactgatggagcccctgggggtgtgggatggaggagggtctgcagccagttcattcccagggccccatcttgatgggccaagggctaaacatgcatgtgtcagtggctttggagcaggctaggctggggctcatcgagggtctcaggccgaggccactgtagtgccagtgcccccctgaggactagggcaggcagctgggggcacttggttccatggagcctggataaacagtgctttggaggctctggaaaaaaaaaaaaaaaaaaaaaa

SEQ ID NO: 690 - DNA, 736 bp, Homo sapiens
  ref <308>: DATABASE ACCESSION NUMBER: NM_001899
  ref <309>: DATABASE ENTRY DATE: 2001-06-18
ggctctcaccctcctctcctgcagctccagctctgtgctctgcctctgaggagaccatggcccggcctctgtgtaccctgctactcctgatggctaccctggctggggctctggcctcgagctccaaggaggagaataggataatcccaggtggcatctatgatgcagacctcaatgatgagtgggtacagcgtgcccttcacttcgccatcagcgagtacaacaaggccaccgaagatgagtactacagacgcccgctgcaggtgctgcgagccagggagcagacctttgggggggtgaattacttcttcgacgtagaggtgggccgcaccatatgtaccaagtcccagcccaacttggacacctgtgccttccatgaacagccagaactgcagaagaaacagttatgctctttcgagatctacgaagttccctgggaggacagaatgtccctggtgaattccaggtgtcaagaagcctaggggtctgtgccaggccagtcacaccgaccaccacccactcccaccccctgtagtgctcccacccctggactggtggcccccaccctgcgggaggcctccccatgtgcctgtgccaagagacagacagagaaggctgcaggagtcctttgttgctcagcagggcgctctgccctccctccttccttcttgcttctaatagacctggtacatggtacacacacccccacctcctgcaattaaacagtagcatcgcc

SEQ ID NO: 691 - DNA, 2758 bp, Homo sapiens
  ref <308>: DATABASE ACCESSION NUMBER: NM_001905
  ref <309>: DATABASE ENTRY DATE: 2001-06-18
ctatccgcgcgcgtcgccggcccagtcctgtcgctgacgggaggatctgaagccggccgcaggtcaaagagtaaaatgaagtacattctggttactggtggtgttatatcaggaattggaaaaggaatcattgccagcagtgtgggcacaatactcaagtcatgtggtttacatgtaacttcaatcaaaattgacccctacattaacattgatgcaggaacattctctccttatgagcatggtgaggtttttgtgctggatgatggtggggaagtagaccttgacctgggtaactatgagcggttccttgacatccgcctcaccaaggacaataatctgaccactggaaagatataccagtatgtcattaacaaggaacggaaaggagattacttggggaaaactgtccaagttgtccctcatatcacagatgcaatccaggagtgggtgatgagacaggcgttaatacctgtagatgaagatggcctggaacctcaagtgtgtgttattgagcttggtggaaccgtgggggacatagaaagcatgccctttattgaggccttccgtcagttccaattcaaggtcaaaagagagaacttttgtaacatccacgtcagtctagttccccagccaagttcaacaggggaacagaagactaaacctacccagaatagtgttcgggaacttagaggacttgggctttccccagatctggttgtatgcaggtgctcaaatccacttgacacatcagtgaaggagaaaatatcaatgttctgccatgttgagcctgaacaagtgatctgtgtccacgatgtctcatccatctaccgagtccccttgttgttagaggagcaaggggttgtagattattttcttcgaagacttgaccttcctattgagaggcagccaagaaaaatgctgatgaaatggaaagagatggctgacagatatgatcgcttgctggagacctgctctattgcccttgtggcgaaatacaccgagttctcagactcctatgcctctgtcattaaggctctggagcattctgcactggccatcaaccacaaattggaaatcaagtacatagattctgcggacttggagcccatcacctcgcaagaagagcccgtgcgctaccacgaagcttggcagaagctctgtagtgctcatggagtgctggttccaggaggatttggtgttcgaggaacagaaggaaaaatccaagcaattgcctgggctcggaatcagaaaaagccttttttgggcgtgtgcttagggatgcagttggcagtggttgaattctcaagaaacgtgctgggatggcaagatgccaattctacagagtttgaccctacgaccagtcatcccgtggtcgtagacatgccagaacacaacccagggcagatgggcggaaccatgaggctgggcaagaggagaaccctgttccagaccaagaactcagtcatgaggaaactctatggagacgcagactacttggaagagaggcaccgccaccgatttgaggtgaatccagtctggaaaaagtgtttggaagaacaaggcttgaagtttgttggccaagatgttgaaggagagagaatggaaattgtggagttagaagatcatcccttttttgttggggttcagtaccaccctgagttcctgtccaggcctatcaagccctccccaccatactttggcctcctcctggcctctgtggggcggctctcacattacctccagaaaggctgcaggctctcacccagggacacctatagtgacaggagtggaagcagctcccctgactctgaaatcaccgaactgaagtttccatcaataaatcatgactgatcttgtagcggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagatgtccccatcggtcaccttgtttctcaactacctcgcatcattgcagatcgtagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtgcgtgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaagggcaatatgaagttactttcttaatgtgacctagcaataggcatagctacgtggcactatattctggccagactcgatgtgtactctaacttaagaaataaatcagtaaggcag

SEQ ID NO: 692 - DNA, 1575 bp, Homo sapiens
  ref <308>: DATABASE ACCESSION NUMBER: NM_001912
  ref <309>: DATABASE ENTRY DATE: 2001-06-18
agaaccgcgacctccgcaaccttgagcggcatccgtggagtgcgcctgcagctacgaccgcagcaggaaagcgccgccggccaggcccagctgtggccggacagggactggaagagaggacgcggtcgagtaggtgtgcaccagccctggcaacgagagcgtctaccccgaactctgctggccttgaggtggggaagccggggagggcagttgaggaccccgcggaggcgcgtgactggttgagcgggcaggccagcctccgagccgggtggacacaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaatgt

SEQ ID NO: 693 - DNA, 716 bp, Homo sapiens
  ref <308>: DATABASE ACCESSION NUMBER: NM_001914
  ref <309>: DATABASE ENTRY DATE: 2001-06-18
atggcagagcagtcggacgaggccgtgaagtactacaccctagaggagattcagaagcacaaccacagcaagagcacctggctgatcctgcaccacaaggtgtacgatttgaccaaatttctggaagagcatcctggtggggaagaagttttaagggaacaagctggaggtgacgctactgagaactttgaggatgtcgggcactctacagatgccagggaaatgtccaaaacattcatcattggggagctccatccagatgacagaccaaagttaaacaagcctccagaaccttaaaggcggtgtttcaaggaaactcttatcactactattgattctagttccagttggtggaccaactgggtgatccctgccatctctgcagtggccgtcgccttgatgtatcgcctatacatggcagaggactgaacacctcctcagaagtcagcgcaggaagagcctgctttggacacgggagaaaagaagccattgctaactacttcaactgacagaaaccttcacttgaaaacaatgattttaatatatctctttctttttcttccgacattagaaacaaaacaaaaagaactgtcctttctgcgctcaaatttttcgagtgtgcctttttattcatctactttattttgatgtttccttaatgtgtaatttacttattataagcatgatcttttaaaaatatatttggcttttaaagt

SEQ ID NO: 694 - DNA, 1017 bp, Homo sapiens
  ref <308>: DATABASE ACCESSION NUMBER: NM_001919
  ref <309>: DATABASE ENTRY DATE: 2001-06-18
cggtcaagatggcgctggtggcttctgtgcgagtcccggcgcgcgttctgctccgcgcgggggcccggctcccgggcgcggccctcgggcggacggagcgggcggccggcggcggagacggcgcgcggccgttcgggagccagcgggtgctggtggagccggacgcggccgcaggggtcgctgtgatgaaattcaagaaccccccagtgaacagcctgagcctggagtttctgacggagctggtcatcagcctggagaagctggagaatgacaagagcttccgcggtgtcattctgacctcggaccgcccgggtgtcttctcggccggcctggacctgacggagatgtgtgggaggagccccgcccactacgctgggtactggaaggccgttcaggagctgtggctgcggttgtaccagtccaacctggtgctggtctccgccatcaacggagcctgccccgctggaggctgcctggtggccctgacctgtgactaccgcatcctggcggacaaccccaggtactgcataggactcaatgagacccagctgggcatcatcgcccctttctggttgaaagacaccctggagaacaccatcgggcaccgggcggcggagcgtgccctgcagctggggctgctcttcccgccggcggaggccctgcaggtgggcatagtggaccaggtggtcccggaggagcaggtgcagagcactgcgctgtcagcgatagcccagtggatggccattccagaccatgctcgacagctgaccaaggccatgatgcgaaaggccacggccagccgcctggtcacgcagcgcgatgcggacgtgcagaacttcgtcagcttcatctccaaagactccatccagaagtccctgcagatgtacttagagaggctcaaagaagaaaaaggctaacgattgggctgccacaggcttacggccacacgtgcccctgtgggtcccagggaggtcttaaacaaggtatttttcaacttaaaaaaaaaaaaaaaaaaaa

SEQ ID NO: 695 - DNA, 5879 bp, Homo sapiens
  ref <308>: DATABASE ACCESSION NUMBER: NM_001941
  ref <309>: DATABASE ENTRY DATE: 2001-06-18
ggcaggtctcgctctcggcaccctcccggcgcccgcgttctcctggccctgcccggcatcccgatggccgccgctgggccccggcgctccgtgcgcggagccgtctgcctgcatctgctgctgaccctcgtgatcttcagtcgtgatggtgaagcctgcaaaaaggtgatacttaatgtaccttctaaactagaggcagacaaaataattggcagagttaatttggaagagtgcttcaggtctgcagacctcatccggtcaagtgatcctgatttcagagttctaaatgatgggtcagtgtacacagccagggctgttgcgctgtctgataagaaaagatcatttaccatatggctttctgacaaaaggaaacagacacagaaagaggttactgtgctgctagaacatcagaagaaggtatcgaagacaagacacactagagaaactgttctcaggcgtgccaagaggagatgggcacctattccttgctctatgcaagagaattccttgggccctttcccattgtttcttcaacaagttgaatctgatgcagcacagaactatactgtcttctactcaataagtggacgtggagttgataaagaacctttaaatttgttttatatagaaagagacactggaaatctattttgcactcggcctgtggatcgtgaagaatatgatgtttttgatttgattgcttatgcgtcaactgcagatggatattcagcagatctgcccctcccactacccatcagggtagaggatgaaaatgacaaccaccctgttttcacagaagcaatttataattttgaagttttggaaagtagtagacctggtactacagtgggggtggtttgtgccacagacagagatgaaccggacacaatgcatacgcgcctgaaatacagcattttgcagcagacaccaaggtcacctgggctcttttctgtgcatcccagcacaggcgtaatcaccacagtctctcattatttggacagagaggttgtagacaagtactcattgataatgaaagtacaagacatggatggccagttttttggattgataggcacatcaacttgtatcataacagtaacagattcaaatgataatgcacccactttcagacaaaatgcttatgaagcatttgtagaggaaaatgcattcaatgtggaaatcttacgaatacctatagaagataaggatttaattaacactgccaattggagagtcaattttaccattttaaagggaaatgaaaatggacatttcaaaatcagcacagacaaagaaactaatgaaggtgttctttctgttgtaaagccactgaattatgaagaaaaccgtcaagtgaacctggaaattggagtaaacaatgaagcgccatttgctagagatattcccagagtgacagccttgaacagagccttggttacagttcatgtgagggatctggatgaggggcctgaatgcactcctgcagcccaatatgtgcggattaaagaaaacttagcagtggggtcaaagatcaacggctataaggcatatgaccccgaaaatagaaatggcaatggtttaaggtacaaaaaattgcatgatcctaaaggttggatcaccattgatgaaatttcagggtcaatcataacttccaaaatcctggatagggaggttgaaactcccaaaaatgagttgtataatattacagtcctggcaatagacaaagatgatagatcatgtactggaacacttgctgtgaacattgaagatgtaaatgataatccaccagaaatacttcaagaatatgtagtcatttgcaaaccaaaaatggggtataccgacattttagctgttgatcctgatgaacctgtccatggagctccattttatttcagtttgcccaatacttctccagaaatcagtagactgtggagcctcaccaaagttaatgatacagctgcccgtctttcatatcagaaaaatgctggatttcaagaatataccattcctattactgtaaaagacagggccggccaagctgcaacaaaattattgagagttaatctgtgtgaatgtactcatccaactcagtgtcgtgcgacttcaaggagtacaggagtaatacttggaaaatgggcaatccttgcaatattactgggtatagcactgctcttttctgtattgctaactttagtatgtggagtttttggtgcaactaaagggaaacgttttcctgaagatttagcacagcaaaacttaattatatcaaacacagaagcacctggagacgatagagtgtgctctgccaatggatttatgacccaaactaccaacaactctagccaaggtttttgtggtactatgggatcaggaatgaaaaatggagggcaggaaaccattgaaatgatgaaaggaggaaaccagaccttggaatcctgccggggggctgggcatcatcataccctggactcctgcaggggaggacacacggaggtggacaactgcagatacacttactcggagtggcacagttttactcaaccccgtctcggtgaaaaattgcatcgatgtaatcagaatgaagaccgcatgccatcccaagattatgtcctcacttataactatgagggaagaggatctccagctggttctgtgggctgctgcagtgaaaagcaggaagaagatggccttgactttttaaataatttggaacccaaatttattacattagcagaagcatgcacaaagagataatgtcacagtgctacaattaggtctttgtcagacattctggaggtttccaaaaataatattgtaaagttcaatttcaacatgtatgtatatgatgatttttttctcaattttgaattatgctactcaccaatttatatttttaaagccagttgttgcttatcttttccaaaaagtgaaaaatgttaaaacagacaactggtaaatctcaaactccagcactggaattaaggtctctaaagcatctgctcttttttttttttacggatattttagtaataaatatgctggataaatattagtccaacaatagctaagttatgctaatatcacattattatgtattcactttaagtgatagtttaaaaaataaacaagaaatattgagtatcactatgtgaagaaagttttggaaaagaaacaatgaagactgaattaaattaaaaatgttgcagctcataaagaattgggactcacccctactgcactaccaaattcatttgactttggaggcaaaatgtgttgaagtgccctatgaagtagcaattttctataggaatatagttggaaataaatgtgtgtgtgtatattattattaatcaatgcaatatttaaaatgaaatgagaacaaagaggaaaatggtaaaaacttgaaatgaggctggggtatagtttgtcctacaatagaaaaaagagagagcttcctaggcctgggctcttaaatgctgcattataactgagtctatgaggaaatagttcctgtccaatttgtgtaatttgtttaaaattgtaaataaattaaacttttctggtttctgtgggaaggaaatagggaatccaatggaacagtagctttgctttgcagtctgtttcaagatttctgcatccacaagttagtagcaaactggggaatactcgctgcagctggggttccctgctttttggtagcaagggtccagagatgaggtgtttttttcggggagctaataacaaaaacattttaaaacttacctttactgaagttaaatcctctattgctgtttctattctctcttatagtgaccaacatctttttaatttagatccaaataaccatgtcctcctagagtttagaggctagagggagctgaggggaggatcttactgaaagcaccctggggagattgattgtccttaaacctaagccccacaaacttgacacctgatcaggtctgggagctacaaaatttcatttttctcctcactgcccttcttctgagtggcattggcctgaatcaaggaaagccaggccttgtgggcccccttctttcggctttctgctaaagcaacacctccagcagagattcccttaagtgactccaggttttccaccatccttcagcgtgaattaatttttaatcagtttgctttctccagagaaattttaaaataatagaagaaatagaaattttgaatgtataaaagaaaaagatcaagttgtcattttagaacagagggaactttgggagaaagcagcccaagtaggttatttgtacagtcagagggcaacaggaagatgcaggccttcaagggcaaggagaggccacaaggaatatgggtgggagtaaaagcaacatcgtctgcttcatactttttcctaggcttggcactgccttttcctttctcaggccaatggcaactgccatttgagtccggtgagggatcagccaacctcttctctatggctcaccttatttggagtgagaaatcaaggagacagagctgactgcatgatgagtctgaaggcatttgcaggatgagcctgaactggttgtgcagaacaaacaaggcattcatgggaattgttgtattccttctgcagccctccttctgggcactaagaaggtctatgaattaaatgcctatctaaaattctgatttattcctacattttctgttttctaatttgaccctaaaatctatgtgttttagacttagactttttattgccccccccccctttttttttgagacggagtctcgctctgacgcacaggctggagtgcagtggctccgatctctgctcactgaaagctccgcctcccgggttcatgccattctcctgcctcagcctcctgagtagctgggactacaggcgcccaccaccacgcccggctaattttttgtatttttaatagagacggggtttcactgtgttagccaggatggtctcgatctcctgacctcgtgatccgcctgcctcggcctcccaaagtgctgggattacaggcatgacccaccgctcccggccttgttttccgtttaaagtcgtcttcttttaatgtaatcattttgaacatgtgtgaaagttgatcatacgaattggatcaatcttgaaatactcaaccaaaagacagtcgagaagccagggggagaaagaactcagggcacaaaatattggtctgagaatggaattctctgtaagcctagttgctgaaatttcctgctgtaaccagaagccagttttatctaacggctactgaaacacccactgtgttttgctcactccctcactcaccgatcaaaacctgctacctccccaagactttactagtgccgataaactttctcaaagagcaaccagtatcacttccctgtttataaaacctctaaccatctctttgttctttgaacatgctgaaaaccacctggtctgcatgtatgcccgaatttgtaattcttttctctcaaatgaaaatttaattttagggattcatttctatattttcacatatgtagtattattatttccttatatgtgtaaggtgaaatttatggtatttgagtgtgcaagaaaatatatttttaaagctttcatttttcccccagtgaatgatttagaattttttatgtaaatatacagaatgttttttcttacttttataaggaagcagctgtctaaaatgcagtggggtttgttttgcaatgttttaaacagagttttagtattgctattaaaagaagttactttgcttttaaagaaacttggctgcttaaaataagcaaaaattggatgcataaagtaatatttacagatgtggggagatgtaataaaacaatattaacttggaaaaaaaaaaaaaaaaaaa

SEQ ID NO: 696 - DNA, 3516 bp, Homo sapiens
  ref <308>: DATABASE ACCESSION NUMBER: NM_001943
  ref <309>: DATABASE ENTRY DATE: 2001-06-18
tcgagggtgcgatggcgcggacgcgggaccgcgtacgcctgctgcttctcctgatctgctttaacgttggaagtggacttcacttacaggtcttaagcacaagaaatgaaaataagctgcttcctaaacatcctcatttagtgcggcaaaagcgcgcctggatcaccgcccccgtggctcttcgggagggagaggatctgtccaagaagaatccaattgccaagatacattctgatcttgcagaagaaagaggactcaaaattacttacaaatacactggaaaagggattacagagccaccttttggtatatttgtctttaacaaagatactggagaactgaatgttaccagcattcttgatcgagaagaaacaccattttttctgctaacaggttacgctttggatgcaagaggaaacaatgtagagaaacccttagagctacgcattaaggttcttgatatcaatgacaacgaaccagtgttcacacaggatgtctttgttgggtctgttgaagagttgagtgcagcacatactcttgtgatgaaaatcaatgcaacagatgcagatgagcccaataccctgaattcgaaaatttcctatagaatcgtatctctggagcctgcttatcctccagtgttctacctaaataaagatacaggagagatttatacaaccagtgttaccttggacagagaggaacacagcagctacactttgacagtagaagcaagagatggcaatggagaagttacagacaaacctgtaaaacaagctcaagttcagattcgtattttggatgtcaatgacaatatacctgtagtagaaaataaagtgcttgaagggatggttgaagaaaatcaagtcaatgtagaagttacgcgcataaaagtgttcgatgcagatgaaataggttctgataattggctggcaaattttacatttgcatcaggaaatgaaggaggttatttccacatagaaacagatgctcaaactaacgaaggaattgtgacccttattaaggaagtagattatgaagaaatgaagaatcttgacttcagtgttattgtcgctaataaagcagcttttcacaagtcgattaggagtaaatacaagcctacacccattcccatcaaggtcaaagtgaaaaatgtgaaagaaggcattcattttaaaagcagcgtcatctcaatttatgttagcgagagcatggatagatcaagcaaaggccaaataattggaaattttcaagcttttgatgaggacactggactaccagcccatgcaagatatgtaaaattagaagatagagataattggatctctgtggattctgtcacatctgaaattaaacttgcaaaacttcctgattttgaatctagatatgttcaaaatggcacatacactgtaaagattgtggccatatcagaagattatcctagaaaaaccatcactggcacagtccttatcaatgttgaagacatcaacgacaactgtcccacactgatagagcctgtgcagacaatctgtcacgatgcagagtatgtgaatgttactgcagaggacctggatggacacccaaacagtggccctttcagtttctccgtcattgacaaaccacctggcatggcagaaaaatggaaaatagcacgccaagaaagtaccagtgtgctgctgcaacaaagtgagaaaaagcttgggagaagtgaaattcagttcctgatttcagacaatcagggttttagttgtcctgaaaagcaggtccttacactcacagtttgtgaggttctgcatggcagcggctgcagggaagcacagcatgactcctatgtgggcctgggacccgcagcaattgcgctcatgattttggcctttctgctcctgctattggtaccacttttactgctgatgtgccattgcggaaagggcgccaaagcgtttacccccatacctggcaccatagagatgctgcatccttggaataatgaaggagcaccacctgaagacaaggtggtgccatcatttctgccagtggatcaagggggcagtctagtaggaagaaatggagtaggaggtatggccaaggaagccacgatgaaaggaagtagctctgcttccattgtcaaagggcaacatgagatgtccgagatggatggaaggtgggaagaacacagaagcctgctttctggtagagctacccagtttacaggggccacaggcgctatcatgaccactgaaaccacgaagaccgcaagggccacaggggcttccagagacatggccggagctcaggcagctgctgttgcactgaacgaagaattcttaagaaattatttcactgataaagcggcctcttacactgaggaagatgaaaatcacacagccaaagattgccttctggtttattctcaggaagaaactgaatcgctgaatgcttctattggttgttgcagttttattgaaggagagctagatgaccgcttcttagatgatttgggacttaaattcaagacgctagctgaagtttgcctgggtcaaaaaatagatataaataaggaaattgagcagagacaaaaacctgccacagaaacaagtatgaacacagcttcacattcactctgtgagcaaactatggttaattcagagaatacctactcctctggcagtagcttcccagttccaaaatctttgcaagaagccaatgcagagaaagtaactcaggaaatagtcactgaaagatctgtgtcttctaggcaggcgcaaaaggtagctacacctcttcctgacccaatggcttctagaaatgtgatagcaacagaaacttcctatgtcacagggtccactatgccaccaaccactgtgatcctgggtcctagccagccacagagccttattgtgacagagagggtgtatgctccagcttctaccttggtagatcagccttatgctaatgaaggtacagttgtggtcactgaaagagtaatacagcctcatgggggtggatcgaatcctctggaaggcactcagcatcttcaagatgtaccttacgtcatggtgagggaaagagagagcttccttgcccccagctcaggtgtgcagcctactctggccatgcctaatatagcagtaggacagaatgtgacagtgacagaaagagttctagcacctgcttccactctgcaatccagttaccagattcccactgaaaattctatgacggctaggaacaccacggtgtctggagctggagtccctggccctctgccagattttggtttagaggaatctggtcattctaattctaccataaccacatcttccaccagagtcaccaagcatagcactgtacagcattcttactcctaaacagcagtcagccacaaactgacccagagtttaattagcagtgactaatttcatgtttccaatgtacctgatttttcatgagccttacagacacacagagacacatacacattgatcttaaaatttttctcagtcactgatatgcaaagga

SEQ ID NO: 697 - DNA, 3336 bp, Homo sapiens
  ref <308>: DATABASE ACCESSION NUMBER: NM_001944
  ref <309>: DATABASE ENTRY DATE: 2001-06-18
ttttcttagacattaactgcagacggctggcaggatagaagcagcggctcacttggactttttcaccagggaaatcagagacaatgatggggctcttccccagaactacaggggctctggccatcttcgtggtggtcatattggttcatggagaattgcgaatagagactaaaggtcaatatgatgaagaagagatgactatgcaacaagctaaaagaaggcaaaaacgtgaatgggtgaaatttgccaaaccctgcagagaaggagaagataactcaaaaagaaacccaattgccaagattacttcagattaccaagcaacccagaaaatcacctaccgaatctctggagtgggaatcgatcagccgccttttggaatctttgttgttgacaaaaacactggagatattaacataacagctatagtcgaccgggaggaaactccaagcttcctgatcacatgtcgggctctaaatgcccaaggactagatgtagagaaaccacttatactaacggttaaaattttggatattaatgataatcctccagtattttcacaacaaattttcatgggtgaaattgaagaaaatagtgcctcaaactcactggtgatgatactaaatgccacagatgcagatgaaccaaaccacttgaattctaaaattgccttcaaaattgtctctcaggaaccagcaggcacacccatgttcctcctaagcagaaacactggggaagtccgtactttgaccaattctcttgaccgagagcaagctagcagctatcgtctggttgtgagtggtgcagacaaagatggagaaggactatcaactcaatgtgaatgtaatattaaagtgaaagatgtcaacgataacttcccaatgtttagagactctcagtattcagcacgtattgaagaaaatattttaagttctgaattacttcgatttcaagtaacagatttggatgaagagtacacagataattggcttgcagtatatttctttacctctgggaatgaaggaaattggtttgaaatacaaactgatcctagaactaatgaaggcatcctgaaagtggtgaaggctctagattatgaacaactacaaagcgtgaaacttagtattgctgtcaaaaacaaagctgaatttcaccaatcagttatctctcgataccgagttcagtcaaccccagtcacaattcaggtaataaatgtaagagaaggaattgcattccgtcctgcttccaagacatttactgtgcaaaaaggcataagtagcaaaaaattggtggattatatcctgggaacatatcaagccatcgatgaggacactaacaaagctgcctcaaatgtcaaatatgtcatgggacgtaacgatggtggatacctaatgattgattcaaaaactgctgaaatcaaatttgtcaaaaatatgaaccgagattctactttcatagttaacaaaacaatcacagctgaggttctggccatagatgaatacacgggtaaaacttctacaggcacggtatatgttagagtacccgatttcaatgacaattgtccaacagctgtcctcgaaaaagatgcagtttgcagttcttcaccttccgtggttgtctccgctagaacactgaataatagatacactggcccctatacatttgcactggaagatcaacctgtaaagttgcctgccgtatggagtatcacaaccctcaatgctacctcggccctcctcagagcccaggaacagatacctcctggagtataccacatctccctggtacttacagacagtcagaacaatcggtgtgagatgccacgcagcttgacactggaagtctgtcagtgtgacaacaggggcatctgtggaacttcttacccaaccacaagccctgggaccaggtatggcaggccgcactcagggaggctggggcctgccgccatcggcctgctgctccttggtctcctgctgctgctgttggccccccttctgctgttgacctgtgactgtggggcaggttctactgggggagtgacaggtggttttatcccagttcctgatggctcagaaggaacaattcatcagtggggaattgaaggagcccatcctgaagacaaggaaatcacaaatatttgtgtgcctcctgtaacagccaatggagccgatttcatggaaagttctgaagtttgtacaaatacgtatgccagaggcacagcggtggaaggcacttcaggaatggaaatgaccactaagcttggagcagccactgaatctggaggtgctgcaggctttgcaacagggacagtgtcaggagctgcttcaggattcggagcagccactggagttggcatctgttcctcagggcagtctggaaccatgagaacaaggcattccactggaggaaccaataaggactacgctgatggggcgataagcatgaattttctggactcctacttttctcagaaagcatttgcctgtgcggaggaagacgatggccaggaagcaaatgactgcttgttgatctatgataatgaaggcgcagatgccactggttctcctgtgggctccgtgggttgttgcagttttattgctgatgacctggatgacagcttcttggactcacttggacccaaatttaaaaaacttgcagagataagccttggtgttgatggtgaaggcaaagaagttcagccaccctctaaagacagcggttatgggattgaatcctgtggccatcccatagaagtccagcagacaggatttgttaagtgccagactttgtcaggaagtcaaggagcttctgctttgtccgcctctgggtctgtccagccagctgtttccatccctgaccctctgcagcatggtaactatttagtaacggagacttactcggcttctggttccctcgtgcaaccttccactgcaggctttgatccacttctcacacaaaatgtgatagtgacagaaagggtgatctgtcccatttccagtgttcctggcaacctagctggcccaacgcagctacgagggtcacatactatgctctgtacagaggatccttgctcccgtctaatatgaccagaatgagctggaataccacactgaccaaatctggatctttggactaaagtattcaaaatagcatagcaaagctcactgtattgggctaataatttggcacttattagcttctctcataaactgatcacgattataaattaaatgtttgggttcataccccaaaagcaatatgttgtcactcctaattctcaagtactattcaaattgtagtaaatcttaaagtttttcaaaaccctaaaatcatattcgc

SEQ ID NO: 698 - DNA, 2390 bp, Homo sapiens
  ref <308>: DATABASE ACCESSION NUMBER: NM_001946
  ref <309>: DATABASE ENTRY DATE: 2001-06-18
ccagcctcggagggagggattagaagccgctagactttttttcctcccctctcagtagcacggagtccgaattaattggatttcattcactggggaggaacaaaaactatctgggcagcttcattgagagagattcattgacactaagagccagcgctgcagctggtgcagagagaacctccggctttgacttctgtctcgtctgccccaaggccgctagcctcggcttgggaaggcgaggcggaattaaaccccgctccgagagcgcacgttcgcgcgcggtgcgtcggccattgcctgccccgaggggcgtctggtaggcaccccgccctctcccgcagctcgacccccatgatagatacgctcagacccgtgcccttcgcgtcggaaatggcgatcagcaagacggtggcgtggctcaacgagcagctggagctgggcaacgagcggctgctgctgatggactgccggccgcaggagctatacgagtcgtcgcacatcgagtcggccatcaacgtggccatcccgggcatcatgctgcggcgcctgcagaagggtaacctgccggtgcgcgcgctcttcacgcgcggcgaggaccgggaccgcttcacccggcgctgtggcaccgacacagtggtgctctacgacgagagcagcagcgactggaacgagaatacgggcggcgagtcgttgctcgggctgctgctcaagaagctcaaggacgagggctgccgggcgttctacctggaaggtggcttcagtaagttccaagccgagttctccctgcattgcgagaccaatctagacggctcgtgtagcagcagctcgccgccgttgccagtgctggggctcgggggcctgcggatcagctctgactcttcctcggacatcgagtctgaccttgaccgagaccccaatagtgcaacagactcggatggtagtccgctgtccaacagccagccttccttcccagtggagatcttgcccttcctctacttgggctgtgccaaagactccaccaacttggacgtgttggaggaattcggcatcaagtacatcttgaacgtcacccccaatttgccgaatctctttgagaacgcaggagagtttaaatacaagcaaatccccatctcggatcactggagccaaaacctgtcccagtttttccctgaggccatttctttcatagatgaagcccggggcaagaactgtggtgtcttggtacattgcttggctggcattagccgctcagtcactgtgactgtggcttaccttatgcagaagctcaatctgtcgatgaacgatgcctatgacattgtcaaaatgaaaaaatccaacatatcccctaacttcaacttcatgggtcagctgctggacttcgagaggacgctgggactcagcagcccatgtgacaacagggttccagcacagcagctgtattttaccaccccttccaaccagaatgtataccaggtggactctctgcaatctacgtgaaagaccccacacccctccttgctggaatgtgtctggcccttcagcagtttctcttggcagcatcagctgggctgctttctttgtgtgtggccccaggtgtcaaaatgacaccagctgtctgtactagacaaggttaccaagtgcggaattggttaatactaacagagagatttgctccattctctttggaataacaggacatgctgtatagatacaggcagtaggtttgctctgtacccatgtgtacagcctacccatgcagggactgggattcgaggacttccaggcgcatagggtagaaccaaatgatagggtaggagcatgtgttctttagggccttgtaaggctgtttccttttgcatctggaactgactatataattgtcttcaagtgaagactaattcaattttgcatatagaggagccaaagagagatttcagctctgtatttgtggtatcagtgttggaaaagagaaatctgatactccatttggattattgtaaatatttgatcttgaatcacttgacagtgtttgtttgaattgtgtttgttttttcctttgatgggcttaaaagaaattatccaaagggagaaagagcagtatgccacttcttaaaacagaacaaaacaaaaaaagaaaattgtgctctgttgtaatccaaaggggagatttgcagcatgcttgactttaccaattctgatgacatctttacggacactattatcactaagaccttgttatggcgaagtctttagtctttttcatgtattttcctcatgattttttctctttatgtagtttgagtatgccttacctttgtaaatatttttgcttgtgttgtcgcaaaggggataatctgggaaagacaccaaatcatgggctcactttaaaa

SEQ ID NO: 699 - DNA, 1600 bp, Homo sapiens
  ref <308>: DATABASE ACCESSION NUMBER: NM_001953
  ref <309>: DATABASE ENTRY DATE: 2001-06-18
gccccgccgccggcagtggaccgctgtgcgcgaaccctgaaccctacggtcccgacccgcgggcgaggccgggtacctgggctgggatccggagcaagcgggcgagggcagcgccctaagcaggcccggagcgatggcagccttgatgaccccgggaaccggggccccacccgcgcctggtgacttctccggggaagggagccagggacttcccgacccttcgccagagcccaagcagctcccggagctgatccgcatgaagcgagacggaggccgcctgagcgaagcggacatcaggggcttcgtggccgctgtggtgaatgggagcgcgcagggcgcacagatcggggccatgctgatggccatccgacttcggggcatggatctggaggagacctcggtgctgacccaggccctggctcagtcgggacagcagctggagtggccagaggcctggcgccagcagcttgtggacaagcattccacagggggtgtgggtgacaaggtcagcctggtcctcgcacctgccctggcggcatgtggctgcaaggtgccaatgatcagcggacgtggtctggggcacacaggaggcaccttggataagctggagtctattcctggattcaatgtcatccagagcccagagcagatgcaagtgctgctggaccaggcgggctgctgtatcgtgggtcagagtgagcagctggttcctgcggacggaatcctatatgcagccagagatgtgacagccaccgtggacagcctgccactcatcacagcctccattctcagtaagaaactcgtggaggggctgtccgctctggtggtggacgttaagttcggaggggccgccgtcttccccaaccaggagcaggcccgggagctggcaaagacgctggttggcgtgggagccagcctagggcttcgggtcgcggcagcgctgaccgccatggacaagcccctgggtcgctgcgtgggccacgccctggaggtggaggaggcgctgctctgcatggacggcgcaggcccgccagacttaagggacctggtcaccacgctcgggggcgccctgctctggctcagcggacacgcggggactcaggctcagggcgctgcccgggtggccgcggcgctggacgacggctcggcccttggccgcttcgagcggatgctggcggcgcagggcgtggatcccggtctggcccgagccctgtgctcgggaagtcccgcagaacgccggcagctgctgcctcgcgcccgggagcaggaggagctgctggcgcccgcagatggcaccgtggagctggtccgggcgctgccgctggcgctggtgctgcacgagctcggggccgggcgcagccgcgctggggagccgctccgcctgggggtgggcgcagagctgctggtcgacgtgggtcagaggctgcgccgtgggaccccctggctccgcgtgcaccgggacggccccgcgctcagcggcccgcagagccgcgccctgcaggaggcgctcgtactctccgaccgcgcgccattcgccgccccctcgcccttcgcagagctcgttctgccgccgcagcaataaagctcctttgccgcgaaa

SEQ ID NO: 700 - DNA, 3838 bp, Homo sapiens
  ref <308>: DATABASE ACCESSION NUMBER: NM_001954
  ref <309>: DATABASE ENTRY DATE: 2001-06-18
ggcttaggaagtattaactgatctctgccctagttctcatgtgttaaatatggatagtaatagtatctaccttatgaagtgactgtgaagataaaattatggattctgtttaagggtttaggccagtgtctggcacaggggaagcattctaaaaatatagctgatgctgttaaacaatgactgttgttgttgttttactgttattatccccaaagcggcccattctgtctgttgctgtcagctatgactcagtcccctgattaacttacgcaccacccattttatcccctgcagagatgctgcccccacccccttaggcccgagggatcaggagctatgggaccagaggccctgtcatctttactgctgctgctcttggtggcaagtggagatgctgacatgaagggacattttgatcctgccaagtgccgctatgccctgggcatgcaggaccggaccatcccagacagtgacatctctgcttccagctcctggtcagattccactgccgcccgccacagcaggttggagagcagtgacggggatggggcctggtgccccgcagggtcggtgtttcccaaggaggaggagtacttgcaggtggatctacaacgactgcacctggtggctctggtgggcacccagggacggcatgccgggggcctgggcaaggagttctcccggagctaccggctgcgttactcccgggatggtcgccgctggatgggctggaaggaccgctggggtcaggaggtgatctcaggcaatgaggaccctgagggagtggtgctgaaggaccttgggccccccatggttgcccgactggttcgcttctacccccgggctgaccgggtcatgagcgtctgtctgcgggtagagctctatggctgcctctggagggatggactcctgtcttacaccgcccctgtggggcagacaatgtatttatctgaggccgtgtacctcaacgactccacctatgacggacataccgtgggcggactgcagtatgggggtctgggccagctggcagatggtgtggtggggctggatgactttaggaagagtcaggagctgcgggtctggccaggctatgactatgtgggatggagcaaccacagcttctccagtggctatgtggagatggagtttgagtttgaccggctgagggccttccaggctatgcaggtccactgtaacaacatgcacacgctgggagcccgtctgcctggcggggtggaatgtcgcttccggcgtggccctgccatggcctgggagggggagcccatgcgccacaacctagggggcaacctgggggaccccagagcccgggctgtctcagtgccccttggcggccgtgtggctcgctttctgcagtgccgcttcctctttgcggggccctggttactcttcagcgaaatctccttcatctctgatgtggtgaacaattcctctccggcactgggaggcaccttcccgccagccccctggtggccgcctggcccacctcccaccaacttcagcagcttggagctggagcccagaggccagcagcccgtggccaaggccgaggggagcccgaccgccatcctcatcggctgcctggtggccatcatcctgctcctgctgctcatcattgccctcatgctctggcggctgcactggcgcaggctcctcagcgctgaacggagggtgttggaagaggagctgacggttcacctctctgtccctggggacactatcctcatcaacaaccgcccaggtcctagagagccacccccgtaccaggagccccggcctcgtgggaatccgccccactccgctccctgtgtccccaatggctctgcctacagtggggactatatggagcctgagaagccaggcgccccgcttctgcccccacctccccagaacagcgtcccccattatgccgaggctgacattgttaccctgcagggcgtcaccgggggcaacacctatgctgtgcctgcactgcccccaggggcagtcggggatgggccccccagagtggatttccctcgatctcgactccgcttcaaggagaagcttggcgagggccagtttggggaggtgcacctgtgtgaggtcgacagccctcaagatctggttagtcttgatttcccccttaatgtgcgtaagggacaccctttgctggtagctgtcaagatcttacggccagatgccaccaagaatgccaggaatgatttcctgaaagaggtgaagatcatgtcgaggctcaaggacccaaacatcattcggctgctgggcgtgtgtgtgcaggacgaccccctctgcatgattactgactacatggagaacggcgacctcaaccagttcctcagtgcccaccagctggaggacaaggcagccgagggggcccctggggacgggcaggctgcgcaggggcccaccatcagctacccaatgctgctgcatgtggcagcccagatcgcctccggcatgcgctatctggccacactcaactttgtacatcgggacctggccacgcggaactgcctagttggggaaaatttcaccatcaaaatcgcagactttggcatgagccggaacctctatgctggggactattaccgtgtgcagggccgggcagtgctgcccatccgctggatggcctgggagtgcatcctcatggggaagttcacgactgcgagtgacgtgtgggcctttggtgtgaccctgtgggaggtgctgatgctctgtagggcccagccctttgggcagctcaccgacgagcaggtcatcgagaacgcgggggagttcttccgggaccagggccggcaggtgtacctgtcccggccgcctgcctgcccgcagggcctatatgagctgatgcttcggtgctggagccgggagtctgagcagcgaccacccttttcccagctgcatcggttcctggcagaggatgcactcaacacggtgtgaatcacacatccagctgcccctccctcagggagcgatccaggggaagccagtgacactaaaacaagaggacacaatggcacctctgcccttcccctcccgacagcccatcacctctaatagaggcagtgagactgcaggtgggctgggcccacccagggagctgatgccccttctccccttcctggacacactctcatgtccccttcctgttcttccttcctagaagcccccctgtcgcccacccagctggtcctgtggatgggatcctctccaccctcctctagccatcccttggggaagggtggggagaaatataggatagacactggacatggcccattggagcacctgggccccactggacaacactgattcctggagaggtggctgcgcccccagcttctctctccctgtcacacactggaccccactggctgagaatctgggggtgaggaggacaagaaggagaggaaaatgtttccttgtgcctgctcctgtacttgtcctcagcttgggcttcttcctcctccatcacctgaaacactggacctgggggtagccccgccccagccctcagtcacccccacttcccacttgcagtcttgtagctagaacttctctaagcctatacgtttctgtggagtaaatattgggattggggggaaagagggagcaacggcccatagccttggggttggacatctctagtgtagctgccacattgatttttctataatcacttggggtttgtacatttttggggggagagacacagatttttacactaatatatggacctagcttgaggcaattttaatcccctgcactaggcaggtaataataaaggttgagttttccacaaaaaaaaaaaaaa

SEQ ID NO: 701 - DNA, 1251 bp, Homo sapiens
  ref <308>: DATABASE ACCESSION NUMBER: NM_001955
  ref <309>: DATABASE ENTRY DATE: 2001-06-18
ggagctgtttacccccactctaataggggttcaatataaaaagccggcagagagctgtccaagtcagacgcgcctctgcatctgcgccaggcgaacgggtcctgcgcctcctgcagtcccagctctccaccaccgccgcgtgcgcctgcagacgctccgctcgctgccttctctcctggcaggcgctgccttttctccccgttaaagggcacttgggctgaaggatcgctttgagatctgaggaacccgcagcgctttgagggacctgaagctgtttttcttcgttttcctttgggttcagtttgaacgggaggtttttgatccctttttttcagaatggattatttgctcatgattttctctctgctgtttgtggcttgccaaggagctccagaaacagcagtcttaggcgctgagctcagcgcggtgggtgagaacggcggggagaaacccactcccagtccaccctggcggctccgccggtccaagcgctgctcctgctcgtccctgatggataaagagtgtgtctacttctgccacctggacatcatttgggtcaacactcccgagcacgttgttccgtatggacttggaagccctaggtccaagagagccttggagaatttacttcccacaaaggcaacagaccgtgagaatagatgccaatgtgctagccaaaaagacaagaagtgctggaatttttgccaagcaggaaaagaactcagggctgaagacattatggagaaagactggaataatcataagaaaggaaaagactgttccaagcttgggaaaaagtgtatttatcagcagttagtgagaggaagaaaaatcagaagaagttcagaggaacacctaagacaaaccaggtcggagaccatgagaaacagcgtcaaatcatcttttcatgatcccaagctgaaaggcaagccctccagagagcgttatgtgacccacaaccgagcacattggtgacagacttcggggcctgtctgaagccatagcctccacggagagccctgtggccgactctgcactctccaccctggctgggatcagagcaggagcatcctctgctggttcctgactggcaaaggaccagcgtcctcgttcaaaacattccaagaaaggttaaggagttcccccaaccatcttcactggcttccatcagtggtaactgctttggtctcttctttcatctggggatgacaatggacctctcagcagaaacacacagtcacattcgaattc

SEQ ID NO: 702 - DNA, 1240 bp, Homo sapiens
  ref <308>: DATABASE ACCESSION NUMBER: NM_001956
  ref <309>: DATABASE ENTRY DATE: 2001-06-18
ccagcttaatagcaggacgctggcaacaggcactccctgctccagtccagcctggcgctccaccgccgctatggtctccgtgcctaccacctggtgctccgttgcgctagccctgctcgtggccctgcatgaagggaagggccaggctgctgccaccctggagcagccagcgtcctcatctcatgcccaaggcacccaccttcggcttcgccgttgctcctgcagctcctggctcgacaaggagtgcgtctacttctgccacttggacatcatctgggtgaacactcctgaacagacagctccttacggcctgggaaacccgccaagacgccggcgccgctccctgccaaggcgctgtcagtgctccagtgccagggaccccgcctgtgccaccttctgccttcgaaggccctggactgaagccggggcagtcccaagccggaagtcccctgcagacgtgttccagactggcaagacaggggccactacaggagagcttctccaaaggctgagggacatttccacagtcaagagcctctttgccaagcgacaacaggaggccatgcgggagcctcggtccacacattccaggtggaggaagagatagtgtcgtgagctggaggaacattgggaaggaagcccgcggggagagaggaggagagaagtggccagggcttgtggactctctgcctgcttcctggaccggggccttggtcccagacagctggacccatttgccaggattggcacaagctccctggtgagggagcctcgtccaaggcagttctgtgtcctcgcactgcccagggaagccctcggcctccagactgcggagcagcctccagtgctggctgctggcccacagctctgctggaagaactgcatggggagtacattcatctggaggctgcgtcctgaggagtgtcctgtctgctgggctacaaaccaggagcaaccgtgcagccacgaacacgcatgcctcagccagccctggagactggatggctcccctgaggctggcatcctggctggctgtgtcctctccagctttccctccccagagttcttgcaccctcattccctcgggaccctcccagtgagaagggcctgctctgcttttcctgtctgtatataacttatttgccctaagaactttgagaatcccaattatttattttaatgtattttttagaccctctatttacctgcgaacttgtgtttataataaatgaggaaacat

SEQ ID NO: 703 - DNA, 1755 bp, Homo sapiens
  ref <308>: DATABASE ACCESSION NUMBER: NM_001958
  ref <309>: DATABASE ENTRY DATE: 2001-06-18
cctcggctccggaatcactgcagcccccctcgccctgagccagagcaccccgggtcccgccagcccctcacactcccagcaaaatgggcaaggagaagacccacatcaacatcgtggtcatcggccacgtggactccggaaagtccaccaccacgggccacctcatctacaaatgcggaggtattgacaaaaggaccattgagaagttcgagaaggaggcggctgagatggggaagggatccttcaagtatgcctgggtgctggacaagctgaaggcggagcgtgagcgcggcatcaccatcgacatctccctctggaagttcgagaccaccaagtactacatcaccatcatcgatgcccccggccaccgcgacttcatcaagaacatgatcacgggtacatcccaggcggactgcgcagtgctgatcgtggcggcgggcgtgggcgagttcgaggcgggcatctccaagaatgggcagacgcgggagcatgccctgctggcctacacgctgggtgtgaagcagctcatcgtgggcgtgaacaaaatggactccacagagccggcctacagcgagaagcgctacgacgagatcgtcaaggaagtcagcgcctacatcaagaagatcggctacaacccggccaccgtgccctttgtgcccatctccggctggcacggcgacaacatgctggagccctcccccaacatgccgtggttcaagggctggaaggtggagcgtaaggagggcaacgcaagcggcgtgtccctgctggaggccctggacaccatcctgccccccacgcgccccacggacaagcccctgcgcctgccgctgcaggacgtgtacaagattggcggcattggcacggtgcccgtgggccgggtggagaccggcatcctgcggccgggcatggtggtgacctttgcgccagtgaacatcaccactgaggtgaagtcagtggagatgcaccacgaggctctgagcgaagctctgcccggcgacaacgtcggcttcaatgtgaagaacgtgtcggtgaaggacatccggcggggcaacgtgtgtggggacagcaagtctgacccgccgcaggaggctgctcagttcacctcccaggtcatcatcctgaaccacccggggcagattagcgccggctactccccggtcatcgactgccacacagcccacatcgcctgcaagtttgcggagctgaaggagaagattgaccggcgctctggcaagaagctggaggacaaccccaagtccctgaagtctggagacgcggccatcgtggagatggtgccgggaaagcccatgtgtgtggagagcttctcccagtacccgcctctcggccgcttcgccgtgcgcgacatgaggcagacggtggccgtaggcgtcatcaagaacgtggaaaagaagagcggcggcgccggcaaggtcaccaagtcggcgcagaaggcgcagaaggcgggcaagtgaagcgcgggccgcggcgcgaccctccccggcggcgccgcgctccgaaccccggcccggcccccgccccgcccccgccccgcgcgccgctccggcgccccgcacccccgccaggcgcatgtctgcacctccgcttgccagaggccctcggtcagcgactggatgctcgccatcaaggtccagtggaagttcttcaagaggaaaggcgcccccgccccaggcttccgcgcccagcgctcgccacgctcagtgcccgttttaccaataaactgagcgaccccag

SEQ ID NO: 704 - DNA, 991 bp, Homo sapiens
  ref <308>: DATABASE ACCESSION NUMBER: NM_001960
  ref <309>: DATABASE ENTRY DATE: 2001-06-18
gggatcagtcttcccgcgtccgccgattcctcctccttggtcgccgcgtccttggctggcgtcagaaaaatggctacaaacttcctagcacatgagaagatctggttcgacaagttcaaatatgacgacgcagaaaggagattctacgagcagatgaacgggcctgtgcgaggtgcctcccgccaggagaacggcgccacggtgatcctccgtgacattgcgagagccagagagaacatccagaaatccctggctggaagctcaggccccggggcctccagcggcaccagcggagaccacggtgagctcgtcgtccggattgccagtctggaagtggagaaccagagtctgcgtggcgtggtacaggagctgcagcaggccatctccaagctggaggcccggctgaacgtgctggagaagagctcgcctggccaccgggccacggccccacagacccagcacgtatctcccatgcgccaagtggagcccccagccaagaagccagccacaccagcagaggatgacgaggatgatgacattgacctgtttggcagtgacaatgaggaggaggacaaggaggcggcacagctgcgggaggagcggctacggcagtacgcggagaagaaggccaagaagcctgcactggtggccaagtcctccatcctgctggatgtcaagccttgggatgatgagacggacatggcccagctggaggcctgtgtgcgctctatccagctggacgggctggtctggggggcttccaagctggtgcccgtgggctacggtatccggaagctacagattcagtgtgtggtggaggacgacaaggtggggacagacttgctggaggaggagatcaccaagtttgaggagcacgtgcagagtgtcgatatcgcagctttcaacaagatctgaagcctgagtgtgtgtacgtgcgcgcgtgcgtgagggccctgccacgattaaagactgagaccggcaaaaaaaaaaa

SEQ ID NO: 705 - DNA, 3075 bp, Homo sapiens
  ref <308>: DATABASE ACCESSION NUMBER: NM_001961
  ref <309>: DATABASE ENTRY DATE: 2001-06-18
atggttaattttacggtggatcagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactgatacccggaaggacgagcaggagcgttgcatcaccatcaagtcaactgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtggtggtggactgcgtgtcaggcgtgtgcgtgcagacggagacagtgctgcggcaggccattgccgagcgcatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatgatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtactttgacccagccaacggcaagttcagcaagtcagccaccagccccgaagggaagaagctgccacgcaccttctgccagctgatcctggaccccatcttcaaggtgtttgatgcgatcatgaatttcaagaaagaggagacagcaaaactgatagagaaactggacatcaaactggacagcgaggacaaggacaaagaaggcaaacccctgctgaaggctgtgatgcgccgctggctgcctgccggagacgccttgttgcagatgatcaccatccacctgccctcccctgtgacggcccagaagtaccgctgcgagctcctgtacgaggggcccccggacgacgaggctgccatgggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagagaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcatatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctatgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcactcagctgtactagtgccattggaataataaatttgataaggtgtgaaaa

SEQ ID NO: 706 - DNA, 558 bp, Homo sapiens
  ref <308>: DATABASE ACCESSION NUMBER: NM_001970
  ref <309>: DATABASE ENTRY DATE: 2001-06-18
gaattccgtccgctcgcgcgagttggaatcgaagcctcttaaaatggcagatgacttggacttcgagacaggagatgcaggggcctcagccaccttcccaatgcagtgctcagcattacgtaagaatggctttgtggtgctcaaaggccggccatgtaagatcgtcgagatgtctacttcgaagactggcaagcacggccacgccaaggtccatctggttggtattgacatctttactgggaagaaatatgaagatatctgcccgtcaactcataatatggatgtccccaacatcaaaaggaatgacttccagctgattggcatccaggatgggtacctatcactgctccaggacagcggggaggtacgagaggaccttcgtctccctgagggagaccttggcaaggagattgagcagaagtacgactgtggagaagagatcctgatcacggtgctgtctgccatgacagaggaggcagctgttgcaatcaaggccatggcaaaataactggctcccagggtggcggtggtggcagcagtgatcctctgaacctgcag

SEQ ID NO: 707 - DNA, 2100 bp, Homo sapiens
  ref <308>: DATABASE ACCESSION NUMBER: NM_001979
  ref <309>: DATABASE ENTRY DATE: 2001-06-18
ggcacgagctctctctctctctctctctctctctcgccgccatgacgctgcgcggcgccgtcttcgaccttgacggggtgctggcgctgccagcggtgttcggcgtcctcggccgcacggaggaggccctggcgctgcccagaggacttctgaatgatgctttccagaaagggggaccagagggtgccactacccggcttatgaaaggagagatcacactttcccagtggataccactcatggaagaaaactgcaggaagtgctccgagaccgctaaagtctgcctccccaagaatttctccataaaagaaatctttgacaaggcgatttcagccagaaagatcaaccgccccatgctccaggcagctctcatgctcaggaagaaaggattcactactgccatcctcaccaacacctggctggacgaccgtgctgagagagatggcctggcccagctgatgtgtgagctgaagatgcactttgacttcctgatagagtcgtgtcaggtgggaatggtcaaacctgaacctcagatctacaagtttctgctggacaccctgaaggccagccccagtgaggtcgtttttttggatgacatcggggctaatctgaagccagcccgtgacttgggaatggtcaccatcctggtccaggacactgacacggccctgaaagaactggagaaagtgaccggaatccagcttctcaataccccggcccctctgccgacctcttgcaatccaagtgacatgagccatgggtacgtgacagtaaagcccagggtccgtctgcattttgtggagctgggctggcctgctgtgtgcctctgccatggatttcccgagagttggtattcttggaggtaccagatccctgctctggcccaggcaggttaccgggtcctagctatggacatgaaaggctatggagagtcatctgctcctcccgaaatagaagaatattgcatggaagtgttatgtaaggagatggtaaccttcctggataaactgggcctctctcaagcagtgttcattggccatgactggggtggcatgctggtgtggtacatggctctcttctaccccgagagagtgagggcggtggccagtttgaatactcccttcataccagcaaatcccaacatgtcccctttggagagtatcaaagccaacccagtatttgattaccagctctacttccaagaaccaggagtggctgaggctgaactggaacagaacctgagtcggactttcaaaagcctcttcagagcaagcgatgagagtgttttatccatgcataaagtctgtgaagcgggaggactttttgtaaatagcccagaagagcccagcctcagcaggatggtcactgaggaggaaatccagttctatgtgcagcagttcaagaagtctggtttcagaggtcctctaaactggtaccgaaacatggaaaggaactggaagtgggcttgcaaaagcttgggacggaagatcctgattccggccctgatggtcacggcggagaaggacttcgtgctcgttcctcagatgtcccagcacatggaggactggattccccacctgaaaaggggacacattgaggactgtgggcactggacacagatggacaagccaaccgaggtgaatcagatcctcattaagtggctggattctgatgcccggaacccaccggtggtctcaaagatgtagaacgcagcgtagtgcccacgctcagcaggtgtgccatccttccacctgctggggcaccattcttagtatacagaggtggccttacacacatcttgcatggatggcagcattgttctgaaggggtttgcagaaaaaaaagattttctttacataaagtgaatcaaatttgacattattttagatcccagagaaatcaggtgtgattagttctccaggcatgaatgcatcgtccctttatctgtaagaacccttagtgtcctgtagggggacagaatggggtggccaggtggtgatttctctttgaccaatgcatagtttggcagaaaaatcagccgttcatttagaagaatcttagcagagattgggatgccttactcaataaagctaagatgac

SEQ ID NO: 708 - DNA, 4975 bp, Homo sapiens
  ref <308>: DATABASE ACCESSION NUMBER: NM_001982
  ref <309>: DATABASE ENTRY DATE: 2001-06-18
ctctcacacacacacacccctcccctgccatccctccccggactccggctccggctccgattgcaatttgcaacctccgctgccgtcgccgcagcagccaccaattcgccagcggttcaggtggctcttgcctcgatgtcctagcctaggggcccccgggccggacttggctgggctcccttcaccctctgcggagtcatgagggcgaacgacgctctgcaggtgctgggcttgcttttcagcctggcccggggctccgaggtgggcaactctcaggcagtgtgtcctgggactctgaatggcctgagtgtgaccggcgatgctgagaaccaataccagacactgtacaagctctacgagaggtgtgaggtggtgatggggaaccttgagattgtgctcacgggacacaatgccgacctctccttcctgcagtggattcgagaagtgacaggctatgtcctcgtggccatgaatgaattctctactctaccattgcccaacctccgcgtggtgcgagggacccaggtctacgatgggaagtttgccatcttcgtcatgttgaactataacaccaactccagccacgctctgcgccagctccgcttgactcagctcaccgagattctgtcagggggtgtttatattgagaagaacgataagctttgtcacatggacacaattgactggagggacatcgtgagggaccgagatgctgagatagtggtgaaggacaatggcagaagctgtcccccctgtcatgaggtttgcaaggggcgatgctggggtcctggatcagaagactgccagacattgaccaagaccatctgtgctcctcagtgtaatggtcactgctttgggcccaaccccaaccagtgctgccatgatgagtgtgccgggggctgctcaggccctcaggacacagactgctttgcctgccggcacttcaatgacagtggagcctgtgtacctcgctgtccacagcctcttgtctacaacaagctaactttccagctggaacccaatccccacaccaagtatcagtatggaggagtttgtgtagccagctgtccccataactttgtggtggatcaaacatcctgtgtcagggcctgtcctcctgacaagatggaagtagataaaaatgggctcaagatgtgtgagccttgtgggggactatgtcccaaagcctgtgagggaacaggctctgggagccgcttccagactgtggactcgagcaacattgatggatttgtgaactgcaccaagatcctgggcaacctggactttctgatcaccggcctcaatggagacccctggcacaagatccctgccctggacccagagaagctcaatgtcttccggacagtacgggagatcacaggttacctgaacatccagtcctggccgccccacatgcacaacttcagtgttttttccaatttgacaaccattggaggcagaagcctctacaaccggggcttctcattgttgatcatgaagaacttgaatgtcacatctctgggcttccgatccctgaaggaaattagtgctgggcgtatctatataagtgccaataggcagctctgctaccaccactctttgaactggaccaaggtgcttcgggggcctacggaagagcgactagacatcaagcataatcggccgcgcagagactgcgtggcagagggcaaagtgtgtgacccactgtgctcctctgggggatgctggggcccaggccctggtcagtgcttgtcctgtcgaaattatagccgaggaggtgtctgtgtgacccactgcaactttctgaatggggagcctcgagaatttgcccatgaggccgaatgcttctcctgccacccggaatgccaacccatggggggcactgccacatgcaatggctcgggctctgatacttgtgctcaatgtgcccattttcgagatgggccccactgtgtgagcagctgcccccatggagtcctaggtgccaagggcccaatctacaagtacccagatgttcagaatgaatgtcggccctgccatgagaactgcacccaggggtgtaaaggaccagagcttcaagactgtttaggacaaacactggtgctgatcggcaaaacccatctgacaatggctttgacagtgatagcaggattggtagtgattttcatgatgctgggcggcacttttctctactggcgtgggcgccggattcagaataaaagggctatgaggcgatacttggaacggggtgagagcatagagcctctggaccccagtgagaaggctaacaaagtcttggccagaatcttcaaagagacagagctaaggaagcttaaagtgcttggctcgggtgtctttggaactgtgcacaaaggagtgtggatccctgagggtgaatcaatcaagattccagtctgcattaaagtcattgaggacaagagtggacggcagagttttcaagctgtgacagatcatatgctggccattggcagcctggaccatgcccacattgtaaggctgctgggactatgcccagggtcatctctgcagcttgtcactcaatatttgcctctgggttctctgctggatcatgtgagacaacaccggggggcactggggccacagctgctgctcaactggggagtacaaattgccaagggaatgtactaccttgaggaacatggtatggtgcatagaaacctggctgcccgaaacgtgctactcaagtcacccagtcaggttcaggtggcagattttggtgtggctgacctgctgcctcctgatgataagcagctgctatacagtgaggccaagactccaattaagtggatggcccttgagagtatccactttgggaaatacacacaccagagtgatgtctggagctatggtgtgacagtttgggagttgatgaccttcggggcagagccctatgcagggctacgattggctgaagtaccagacctgctagagaagggggagcggttggcacagccccagatctgcacaattgatgtctacatggtgatggtcaagtgttggatgattgatgagaacattcgcccaacctttaaagaactagccaatgagttcaccaggatggcccgagacccaccacggtatctggtcataaagagagagagtgggcctggaatagcccctgggccagagccccatggtctgacaaacaagaagctagaggaagtagagctggagccagaactagacctagacctagacttggaagcagaggaggacaacctggcaaccaccacactgggctccgccctcagcctaccagttggaacacttaatcggccacgtgggagccagagccttttaagtccatcatctggatacatgcccatgaaccagggtaatcttggggggtcttgccaggagtctgcagtttctgggagcagtgaacggtgcccccgtccagtctctctacacccaatgccacggggatgcctggcatcagagtcatcagaggggcatgtaacaggctctgaggctgagctccaggagaaagtgtcaatgtgtagaagccggagcaggagccggagcccacggccacgcggagatagcgcctaccattcccagcgccacagtctgctgactcctgttaccccactctccccacccgggttagaggaagaggatgtcaacggttatgtcatgccagatacacacctcaaaggtactccctcctcccgggaaggcaccctttcttcagtgggtctcagttctgtcctgggtactgaagaagaagatgaagatgaggagtatgaatacatgaaccggaggagaaggcacagtccacctcatccccctaggccaagttcccttgaggagctgggttatgagtacatggatgtggggtcagacctcagtgcctctctgggcagcacacagagttgcccactccaccctgtacccatcatgcccactgcaggcacaactccagatgaagactatgaatatatgaatcggcaacgagatggaggtggtcctgggggtgattatgcagccatgggggcctgcccagcatctgagcaagggtatgaagagatgagagcttttcaggggcctggacatcaggccccccatgtccattatgcccgcctaaaaactctacgtagcttagaggctacagactctgcctttgataaccctgattactggcatagcaggcttttccccaaggctaatgcccagagaacgtaactcctgctccctgtggcactcagggagcatttaatggcagctagtgcctttagagggtaccgtcttctccctattccctctctctcccaggtcccagccccttttccccagtcccagacaattccattcaatctttggaggcttttaaacattttgacacaaaattcttatggtatgtagccagctgtgcactttcttctctttcccaaccccaggaaaggttttccttattttgtgtgctttcccagtcccattcctcagcttcttcacaggcactcctggagatatgaaggattactctccatatcccttcctctcaggctcttgactacttggaactaggctcttatgtgtgcctttgtttcccatcagactgtcaagaagaggaaagggaggaaacctagcagaggaaagtgtaattttggtttatgactcttaaccccctagaaagacagaagcttaaaatctgtgaagaaagaggttaggagtagatattgattactatcataattcagcacttaactatgagccaggcatcatactaaacttcacctacattatctcacttagtcctttatcatccttaaaacaattctgtgacatacatattatctcattttacacaaagggaagtcgggcatggtggctcatgcctgtaatctcagcactttgggaggctgaggcagaaggattacctgaggcaaggagtttgagaccagcttagccaacatagtaagacccccatctc

SEQ ID NO: 709 - DNA, 852 bp, Homo sapiens
  ref <308>: DATABASE ACCESSION NUMBER: NM_001985
  ref <309>: DATABASE ENTRY DATE: 2001-06-18
caccctgtaagtggctgcggcgggaagatggcggagctgcgcgtgctcgtagctgtcaagagggtcatcgactacgccgtgaagatccgagtgaagcctgacaggaccggtgtggtcacggatggtgtgaagcactccatgaaccccttctgtgagatcgcggtggaggaggctgtgcggctcaaggagaagaagctggtgaaggaggtcatcgccgtcagctgtgggcctgcacagtgccaggagacgattcgtaccgccctggccatgggtgcagaccgaggtatccacgtggaggtgcccccagcagaagcagaacgcttgggtcccctgcaggtggctcgggtcctggccaagctggcagagaaggagaaggtggacctggtgctgctgggcaaacaggccatcgatgatgactgtaaccagacagggcagatgacagctggatttcttgactggccacagggcacattcgcctcccaggtgacgctggagggggacaagttgaaagtggagcgggagatcgatgggggcctggagaccctgcgcctgaagctgccagctgtggtgacagctgacctgaggctcaacgagccccgctacgccacgctgcccaacatcatgaaagccaagaagaagaagatcgaggtgatcaagcctggggacctgggtgtggacctgacctccaagctctctgtgatcagtgtggaggacccgccccagcgcacggccggcgtcaaggtggagaccactgaggacctggtggccaagctgaaggagattgggcggatttgagcccctcccagagatggcaataaaactgactctcaacatcaaaaaaaaaaaaaaaaa

SEQ ID NO: 710 - DNA, 2957 bp, Homo sapiens
  ref <308>: DATABASE ACCESSION NUMBER: NM_002017
  ref <309>: DATABASE ENTRY DATE: 2001-06-18
gaattcccaaacgtgcacaggggagtgagggcagggcgctcgcagggggcacgcagggagggcccagggcgccagggaggccgcgccgggctaatccgaaggggctgcgaggtcaggctgtaaccgggtcaatgtgtggaatattggggggctcggctgcagacttggccaaatggacgggactattaaggaggctctgtcggtggtgagcgacgaccagtccctctttgactcagcgtacggagcggcagcccatctccccaaggccgacatgactgcctcggggagtcctgactacgggcagccccacaagatcaaccccctcccaccacagcaggagtggatcaatcagccagtgagggtcaacgtcaagcgggagtatgaccacatgaatggatccagggagtctccggtggactgcagcgttagcaaatgcagcaagctggtgggcggaggcgagtccaaccccatgaactacaacagctatatggacgagaagaatggcccccctcctcccaacatgaccaccaacgagaggagagtcatcgtccccgcagaccccacactgtggacacaggagcatgtgaggcaatggctggagtgggccataaaggagtacagcttgatggagatcgacacatcctttttccagaacatggatggcaaggaactgtgtaaaatgaacaaggaggacttcctccgcgccaccaccctctacaacacggaagtgctgttgtcacacctcagttacctcagggaaagttcactgctggcctataatacaacctcccacaccgaccaatcctcacgattgagtgtcaaagaagacccttcttatgactcagtcagaagaggagcttggggcaataacatgaattctggcctcaacaaaagtcctccccttggaggggcacaaacgatcagtaagaatacagagcaacggccccagccagatccgtatcagatcctgggcccgaccagcagtcgcctagccaaccctggaagcgggcagatccagctgtggcaattcctcctggagctgctctccgacagcgccaacgccagctgtatcacctgggaggggaccaacggggagttcaaaatgacggaccccgatgaggtggccaggcgctggggcgagcggaaaagcaagcccaacatgaattacgacaagctgagccgggccctccgttattactatgataaaaacattatgaccaaagtgcacggcaaaagatatgcttacaaatttgacttccacggcattgcccaggctctgcagccacatccgaccgagtcgtccatgtacaagtacccttctgacatctcctacatgccttcctaccatgcccaccagcagaaggtgaactttgtccctccccatccatcctccatgcctgtcacttcctccagcttctttggagccgcatcacaatactggacctcccccacggggggaatctaccccaaccccaacgtcccccgccatcctaacacccacgtgccttcacacttaggcagctactactagaagcttcttctagctgaagcccatcctgcacacttactggatgctttggactcaacaggacatatgtggccttgaagggaagacaaaactggatgttctttcttgttggatagaacctttgtatttgttctttaaaaacattttttttaatgttggtaacttttgcttcctctacctgaacaaagagatgaataattccatgggccagtatgccagtttgaattctcagtctcctagcatcttgtgagttgcatattaagattactggaatggttaagtcatggttctgagaaagaagctgtacgttttctttatgtttttatgaccaaagcagtttcttgtcaatacacggggttcagtatgacacagaatcatggacttaacccgtcatgttctggtttgagatttagtgacaaatagaggtgggaagcttataatctaattttaggaggaccaaattcagcggatggcaactggaacattgattgtaaggccagtgaagttttcacccaactggaatttgatggaaagaaggtttgtgtgtttaagacgccaagggcattgcagaatccctctcagtggacagtatgcactcagctgaccactctctctagaaatagtcaagatatgaactaagaaattttaatgcaaatacatacattcctgaaagacggggaattaaattactaattttttttttttaaatgatgacagtggtcccagaacttggaaaagttgtagggatttctaaactcaagcagattcgcaagtgctgtgcgcttgtcagaccatcagaccagggccaaccaatcagaaggcaacttactgtataaattatgcagagttattttcctatatctcacagtattaaaaaataaataattaaaaattaagaataaataaacgagttgacctcggtcacaaaagcagttttactatcgaatcaatcgctgttatttttttttaatgtaatttgtacatcttttttcaatctgtacatttgggctgtcttgtatgtttttatgctcctttttaaaaagcataatatgcctatagctgaaaaggaaacagggctgtttaagtcactgacttatgagaaagcaaagcactggtacagttatttaacaggcatacacaagcagggaaaagataatccatttagatctttaatgctttggaaatgcgtgtaacagtactgcaataatcacagctctgggaaaaacaacgaaactttcccttgtggagaggagggattttcctgctctatataagcaacatatttttagacattaaaatatatataattttgcaggtaattgttgacttttttaactatattaagtgttaagctgacaactgtcaaagaagaccatgttgtaaaataatttgactaaataaatggttccttctctcaaaaaaaaaaaaa

SEQ ID NO: 711 - DNA, 7680 bp, Homo sapiens
  ref <308>: DATABASE ACCESSION NUMBER: NM_002019
  ref <309>: DATABASE ENTRY DATE: 2001-06-18
gcggacactcctctcggctcctccccggcagcggcggcggctcggagcgggctccggggctcgggtgcagcggccagcgggcctggcggcgaggattacccggggaagtggttgtctcctggctggagccgcgagacgggcgctcagggcgcggggccggcggcggcgaacgagaggacggactctggcggccgggtcgttggccgggggagcgcgggcaccgggcgagcaggccgcgtcgcgctcaccatggtcagctactgggacaccggggtcctgctgtgcgcgctgctcagctgtctgcttctcacaggatctagttcaggttcaaaattaaaagatcctgaactgagtttaaaaggcacccagcacatcatgcaagcaggccagacactgcatctccaatgcaggggggaagcagcccataaatggtctttgcctgaaatggtgagtaaggaaagcgaaaggctgagcataactaaatctgcctgtggaagaaatggcaaacaattctgcagtactttaaccttgaacacagctcaagcaaaccacactggcttctacagctgcaaatatctagctgtacctacttcaaagaagaaggaaacagaatctgcaatctatatatttattagtgatacaggtagacctttcgtagagatgtacagtgaaatccccgaaattatacacatgactgaaggaagggagctcgtcattccctgccgggttacgtcacctaacatcactgttactttaaaaaagtttccacttgacactttgatccctgatggaaaacgcataatctgggacagtagaaagggcttcatcatatcaaatgcaacgtacaaagaaatagggcttctgacctgtgaagcaacagtcaatgggcatttgtataagacaaactatctcacacatcgacaaaccaatacaatcatagatgtccaaataagcacaccacgcccagtcaaattacttagaggccatactcttgtcctcaattgtactgctaccactcccttgaacacgagagttcaaatgacctggagttaccctgatgaaaaaaataagagagcttccgtaaggcgacgaattgaccaaagcaattcccatgccaacatattctacagtgttcttactattgacaaaatgcagaacaaagacaaaggactttatacttgtcgtgtaaggagtggaccatcattcaaatctgttaacacctcagtgcatatatatgataaagcattcatcactgtgaaacatcgaaaacagcaggtgcttgaaaccgtagctggcaagcggtcttaccggctctctatgaaagtgaaggcatttccctcgccggaagttgtatggttaaaagatgggttacctgcgactgagaaatctgctcgctatttgactcgtggctactcgttaattatcaaggacgtaactgaagaggatgcagggaattatacaatcttgctgagcataaaacagtcaaatgtgtttaaaaacctcactgccactctaattgtcaatgtgaaaccccagatttacgaaaaggccgtgtcatcgtttccagacccggctctctacccactgggcagcagacaaatcctgacttgtaccgcatatggtatccctcaacctacaatcaagtggttctggcacccctgtaaccataatcattccgaagcaaggtgtgacttttgttccaataatgaagagtcctttatcctggatgctgacagcaacatgggaaacagaattgagagcatcactcagcgcatggcaataatagaaggaaagaataagatggctagcaccttggttgtggctgactctagaatttctggaatctacatttgcatagcttccaataaagttgggactgtgggaagaaacataagcttttatatcacagatgtgccaaatgggtttcatgttaacttggaaaaaatgccgacggaaggagaggacctgaaactgtcttgcacagttaacaagttcttatacagagacgttacttggattttactgcggacagttaataacagaacaatgcactacagtattagcaagcaaaaaatggccatcactaaggagcactccatcactcttaatcttaccatcatgaatgtttccctgcaagattcaggcacctatgcctgcagagccaggaatgtatacacaggggaagaaatcctccagaagaaagaaattacaatcagagatcaggaagcaccatacctcctgcgaaacctcagtgatcacacagtggccatcagcagttccaccactttagactgtcatgctaatggtgtccccgagcctcagatcacttggtttaaaaacaaccacaaaatacaacaagagcctggaattattttaggaccaggaagcagcacgctgtttattgaaagagtcacagaagaggatgaaggtgtctatcactgcaaagccaccaaccagaagggctctgtggaaagttcagcatacctcactgttcaaggaacctcggacaagtctaatctggagctgatcactctaacatgcacctgtgtggctgcgactctcttctggctcctattaaccctccttatccgaaaaatgaaaaggtcttcttctgaaataaagactgactacctatcaattataatggacccagatgaagttcctttggatgagcagtgtgagcggctcccttatgatgccagcaagtgggagtttgcccgggagagacttaaactgggcaaatcacttggaagaggggcttttggaaaagtggttcaagcatcagcatttggcattaagaaatcacctacgtgccggactgtggctgtgaaaatgctgaaagagggggccacggccagcgagtacaaagctctgatgactgagctaaaaatcttgacccacattggccaccatctgaacgtggttaacctgctgggagcctgcaccaagcaaggagggcctctgatggtgattgttgaatactgcaaatatggaaatctctccaactacctcaagagcaaacgtgacttattttttctcaacaaggatgcagcactacacatggagcctaagaaagaaaaaatggagccaggcctggaacaaggcaagaaaccaagactagatagcgtcaccagcagcgaaagctttgcgagctccggctttcaggaagataaaagtctgagtgatgttgaggaagaggaggattctgacggtttctacaaggagcccatcactatggaagatctgatttcttacagttttcaagtggccagaggcatggagttcctgtcttccagaaagtgcattcatcgggacctggcagcgagaaacattcttttatctgagaacaacgtggtgaagatttgtgattttggccttgcccgggatatttataagaaccccgattatgtgagaaaaggagatactcgacttcctctgaaatggatggctcccgaatctatctttgacaaaatctacagcaccaagagcgacgtgtggtcttacggagtattgctgtgggaaatcttctccttaggtgggtctccatacccaggagtacaaatggatgaggacttttgcagtcgcctgagggaaggcatgaggatgagagctcctgagtactctactcctgaaatctatcagatcatgctggactgctggcacagagacccaaaagaaaggccaagatttgcagaacttgtggaaaaactaggtgatttgcttcaagcaaatgtacaacaggatggtaaagactacatcccaatcaatgccatactgacaggaaatagtgggtttacatactcaactcctgccttctctgaggacttcttcaaggaaagtatttcagctccgaagtttaattcaggaagctctgatgatgtcagatatgtaaatgctttcaagttcatgagcctggaaagaatcaaaacctttgaagaacttttaccgaatgccacctccatgtttgatgactaccagggcgacagcagcactctgttggcctctcccatgctgaagcgcttcacctggactgacagcaaacccaaggcctcgctcaagattgacttgagagtaaccagtaaaagtaaggagtcggggctgtctgatgtcagcaggcccagtttctgccattccagctgtgggcacgtcagcgaaggcaagcgcaggttcacctacgaccacgctgagctggaaaggaaaatcgcgtgctgctccccgcccccagactacaactcggtggtcctgtactccaccccacccatctagagtttgacacgaagccttatttctagaagcacatgtgtatttatacccccaggaaactagcttttgccagtattatgcatatataagtttacacctttatctttccatgggagccagctgctttttgtgatttttttaatagtgctttttttttttgactaacaagaatgtaactccagatagagaaatagtgacaagtgaagaacactactgctaaatcctcatgttactcagtgttagagaaatccttcctaaacccaatgacttccctgctccaacccccgccacctcagggcacgcaggaccagtttgattgaggagctgcactgatcacccaatgcatcacgtaccccactgggccagccctgcagcccaaaacccagggcaacaagcccgttagccccaggggatcactggctggcctgagcaacatctcgggagtcctctagcaggcctaagacatgtgaggaggaaaaggaaaaaaagcaaaaagcaagggagaaaagagaaaccgggagaaggcatgagaaagaatttgagacgcaccatgtgggcacggagggggacggggctcagcaatgccatttcagtggcttcccagctctgacccttctacatttgagggcccagccaggagcagatggacagcgatgaggggacattttctggattctgggaggcaagaaaaggacaaatatcttttttggaactaaagcaaattttagacctttacctatggaagtggttctatgtccattctcattcgtggcatgttttgatttgtagcactgagggtggcactcaactctgagcccatacttttggctcctctagtaagatgcactgaaaacttagccagagttaggttgtctccaggccatgatggccttacactgaaaatgtcacattctattttgggtattaatatatagtccagacacttaactcaatttcttggtattattctgttttgcacagttagttgtgaaagaaagctgagaagaatgaaaatgcagtcctgaggagagttttctccatatcaaaacgagggctgatggaggaaaaaggtcaataaggtcaagggaagaccccgtctctataccaaccaaaccaattcaccaacacagttgggacccaaaacacaggaagtcagtcacgtttccttttcatttaatggggattccactatctcacactaatctgaaaggatgtggaagagcattagctggcgcatattaagcactttaagctccttgagtaaaaaggtggtatgtaatttatgcaaggtatttctccagttgggactcaggatattagttaatgagccatcactagaagaaaagcccattttcaactgctttgaaacttgcctggggtctgagcatgatgggaatagggagacagggtaggaaagggcgcctactcttcagggtctaaagatcaagtgggccttggatcgctaagctggctctgtttgatgctatttatgcaagttagggtctatgtatttaggatgcgcctactcttcagggtctaaagatcaagtgggccttggatcgctaagctggctctgtttgatgctatttatgcaagttagggtctatgtatttaggatgtctgcaccttctgcagccagtcagaagctggagaggcaacagtggattgctgcttcttggggagaagagtatgcttccttttatccatgtaatttaactgtagaacctgagctctaagtaaccgaagaatgtatgcctctgttcttatgtgccacatccttgtttaaaggctctctgtatgaagagatgggaccgtcatcagcacattccctagtgagcctactggctcctggcagcggcttttgtggaagactcactagccagaagagaggagtgggacagtcctctccaccaagatctaaatccaaacaaaagcaggctagagccagaagagaggacaaatctttgttgttcctcttctttacacatacgcaaaccacctgtgacagctggcaattttataaatcaggtaactggaaggaggttaaactcagaaaaaagaagacctcagtcaattctctacttttttttttttttttccaaatcagataatagcccagcaaatagtgataacaaataaaaccttagctgttcatgtcttgatttcaataattaattcttaatcattaagagaccataataaatactccttttcaagagaaaagcaaaaccattagaattgttactcagctccttcaaactcaggtttgtagcatacatgagtccatccatcagtcaaagaatggttccatctggagtcttaatgtagaaagaaaaatggagacttgtaataatgagctagttacaaagtgcttgttcattaaaatagcactgaaaattgaaacatgaattaactgataatattccaatcatttgccatttatgacaaaaatggttggcactaacaaagaacgagcacttcctttcagagtttctgagataatgtacgtggaacagtctgggtggaatggggctgaaaccatgtgcaagtctgtgtcttgtcagtccaagaagtgacaccgagatgttaattttagggacccgtgccttgtttcctagcccacaagaatgcaaacatcaaacagatactcgctagcctcatttaaattgattaaaggaggagtgcatctttggccgacagtggtgtaactgtgtgtgtgtgtgtgtgtgtgtgtgtgtgtgtgtgtgtgtgggtgtgggtgtatgtgtgttttgtgcataactatttaaggaaactggaattttaaagttacttttatacaaaccaagaatatatgctacagatataagacagacatggtttggtcctatatttctagtcatgatgaatgtattttgtataccatcttcatataatatacttaaaaatatttcttaattgggatttgtaatcgtaccaacttaattgataaacttggcaactgcttttatgttctgtctccttccataaatttttcaaaatactaattcaacaaagaaaaagctcttttttttcctaaaataaactcaaatttatccttgtttagagcagagaaaaattaagaaaaactttgaaatggtctcaaaaaattgctaaatattttcaatggaaaactaaatgttagtttagctgattgtatggggttttcgaacctttcactttttgtttgttttacctatttcacaactgtgtaaattgccaataattcctgtccatgaaaatgcaaattatccagtgtagatatatttgaccatcaccctatggatattggctagttttgcctttattaagcaaattcatttcagcctgaatgtctgcctatatattctctgctctttgtattctcctttgaacccgttaaaacatcctgtggcactc

SEQ ID NO: 712 - DNA, 2863 bp, Homo sapiens
  ref <308>: DATABASE ACCESSION NUMBER: NM_002023
  ref <309>: DATABASE ENTRY DATE: 2001-06-18
cggaattcaagaaacacaaaatgcagtgggcgtccctcctgctgctggcagggctcttctccctctcccaggcccagtatgaagatgaccctcattggtggttccactacctccgcagccagcagtccacctactacgatccctatgacccttacccgtatgagacctacgagccttacccctatggggtggatgaagggccagcctacacctacggctctccatcccctccagatccccgcgactgcccccaggaatgcgactgcccacccaacttcctcacggccatgtactgtgacaatcgcaacctcaagtacctgcccttcgttccctcccgcatgaagtatgtgtacttccagaacaaccagatcacctccatccaggaaggcgtctttgacaatgccacagggctgctctggattgctctccacggcaaccagatcaccagtgataaggtgggcaggaaggtcttctccaagctgaggcacctggagaggctgtacctggaccacaacaacctgacccggatgcccggtcccctgcctcgatccctgagagagctccatctcgaccacaaccagatctcacgggtccccaacaatgctctggaggggctggagaacctcacggccttgtacctccaacacgatgagatccaggaagtgggcagttccatgaggggcctccggtcactgatcttgctggacctgagttataaccaccttcggaaggtgcctgatgggctgccctcagctcttgagcagctgtacatggagcacaacaatgtctacaccgtccccgatagctacttccggggggcgcccaagctgctgtatgtgcggctgtcccacaacagtctaaccaacaatggcctggcctccaacaccttcaattccagcagcctccttgagctagacctctcctacaaccagctgcagaagatccccccagtcaacaccaacctggagaacctctacctccaaggcaataggatcaatgagttctccatcagcagcttctgcaccgtggtggacgtcgtgaacttctccaagctgcaggtcgtgcgcctggacgggaacgagatcaagcgcagcgccatgcctgccgacgcgcccctctgcctgcgccttgccagcctcatcgagatctgagcagccctggcaccgggtactgggcggagagcccccgtggcatttggcttgatggtttggtttggcttatggaagatctgggacagaccgtgtgacagaagtccacgggcaccctctgtagtcttctttcctgtaggtggggttagggggggcgatcagggacaggcagccttctgctgaggacataggcagaagctcactcttttccagggacagaagtggtggtagatggaaggatccctggatgttccaaccccataaatctcacggctcttaagttcttcccaatgatctgaggtcatggaacttcaaaagtggcatgggcaatagtatataaccatacttttctaacaatccctggctgtctgtgagcagcacttgacagctctccctctgtgctgggctggtcgtgcagttactctgggctcccatttgttgcttctcaaaatatacctcttgcccagctgcctcttctgaaatccacttcacccactccactttcctccacagatgcctcttctgtgccttaagcagagtcaggagaccccaaggcatgtgagcatctgcccagcaacctgtggagacaacccacactgtgtctgagggtgaaaggacaccaggagtcacttctatacctccctaacctcacccctggaaagccaccagattggaggtcaccagcatgatgataatattcatgacctgatgtgggaggagacagccaacctcaggcttagatcaatgtatagggctatattttggcagctgggtagctctttgaaggtggataagacttcagaagaggaaaggccagactttgcttaccatcagcatctgcaatgggccaaacacacctcaaattggctgagttgagaaagcagccccagtagttccattcttgcccagcactttctgcattccaaacagcatcctacctgggtttttatccacaaaggtagcggccacatggtttttaaagtatgagaaacacagtttgtcctctccttttatccaagcaggaagattctatatcctgatggtagagacagactccaggcagccctggacttgctagcccaaagaaggaggatgtggttaatctgtttcacctggtttgtcctaaggccatagttaaaaagtaccagctctggctggggtccgtgaagcccaggccaggcagccaaatcttgcctgtgctgggcatacaaccctctgctttcacatctctgagctatatcctcattagtgaaggtggcttttgctttatagtttggctggggagcacttaattcttcccatttcaaaaggtaatgttgcctggggcttaacccacctgccctttgggcaaggttgggacaaagccatctgggcagtcaggggcaaggactgttggaggagagttagcccaagtataggctctgcccagatgccatcacatccctgatactgtgtatgctttgaagcaccttccctgagaagggaagaggggatctttggactacgttcttggctccagacctggaatccacaaaagccaaaccagctcatttcaacaaaggagctccgatgtgaggggcaaggctgccccctgccccagggctcttcagaaagcatctgcatgtgaacaccatcatgcctttataaaggatccttattacaggaaaagcatgagtggtggctaacctgaccaataaagttattttatgattgcc

SEQ ID NO: 713 - DNA, 2861 bp, Homo sapiens
  ref <308>: DATABASE ACCESSION NUMBER: NM_002033
  ref <309>: DATABASE ENTRY DATE: 2001-06-18
ctgctcctgcgcggcagctgctttagaaggtctcgagcctcctgtaccttcccagggatgaaccgggccttccctctggaaggcgagggttcgggccacagtgagcgagggccagggcggtgggcgcgcgcagagggaaaccggatcagttgagagagaatcaagagtagcggatgaggcgcttgtggggcgcggcccggaagccctcgggcgcgggctgggagaaggagtgggcggaggcgccgcaggaggctcccggggcctggtcgggccggctgggccccgggcgcagtggaagaaagggacgggcggtgcccggttgggcgtcctggccagctcaccttgccctggcggctcgccccgcccggcacttgggaggagcagggcagggcccgcggcctttgcattctgggaccgcccccttccattcccgggccagcggcgagcggcagcgacggctggagccgcagctacagcatgagagccggtgccgctcctccacgcctgcggacgcgtggcgagcggaggcagcgctgcctgttcgcgccatgggggcaccgtggggctcgccgacggcggcggcgggcgggcggcgcgggtggcgccgaggccgggggctgccatggaccgtctgtgtgctggcggccgccggcttgacgtgtacggcgctgatcacctacgcttgctgggggcagctgccgccgctgccctgggcgtcgccaaccccgtcgcgaccggtgggcgtgctgctgtggtgggagcccttcggggggcgcgatagcgccccgaggccgccccctgactgccggctgcgcttcaacatcagcggctgccgcctgctcaccgaccgcgcgtcctacggagaggctcaggccgtgcttttccaccaccgcgacctcgtgaaggggccccccgactggcccccgccctggggcatccaggcgcacactgccgaggaggtggatctgcgcgtgttggactacgaggaggcagcggcggcggcagaagccctggcgacctccagccccaggcccccgggccagcgctgggtttggatgaacttcgagtcgccctcgcactccccggggctgcgaagcctggcaagtaacctcttcaactggacgctctcctaccgggcggactcggacgtctttgtgccttatggctacctctaccccagaagccaccccggcgacccgccctcaggcctggccccgccactgtccaggaaacaggggctggtggcatgggtggtgagccactgggacgagcgccaggcccgggtccgctactaccaccaactgagccaacatgtgaccgtggacgtgttcggccggggcgggccggggcagccggtgcccgaaattgggctcctgcacacagtggcccgctacaagttctacctggctttcgagaactcgcagcacctggattatatcaccgagaagctctggcgcaacgcgttgctcgctggggcggtgccggtggtgctgggcccagaccgtgccaactacgagcgctttgtgccccgcggcgccttcatccacgtggacgacttcccaagtgcctcctccctggcctcgtacctgcttttcctcgaccgcaaccccgcggtctatcgccgctacttccactggcgccggagctacgctgtccacatcacctccttctgggacgagccttggtgccgggtgtgccaggctgtacagagggctggggaccggcccaagagcatacggaacttggccagctggttcgagcggtgaagccgcgctcccctggaagcgacccaggggaggccaagttgtcagctttttgatcctctactgtgcatctccttgactgccgcatcatgggagtaagttcttcaaacacccatttttgctctatgggaaaaaaacgatttaccaattaatattactcagcacagagatgggggcccggtttccatattttttgcacagctagcaattgggctccctttgctgctgatgggcatcattgtttaggggtgaaggagggggttcttcctcaccttgtaaccagtgcagaaatgaaatagcttagcggcaagaagccgttgaggcggtttcctgaatttccccatctgccacaggccatatttgtggcccgtgcagcttccaaatctcatacacaactgttcccgattcacgtttttctggaccaaggtgaagcaaatttgtggttgtagaaggagccttgttggtggagagtggaaggactgtggctgcaggtgggactttgttgtttggattcctcacagccttggctcctgagaaaggtgaggagggcagtccaagaggggccgctgacttctttcacaagtactatctgttcccctgtcctgtgaatggaagcaaagtgctggattgtccttggaggaaacttaagatgaatacatgcgtgtacctcactttacataagaaatgtattcctgaaaagctgcatttaaatcaagtcccaaattcattgacttaggggagttcagtatttaatgaaaccctatggagaatttatccctttacaatgtgaatagtcatctcctaatttgtttcttctgtctttatgtttttctataacctggattttttaaatcatattaaaattacagatgtgaaaataaagcagaagcaacctttttccctcttcccagaaaaccagtctgtgtttacagacagaagagaaggaagccatagtgtcacttccacacaattatttatttcatgtctttactggacctgaaatttaaactgcaatgccagtcctgcaggagtgctggcattaccctctgcagaacagtgaaaggtattgcactacattatggaatcatgcaaaaaaaa

SEQ ID NO: 714 - DNA, 1283 bp, Homo sapiens
  ref <308>: DATABASE ACCESSION NUMBER: NM_002046
  ref <309>: DATABASE ENTRY DATE: 2001-06-18
ctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaacc

SEQ ID NO: 715 - DNA, 2742 bp, Homo sapiens
  ref <308>: DATABASE ACCESSION NUMBER: NM_002047
  ref <309>: DATABASE ENTRY DATE: 2001-06-18
gtcactcgtataaaaacctatgctttgaaggttctcgtgtgtctcggcctgcaggtctcgctcagagctgtgtccctgaacatccaccctgctggggtggcttgacgcacttctgtgcaaatctgttcgctcgcaaccctacctacctctctcccgaaccggagaaaaccttcggcggggtccttccgggttttgtgtcgaatctgcggcggcgacccggcgccgcgtcacgcggtggtgaatgtgcggcagtacgcgcgccgcgtcgtttacgcggcgatttcatcatgctccgagccggcggcgcgcgccgcttccgtcgccaccctctctggacagcccagggccgcaggctcatgccctctccgcgtccagtgctgcttagaggtgctcgcgccgctctgctgctgctgctgccgccccggctcttagcccgaccctcgctcctcctccgccggtccctcagcgcggcctcctgcgccccgatctccttgcccgccgccgcctcccggagcagcatggacggcgcgggggctgaggaggtgctggcacctctgaggctagcagtgcgccagcagggagatcttgtgcgaaaactcaaagaagataaagcaccccaagtagacgtagacaaagcagtggctgagctcaaagcccgcaagagggttctggaagcaaaggagctggcgttacagcccaaagatgatattgtagaccgagcaaaaatggaagataccctgaagaggaggtttttctatgatcaagcttttgctatttatggaggtgttagtggtctgtatgactttgggccagttggctgtgctttgaagaacaatattattcagacctggaggcagcactttatccaagaggaacagatcctggagatcgattgcaccatgctcacccctgagccagttttaaagacctctggccatgtagacaaatttgctgacttcatggtgaaagacgtaaaaaatggagaatgttttcgtgctgaccatctattaaaagctcatttacagaaattgatgtctgataagaagtgttctgtcgaaaagaaatcagaaatggaaagtgttttggcccagcttgataactatggacagcaagaacttgcggatctttttgtgaactataatgtaaaatctcccattactggaaatgatctatcccctccagtgtcttttaacttaatgttcaagactttcattgggcctggaggaaacatgcctgggtacttgagaccagaaactgcacaggggattttcttgaatttcaaacgacttttggagttcaaccaaggaaagttgccttttgctgctgcccagattggaaattcttttagaaatgagatctcccctcgatctggactgatcagagtcagagaattcacaatggcagaaattgagcactttgtagatcccagtgagaaagaccaccccaagttccagaatgtggcagaccttcacctttatttgtattcagcaaaagcccaggtcagcggacagtccgctcggaaaatgcgcctgggagatgctgttgaacagggtgtgattaataacacagtattaggctatttcattggccgcatctacctctacctcacgaaggttggaatatctccagataaactccgcttccggcagcacatggagaatgagatggcccattatgcctgtgactgttgggatgcagaatccaaaacatcctacggttggattgagattgttggatgtgctgatcgttcctgttatgacctctcctgtcatgcacgagccaccaaagtcccacttgtagctgagaaacctctgaaagaacccaaaacagtcaatgttgttcagtttgaacccagtaagggagcaattggtaaggcatataagaaggatgcaaaactggtgatggagtatcttgccatttgtgatgagtgctacattacagaaatggagatgctgctgaatgagaaaggggaattcacaattgaaactgaagggaaaacatttcagttaacaaaagacatgatcaatgtgaagagattccagaaaacactatatgtggaagaagttgttccgaatgtaattgaaccttccttcggcctgggtaggatcatgtatacggtatttgaacatacattccatgtacgagaaggagatgaacagagaacattcttcagtttccctgctgtagttgctccattcaaatgttccgtcctcccactgagccaaaaccaggagttcatgccatttgtcaaggaattatcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagagatctctgagctgcccagcatagtccaagacctagccaatggcaacatcacatgggctgatgtggaggccaggtatcctctgtttgaagggcaagagactggtaaaaaagagacaatcgaggaatgaggacaattttgacaacttttgaccacttgcgctaataaaaaaaaaaaaactactcttatgtccactttacaaaagaaaacagcattgtgattactcccagggaccgtattttatcttcagtggctgcctgattttacccccacaattaaagttgaaggaatcctga

SEQ ID NO: 716 - DNA, 2365 bp, Homo sapiens
  ref <308>: DATABASE ACCESSION NUMBER: NM_002051
  ref <309>: DATABASE ENTRY DATE: 2001-06-18
tcccagccttcccatccccccaccgaaagcaaatcattcaacgacccccgaccctccgacggcaggagccccccgacctcccaggcggaccgcccttccctccccgcgcgggttccgggcccggcgagagggcgcgacgacagccgaggccatggaggtgacggcggaccagccgcgctgggtgagccaccaccaccccgccgtgctcaacgggcagcacccggacacgcaccacccgggcctcagccactcctacatggacgcggcgcagtacccgctgccggaggaggtggatgtgctttttaacatcgacggtcaaggcaaccacgtcccgccctactacggaaactcggtcagggccacggtgcagaggtaccctccgacccaccacgggagccaggtgtgccgcccgcctctgcttcatggatccctaccctggctggacggcggcaaagccctgggcagccaccacaccgcctccccctggaatctcagccccttctccaagacgtccatccaccacggctccccggggcccctctccgtctaccccccggcctcgtcctcctccttgtcggggggccacgccagcccgcacctcttcaccttcccgcccaccccgccgaaggacgtctccccggacccatcgctgtccaccccaggctcggccggctcggcccggcaggacgagaaagagtgcctcaagtaccaggtgcccctgcccgacagcatgaagctggagtcgtcccactcccgtggcagcatgaccgccctgggtggagcctcctcgtcgacccaccaccccatcaccacctacccgccctacgtgcccgagtacagctccggactcttcccccccagcagcctgctgggcggctcccccaccggcttcggatgcaagtccaggcccaaggcccggtccagcacaggcagggagtgtgtgaactgtggggcaacctcgaccccactgtggcggcgagatggcacgggacactacctgtgcaacgcctgcgggctctatcacaaaatgaacggacagaaccggcccctcattaagcccaagcgaaggctgtctgcagccaggagagcagggacgtcctgtgcgaactgtcagaccaccacaaccacactctggaggaggaatgccaatggggaccctgtctgcaatgcctgtgggctctactacaagcttcacaatattaacagacccctgactatgaagaaggaaggcatccagaccagaaaccgaaaaatgtctagcaaatccaaaaagtgcaaaaaagtgcatgactcactggaggacttccccaagaacagctcgtttaacccggccgccctctccagacacatgtcctccctgagccacatctcgcccttcagccactccagccacatgctgaccacgcccacgccgatgcacccgccatccagcctgtcctttggaccacaccacccctccagcatggtcaccgccatgggttagagccctgctcgatgctcacagggcccccagcgagagtccctgcagtccctttcgacttgcatttttgcaggagcagtatcatgaagcctaaacgcgatggatatatgtttttgaaggcagaaagcaaaattatgtttgccactttgcaaaggagctcactgtggtgtctgtgttccaaccactgaatctggaccccatctgtgaataagccattctgactcatatcccctatttaacagggtctctagtgctgtgaaaaaaaaaaatcctgaacattgcatataacttatattgtaagaaatactgtacaatgactttattgcatctgggtagctgtaaggcatgaaggatgccaagaagtttaaggaatatgggagaaatagtgtggaaattaagaagaaactaggtctgatattcaaatggacaaactgccagttttgtttcctttcactggccacagttgtttgatgcattaaaagaaaataaaaaaaagaaaaaagagaaaagaaaaaaaaagaaaaaagttgtaggcgaatcatttgttcaaagctgttggccctctgcaaaggaaataccagttctgggcaatcagtgttaccgttcaccagttgccattgagggtttcagagagcctttttctaggcctacatgctttgtgaacaagtccctgtaattgttgtttgtatgtataattcaaagcaccaaaataagaaaagatgtagatttatttcatcatattatacagaccgaactgttgtataaatttatttactgctagtcttaagaactgctttctttcgtttgtttgtttcaatattttccttctctctcaattttcggttgaataaactagattacattcagttggcaaaaaaaaaaaaa

SEQ ID NO: 717 - DNA, 2881 bp, Homo sapiens
  ref <308>: DATABASE ACCESSION NUMBER: NM_002053
  ref <309>: DATABASE ENTRY DATE: 2001-06-18
acagaagtgctagaagccagtgctcgtgaactaaggagaaaaagaacagacaagggaacagcctggacatggcatcagagatccacatgacaggcccaatgtgcctcattgagaacactaatgggcgactgatggcgaatccagaagctctgaagatcctttctgccattacacagcctatggtggtggtggcaattgtgggcctctaccgcacaggcaaatcctacctgatgaacaagctggctggaaagaaaaagggcttctctctgggctccacggtgcagtctcacactaaaggaatctggatgtggtgtgtgccccaccccaagaagccaggccacatcctagttctgctggacaccgagggtctgggagatgtagagaagggtgacaaccagaatgactcctggatcttcgccctggccgtcctcctgagcagcaccttcgtgtacaatagcataggaaccatcaaccagcaggctatggaccaactgtactatgtgacagagctgacacatagaatccgatcaaaatcctcacctgatgagaatgagaatgaggttgaggattcagctgactttgtgagcttcttcccagactttgtgtggacactgagagatttctccctggacttggaagcagatggacaacccctcacaccagatgagtacctgacatactccctgaagctgaagaaaggtaccagtcaaaaagatgaaacttttaacctgcccagactctgtatccggaaattcttcccaaagaaaaaatgctttgtctttgatcggcccgttcaccgcaggaagcttgcccagctcgagaaactacaagatgaagagctggaccccgaatttgtgcaacaagtagcagacttctgttcctacatctttagtaattccaaaactaaaactctttcaggaggcatccaggtcaacgggcctcgtctagagagcctggtgctgacctacgtcaatgccatcagcagtggggatctgccgtgcatggagaacgcagtcctggccttggcccagatagagaactcagctgcagtgcaaaaggctattgcccactatgaacagcagatgggccagaaggtgcagctgcccacagaaagcctccaggagctgctggacctgcacagggacagtgagagagaggccattgaagtcttcatcaggagttccttcaaagatgtggaccatctatttcaaaaggagttagcggcccagctagaaaaaaagcgggatgacttttgtaaacagaatcaggaagcatcatcagatcgttgctcaggtttacttcaggtcattttcagtcctctagaagaagaagtgaaggcgggaatttattcgaaaccagggggctatcgtctctttgttcagaagctacaagacctgaagaaaaagtactatgaggaaccgaggaaggggatacaggctgaagagattctgcagacatacttgaaatccaaggagtctatgactgatgcaattctccagacagaccagactctcacagaaaaagaaaaggagattgaagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaaagactgtaaattgtgcaacaaagatgcatttacctctgtatcaactcaggaaatctcataagctggtaccactcaggagaagtttattcttccagatgaccagcagtagacaaatggatactgagcagagtcttaggtaaaagtcttgggaaatatttgggcattggtctggccaagtctacaatgtcccaatatcaaggacaaccaccctagcttcttagtgaagacaatgtacagttatccattagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggactttaaaagatgctgtgtaactaaactgaaataattcaattacttattatttagaatgttaaagcttatgatagtcttttctaattcttaacactcatacttgaaatctttccgagtttccccagaagagaatatgggattttttttgacatttttgacccatttaataatgctcttgtgtttacctagtatatgtagactttgtcttatgtgtcaaaagtcctaggaaagtggttgatgtttcttatagcaattaaaaattatttttgaactga

SEQ ID NO: 718 - DNA, 1610 bp, Homo sapiens
  ref <308>: DATABASE ACCESSION NUMBER: NM_002061
  ref <309>: DATABASE ENTRY DATE: 2001-06-18
ggcacgaggctgcggccgcagtagccggagccggagccgcagccaccggtgccttcctttcccgccgccgcccagccgccgtccggcctccctcgggcccgagcgcagaccaggctccagccgcgcggcgccggcagcctcgcgctccctctcgggtctctctcgggcctcgggcaccgcgtcctgtgggcggccgcctgcctgcccgcccgcccgcagccccttgcctgccggcccctgggcggcccgtgccatgggcaccgacagccgcgcggccaaggcgctcctggcgcgggcccgcaccctgcacctgcagacggggaacctgctgaactggggccgcctgcggaagaagtgcccgtccacgcacagcgaggagcttcatgattgtatccaaaaaaccttgaatgaatggagttcccaaatcaacccagatttggtcagggagtttccagatgtcttggaatgcactgtatctcatgcagtagaaaagataaatcctgatgaaagagaagaaatgaaagtttctgcaaaactgttcattgtagaatcaaactcttcatcatcaactagaagtgcagttgacatggcctgttcagtccttggagttgcacagctggattctgtgatcattgcttcacctcctattgaagatggagttaatctttccttggagcatttacagccttactgggaggaattagaaaacttagttcagagcaaaaagattgttgccataggtacctctgatctagacaaaacacagttggaacagctgtatcagtgggcacaggtaaaaccaaatagtaaccaagttaatcttgcctcctgctgtgtgatgccaccagatttgactgcatttgctaaacaatttgacatacagctgttgactcacaatgatccaaaagaactgctttctgaagcaagtttccaagaagctcttcaggaaagcattcctgacattcaagcgcacgagtgggtgccgctgtggctactgcggtattcggtcattgtgaaaagtagaggaattatcaaatcaaaaggctacattttacaagctaaaagaaggggttcttaactgacttaggagcataacttacctgtaatttccttcaatatgagagaaaattgagatgtgtaaaatctagttactgcctgtaaatggtgtcattgaggcagatattctttcgtcatatttgacagtatgttgtctgtcaagttttaaatacttatcttgcctccatatcaatccattctcatgaacctctgtattgctttccttaaactattgttttctaattgaaattgtctataaagaaaatacttgcaatatatttttcctttatttttatgactaatataaatcaagaaaatttgttgttagatatattttggcctaggtatcagggtaatgtatatacatattttttatttccaaaaaaaattcattaattgcttcttaactcttattataaccaagcaatttaattacaattgttaaaactgaaatactggaagaagatatttttcctgtcattgatgagatatatcagagtaactggagtagctgggatttactagtagtgtaaataaaattcactcttcaatac

SEQ ID NO: 719 - DNA, 1366 bp, Homo sapiens
  ref <308>: DATABASE ACCESSION NUMBER: NM_002065
  ref <309>: DATABASE ENTRY DATE: 2001-06-18
cgcgagagcaggttaggagaggagaggaggccgcagtactgctcacacgctccgctcttctcccactctcggcctacctttacccgcccgcctgctcggcgaccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaagagttgcctgagtggaatttcgatggctccagtactttacagtctgagggttccaacagtgacatgtatctcgtgcctgctgccatgtttcgggaccccttccgtaaggaccctaacaagctggtgttatgtgaagttttcaagtacaatcgaaggcctgcagagaccaatttgaggcacacctgtaaacggataatggacatggtgagcaaccagcacccctggtttggcatggagcaggagtataccctcatggggacagatgggcacccctttggttggccttccaacggcttcccagggccccagggtccatattactgtggtgtgggagcagacagagcctatggcagggacatcgtggaggcccattaccgggcctgcttgtatgctggagtcaagattgcggggactaatgccgaggtcatgcctgcccagtgggaatttcagattggaccttgtgaaggaatcagcatgggagatcatctctgggtggcccgtttcatcttgcatcgtgtgtgtgaagactttggagtgatagcaacctttgatcctaagcccattcctgggaactggaatggtgcaggctgccataccaacttcagcaccaaggccatgcgggaggagaatggtctgaagtacatcgaggaggccattgagaaactaagcaagcggcaccagtaccacatccgtgcctatgatcccaagggaggcctggacaatgcccgacgtctaactggattccatgaaacctccaacatcaacgacttttctggtggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgttttttttcattcc

SEQ ID NO: 720 - DNA, 2060 bp, Homo sapiens
  ref <308>: DATABASE ACCESSION NUMBER: NM_002068
  ref <309>: DATABASE ENTRY DATE: 2001-06-18
tgttcccagcactcaagccttgccaccgccgagccgggcttcctgggtgtttcaggcaaggaagtctaggtccctggggggtgacccccaaggaaaaggcagcctccctgcgcacccggttgcccggagccctctccagggccggctgggctgggggttgccctggccagcaggggcccgggggcgatgccacccggtgccgactgaggccaccgcaccatggcccgctcgctgacctggcgctgctgcccctggtgcctgacggaggatgagaaggccgccgcccgggtggaccaggagatcaacaggatcctcttggagcagaagaagcaggaccgcggggagctgaagctgctgcttttgggcccaggcgagagcgggaagagcaccttcatcaagcagatgcggatcatccacggcgccggctactcggaggaggagcgcaagggcttccggcccctggtctaccagaacatcttcgtgtccatgcgggccatgatcgaggccatggagcggctgcagattccattcagcaggcccgagagcaagcaccacgctagcctggtcatgagccaggacccctataaagtgaccacgtttgagaagcgctacgctgcggccatgcagtggctgtggagggatgccggcatccgggcctgctatgagcgtcggcgggaattccacctgctcgattcagccgtgtactacctgtcccacctggagcgcatcaccgaggagggctacgtccccacagctcaggacgtgctccgcagccgcatgcccaccactggcatcaacgagtactgcttctccgtgcagaaaaccaacctgcggatcgtggacgtcgggggccagaagtcagagcgtaagaaatggatccattgtttcgagaacgtgatcgccctcatctacctggcctcactgagtgaatacgaccagtgcctggaggagaacaaccaggagaaccgcatgaaggagagcctcgcattgtttgggactatcctggaactaccctggttcaaaagcacatccgtcatcctctttctcaacaaaaccgacatcctggaggagaaaatccccacctcccacctggctacctatttccccagtttccagggccctaagcaggatgctgaggcagccaagaggttcatcctggacatgtacacgaggatgtacaccgggtgcgtggacggccccgagggcagcaagaagggcgcacgatcccgacgccttttcagccactacacatgtgccacagacacacagaacatccgcaaggtcttcaaggacgtgcgggactcggtgctcgcccgctacctggacgagatcaacctgctgtgacccaggccccacctggggcaggcggcaccggcgggcgggtgggaggtgggagtggctgcagggaccctagtgtcctggtctatctctccagcctcggcccacacgcaagggagtcgggggacggcccgctgctggccgctctcttctctgcctctcaccaggacagccgccccccagggtactcctgcccttgcttgactcagtttccctcctttgaaagggaaggagcaaaacggccatttgggatgccagggtggatgaaaaggtgaagaaatcaggggattgagacttgggtgggtgggcatctctcaggagccccatctccgggcgtgtcacctcctgggcagggttctgggaccctctgtgggtgacgcacaccctgggatggggctagtagagccttcaggcgccttcgggcgtggactctggcgcactctagtggacaggagaaggaacgccttccaggaacctgtggactaggggtgcagggacttccctttgcaaggggtaacagaccgctggaaaacactgtcactttcagagctcggtggctcacagcgtgtcctgccccggtttgcggacgagagaaatcgcggcccacaagcatcccccatcccttgcaggctgggggctgggcatgctgcatcttaaccttttgtatttattccctcaccttctgcagggctccgtgcgggctgaaattaaagatttcttag

SEQ ID NO: 721 - DNA, 2679 bp, Homo sapiens
  ref <308>: DATABASE ACCESSION NUMBER: NM_002073
  ref <309>: DATABASE ENTRY DATE: 2001-06-18
gagaccaggaccatgggatgtcggcaaagctcagaggaaaaagaagcagcccggcggtcccggagaattgaccgccacctgcgctcagagagccagcggcaacgccgcgaaatcaagctgctcctgctgggcaccagcaactcaggcaagagcaccatcgtcaaacagatgaagatcatccacagcggcggcttcaacctggaggcctgcaaggagtacaagcccctcatcatctacaatgccatcgactcgctgacccgcatcatccgggccctggccgccctcaggatcgacttccacaaccccgaccgcgcctacgacgctgtgcagctctttgcgctgacgggccccgctgagagcaagggcgagatcacacccgagctgctgggtgtcatgcgacggctctgggccgacccaggggcacaggcctgcttcagccgctccagcgagtaccacctggaggacaacgcggcctactacctgaacgacctggagcgcatcgccgcagctgactatatccccactgtcgaggacatcctgcgctcccgggacatgaccacgggcattgtggagaacaagttcaccttcaaggagctcaccttcaagatggtggacgtgggggggcagaggtcagagcgcaaaaagtggatccactgcttcgagggcgtcacagccatcatcttctgtgtggagctcagcggctacgacctgaaactctacgaggataaccagacaagtcggatggcagagagcttgcgcctctttgactccatctgcaacaacaactggttcatcaacacctcactcatcctcttcctgaacaagaaggacctgctggcagagaagatccgccgcatcccgctcaccatctgctttcccgagtacaagggccagaacacgtacgaggaggccgctgtctacatccagcggcagtttgaagacctgaaccgcaacaaggagaccaaggagatctactcccacttcacctgcgccaccgacaccagtaacatccagtttgtcttcgacgcggtgacagacgtcatcatacagaacaatctcaagtacattggcctttgctgaggagctgggcccggggcgcctgcctatggtgaaacccacggggtgtcatgccccaacgcgtgctagagaggcccaatccaggggcagaaaacagggggcctaaagaatgtcccccaccccttggcctctgcctccttggccccacatttctgcaaacataaatatttacggatagattgctaggtagatagacacacacacatgcacacacacacatctggagatggcaaaatcctctaaaatgtcgaggtctcttgaagacttgagaagctgtcacaaggtcactacaagcccaacctgccccttcactttgccttcctgagttggccccactccacttgggggtctgcattggattgttagggataggcagcagggctgaggcaaggtaggccaactgcacccctgtcacctggaggagggccggctcgctgcccgagctctggcctagggaccttgccgctgaccaagagggaggaccagtgcagggtctgtgcaccttccctgctggcctgcacacagctgctcagcaccatttcattctggacctgggaccttaggagccgggtgacagcactaaccagacctccagccactcacagctctttttaaaaaacagcttcaaaatatgcagcaaaaaccaatacaacaaaacgagtggcacgatttatttcaaactaggccagctgggattccagcttttcttctactagtctgatgttttataaatcaaaacctggttttccttctctggcatttttttttgttttttgttttttggttttttttttttttttggccaaatctcgtggtgtttcgcagaaaaaaatccagaaaatttcaaatgcagttgagtattcttttttaaatgcagattttcaaaacatattttttttcaggtggtcttttttgtgtctggcttgctgagtgtaaaagttgttatctggacgatctgtctctctgctccaaagaaattttggagtgagtggcagtcctgcgccagcctcgcgggacacgtgttgtacataagcctctgcagtgtcctcttgttaatggtggggttttctgctttgtttttatttaagaaaataaacacgacatatttaaagaaggttctttcacctgggagcaaatgaacaatagctaagtgtcttggtatttaaagagtaaattatttgtggctttgctgagtgaaggaaggggagcaaggggtggtgcccctggtcccagcatgccccgcgcctgagactggctggaaatgctctgactcctgtgaaggcacagccagcgttgtggcctgagggaggccctgctgggaccctgatctgggccttcctgtcccagggcctatgggcaactgcgttgaaaggacgttcgccaagggccgtgtgtaaatacgaactgcgccatggagaggagaggcactgccggagcccttgccagatctccctccctctctctgtgcagtagctgtgtgtccgaggtcagtgtgcggaatcacagccaaggacgtgaagagatgtacgggggaaagagaagctggggattggatgaaagtcaaaggttgtctactttaagaaaataaaataccctgaatgg

SEQ ID NO: 722 - DNA, 4860 bp, Homo sapiens
  ref <308>: DATABASE ACCESSION NUMBER: NM_002077
  ref <309>: DATABASE ENTRY DATE: 2001-06-18
gcactgggagacgtgcggttccgggtcgctgctcggctcgccggctgggcggtgggggttggtgacgcgggccggcgctcacgagaggcccgggaggcggggctttgctggcttcccagagagaggcaggacagaatgctttgacctccaagctgttttaaatctagtagataagccagatcctgtgttgccataagcccttggcccacatttaagtgggaatgcagctagcttggatgtctgaaactttgtaggcgcctctgtctgaatcctgaacacaggcaccaggactactgagagctcgtcatctgtgcaggatagccacacagcaaacatgtttgcaaaactgaagaagaaaattgcagaagagactgctgttgctcagaggccaggaggtgctactaggatcccacggtctgtgagcaaggaatcagttgcctcaatgggagctgactcaggagatgactttgcttccgatggaagcagctccagagaagatctttcatcccagcttctgagaaggaatgaacagatacggaagttagaggccagactttctgactatgctgaacaggtccgaaacttgcagaagataaaagagaagcttgaaattgcattagaaaaacaccaggattcttccatgcggaaatttcaagagcagaatgagacattccaagccaacagagccaaaatggcagaaggactggctttggcattagccagaaaggaccaggaatggtcagaaaagatggatcagcttgaaaaggagaaaaatattctgacagcccagttacaggaaatgaagaaccagagtatgaatcttttccaaaggagagatgaaatggatgaattagaggggttccagcagcaggaactaagtaaaataaagcacatgcttttaaaaaaagaagaaagtctagggaaaatggaacaagaattggaggcacgaaccagagaacttagtcgtacccaggaggagttgatgaactccaatcagatgtcatcagacttaagccagaagctagaagaattgcagagacactactcaacgctggaagagcagagagatcatgtgatagcttcaaaaacaggtgcagaaagtaagatcacagccctggaacaaaaggaacaagagctccaagcactcattcagcagctttccattgatttgcaaaaggtcactgctgaaactcaagagaaagaagacgttatcacacatttgcaagagaaggttgcatccttggagaagagactagaacagaacttatcaggagaagaacacgtgcaagaactcctgaaagagaaaacacttgctgagcagaatttggaggataccagacaacagctcttggcagccagaagcagccaggctaaggccattaacaccctggagactcgggtgagagaactggagcagaccttgcaggcctctgaggagcagctccaacagagcaagggcattgtggctgcccaggaaactcagatacaggagctcgctgccgccaaccaggagagcagccatgtgcagcagcaggcccttgctctggagcagcagttcttggagcgcacccaggcgctagaagcccagatagtggccctggagagaacgcgggcagctgaccagaccaccgcagagcaagggatgagacaactggagcaagaaaatgcagcccttaaagaatgcaggaatgaatatgaacgttctttacaaaatcaccaatttgaactaaagaagctgaaggaagaatggagccaaagagaaattgtgagcgtggccatggctcaagccctggaggaggtgcggaagcaaagggaagagttccagcaacaggcagctaacctgacagccataatagacgagaaggaacagaatctgcgggaaaaaaccgaagtgcttctccagaaagagcaggagattctccagctggagcgaggtcacaactctgccctgctgcagatacaccagctgcaggccgagctggaggccctgaggaccctcaaggcggaggaggctgcagtggtcgcggagcaggaggacctgctgaggctgcggggcccattgcaggccgaagcactctcagtcaatgagtcgcacgtgacctcgagggccatgcaggaccctgtgttccagcttccaactgcaggaagaacaccaaatggtgaggttggggccatggatctcacacagctacagaaggagaaacaggacttggagcagcaacttctggagaaaaataagaccataaagcagatgcagcagcggatgctggagctccggaagactctgcagaaggagctgaaaatcagacccgataatgagctcttcgaagtccgggagaaacctggacctgagatggcaaacatggcgccttccgtcacgaataacactgacctgacagatgcccgcgagatcaactttgagtaccttaaacatgtggttttaaaattcatgtcttgtcgcgaatccgaggcttttcatcttataaaagctgtgtcagtgttgctgaacttttcccaagaggaggagaacatgctcaaggaaactctggaatataagatgtcatggtttgggtccaaaccagctcccaagggcagcatccggccgtctatctcaaaccctcggataccatggtcctagaggggactacccaaggatggagctccgtgggttgacactttttctgtgaaaagaacactgacacaccagtctgggtgggtttttaatcactgtaactgcagtattttgtacaagtgtctaaacattgtttacaagactaaggcccacttccctgcaggctgacctgaacctcagggggtagctgatcctgtcattctggtcaccaaacaggagggtcctggcactacccagatttccacagtgctgctaatatcccagctccagccagcaccccatctgcacctgaatcctctaacttcacggtagcacttacagctgaagccatcagcatctggcaggcacacctgagtcaccatgtagcgctgctactggaggtagagacggccctttgagatggtgcccagcaggccaaacccacctgcctctgccaggaacagccaactccatgggaactctatgggagtggcttttaaaaattcagatgagttagaagctttttatcccttcctctcaagaaaatattctttcaccctgtctctcaaaccacctagaactttagaggatccatctttaagggccggtgtggatgaatgagaaaatgcacctttctgacagtatctccactttacttaagaaaactagcaaatatatgaaaagacccttagtaccaaatacactcaattgcctttttaatgaatgtacttgtcttggataggttgctggtaaaccattttaaactattttttatagctgaagttcttcactactataaacgtcttctgtactataaaatccatttaactggtgttcttaaaatcagagcgtccagaggaaattcttcctaaaactaggattcctgttcctttgtcttctcactcgcactctggcactgctccctctgaagtgcagtgggatctcgtgtgctttgtcttgattctgtgctgcgctgccgctgggcgatgcagaccacctgtcttctactgaaggacagtccgctgtctccagtgggggcagcagctgtcccccagcctcgatggagacattggggcagtctgccttgtctgtggagctgctctctctccctcatcccaccccaaatacttaaaatgacactacacccagacggcgcccagctggctgcagcacttgtagcatgcacatgactctggtagtaaccaacaaaaacttgttttatggattcctcgtttactgaggaaagggaacatgctggttctggaaaagccacaatattgaatctaaaaggaaaccgtttattgtttgatgaaagtttcactggttaaataaaaaactaaattaataactggagcctctaaatttattatccattatccagtgatggaaagttgtatttctcaatcatgcttagggccaaaataggtatataaaatgtgtcacagaaaaacacgcatttgcaacgttaacctaacgaaatttccatgaagaaccaagtcagggcagcatctccttagtcccagctcaggctctctgccttccagaggccgcttctccagtgactaacctcctcctctggctcctccttgcagacagttatcccttgtttagaacacgaatttccatttacctggtgggaacacgaaacaggagtctcttctgttctgcaagtttgatgggtaagaggtagccttttttcaaagtaggatttcctttttcaactgttccaggaaagaatctctaagactgggtagctcacagccagccaaaggcagctacatttccacagaagcccgtccgctgcctccgtggcttctccagccattgaactggtcccacacgcaccccaggccccactcctcggcagtttcaggtgtagctgtggggcccgttcctaggtctgtactcactttagggaggcttcactgactaggctttcctcctgcatgttgaatttccttcagctttaagaggaagagtggaataaatattctaagtgatttaatgcactttgacttgtataaaactttctgtgttagcgacggtatctatagccctttatacgagcgatggatcttgagctctccttccatgttgtaaatagggattgtattcttgaaaactgctgtagcaaattcatctgtggtgcaatacactttttgattaaagctcttcaatccagatgcaaaaaaaaaaaaaaaaaaaaaaaaaaaaaaaaaaaaaaaaaaaaaaaaaaaaaaaaaaaaaaa

SEQ ID NO: 723 - DNA, 797 bp, Homo sapiens
  ref <308>: DATABASE ACCESSION NUMBER: NM_002091
  ref <309>: DATABASE ENTRY DATE: 2001-06-18
agtctctgctcttcccagcctctccggcgcgctccaagggcttcccgtcgggaccatgcgcggcagtgagctcccgctggtcctgctggcgctggtcctctgcctagcgccccgggggcgagcggtcccgctgcctgcgggcggagggaccgtgctgaccaagatgtacccgcgcggcaaccactgggcggtggggcacttaatggggaaaaagagcacaggggagtcttcttctgtttctgagagagggagcctgaagcagcagctgagagagtacatcaggtgggaagaagctgcaaggaatttgctgggtctcatagaagcaaaggagaacagaaaccaccagccacctcaacccaaggccttgggcaatcagcagccttcgtgggattcagaggatagcagcaacttcaaagatgtaggttcaaaaggcaaagttggtagactctctgctccaggttctcaacgtgaaggaaggaacccccagctgaaccagcaatgataatgatggcctctctcaaaagagaaaaacaaaacccctaagagactgagttctgcaagcatcagttctacggatcatcaacaagatttccttgtgcaaaatatttgactattctgtatctttcatccttgactaaattcgtgattttcaagcagcatcttctggtttaaacttgtttgctgtgaacaattgtcgaaaagagtcttccaattaatgcttttttatatctaggctacctgttggttagattcaaggccccgagctgttaccattcacaataaaagcttaaacacat

SEQ ID NO: 724 - DNA, 1077 bp, Homo sapiens
  Modified_base 1 ... 1077: n = a,c,g, or t
  ref <308>: DATABASE ACCESSION NUMBER: NM_002101
  ref <309>: DATABASE ENTRY DATE: 2001-06-18
gagcccctcccctcggcccgcgcgggaggagtgtgacccaggtgccgcttcctctcgccgccgagggtcaggagcccgggagcgcgaccctcccccggcccggcctggcccggcctggccagtccccgcggtctctgcccgggctgacgcccaggaatgtggtcgacgagaagccccaacagcacggcgtggcctctcagcctcgagcctgatccggggatggcctctgcctccaccacaatgcatactaccaccattgcagagcctgatccagggatgtctggatggccggatggcagaatggagacctccacccccaccataatggacattgtcgtcattgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccaccggaggtgggagaaaatctgggcacgatcgggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtcnttgacatttggggggaacagcaggtgccagagctaaaaggtacctttgtctgccattgatccagctcagaacgattggaaataaatttgaaatgtaaccgagcaaaaa

SEQ ID NO: 725 - DNA, 873 bp, Homo sapiens
  ref <308>: DATABASE ACCESSION NUMBER: NM_002106
  ref <309>: DATABASE ENTRY DATE: 2001-06-18
cagtttgaatcgcggtgcgaccgaaggagtaggtgctgggatcgtcaccgtggcaccgattagccttttctctgccttgcttgcttgagcttcagcggaattcgaaatggctggcggtaaggctggaaaggactccggaaaggccaagacaaaggcggtttcccgctcgcagagagccggcttgcagttcccagtgggccgtattcatcgacacctaaaatctaggacgaccagtcatggacgtgtgggcgcgactgccgctgtgtacagcgcagccatcctggagtacctcaccgcagaggtacttgaactggcaggaaatgcatcaaaagacttaaaggtaaagcgtattacccctcgtcacttgcaacttgctattcgtggagatgaagaattggattctctcatcaaggctacaattgctggtggtggtgtcattccacacatccacaaatctctgattgggaagaaaggacaacagaagactgtctaaaggatgcctggattccttgttatctcaggactctaaatactctaacagctgtccagtgttggtgattccagtggactgtatctctgtgaaaaacacaattttgcctttttgtaattctatttgagcaagttggaagtttaattagctttccaaccaaccaaatttctgcattcgagtcttaaccatatttaagtgttactgtggcttcaaagaagctattgattctgaagtagtgggttttgattgagttgactgtttttaaaaaactgtttggattttaattgtgatgcagaagttatagtaacaaacatttggttttgttcagaccttatttccactctggtggataagttcaataaaggtcatatcccaaactaaaa

SEQ ID NO: 726 - DNA, 2015 bp, Homo sapiens
  ref <308>: DATABASE ACCESSION NUMBER: NM_002110
  ref <309>: DATABASE ENTRY DATE: 2001-06-18
cggaggcacggaagatgaggaagatgatcaggaggatgatgaaggtgaagagggagatgaagacgatgacgacgatggctctgaggggacctcaggggctgccgagctgggggggcgctcaagctgcgaggatccgggctgcccgcgagacgaggagcgggcgccaggatggggtcgatgaagtccaagttcctccaggtcggaggcaatacattctcaaaaactgaaaccagcgccagcccacactgtcctgtgtacgtgccggatcccacatccaccatcaagccggggcctaatagccacaacagcaacacaccaggaatcagggaggcaggctctgaggacatcatcgtggttgccctgtatgattacgaggccattcaccacgaagacctcagcttccagaagggggaccagatggtggtcctagaggaatccggggagtggtggaaggctcgatccctggccacccggaaggagggctacatcccaagcaactatgtcgcccgcgttgactctctggagacagaggagtggtttttcaagggcatcagccggaaggacgcagagcgccaactgctggctcccggcaacatgctgggctccttcatgatccgggatagcgagaccactaaaggaagctactctttgtccgtgcgagactacgaccctcggcagggagataccgtgaaacattacaagatccggaccctggacaacgggggcttctacatatccccccgaagcaccttcagcactctgcaggagctggtggaccactacaagaaggggaacgacgggctctgccagaaactgtcggtgccctgcatgtcttccaagccccagaagccttgggagaaagatgcctgggagatccctcgggaatccctcaagctggagaagaaacttggagctgggcagtttggggaagtctggatggccacctacaacaagcacaccaaggtggcagtgaagacgatgaagccagggagcatgtcggtggaggccttcctggcagaggccaacgtgatgaaaactctgcagcatgacaagctggtcaaacttcatgcggtggtcaccaaggagcccatctacatcatcacggagttcatggccaaaggaagcttgctggactttctgaaaagtgatgagggcagcaagcagccattgccaaaactcattgacttctcagcccagattgcagaaggcatggccttcatcgagcagaggaactacatccaccgagacctccgagctgccaacatcttggtctctgcatccctggtgtgtaagattgctgactttggcctggcccgggtcattgaggacaacgagtacacggctcgggaaggggccaagttccccatcaagtggacagctcctgaagccatcaactttggctccttcaccatcaagtcagacgtctggtcctttggtatcctgctgatggagatcgtcacctacggccggatcccttacccagggatgtcaaaccctgaagtgatccgagctctggagcgtggataccggatgcctcgcccagagaactgcccagaggagctctacaacatcatgatgcgctgctggaaaaaccgtccggaggagcggccgaccttcgaatacatccagagtgtgctggatgacttctacacggccacagagagccagtaccaacagcagccatgatagggaggaccagggcagggcagggggtgcccaggtggtggctcgaaggtggctccagcaccatccgccagggcccacacccccttcctactcccagacacccaccctcgcttcagccacagtttcctcatctgtccagtgggtaggttggactggaaaatctctttttgactcttgcaatccacaatctgacattctcaggaagcccccaagttgatatttctatttcctggaatggttggattttagttacagctgtgatttggaagggaaactttcaaaatagtgaaatgaatatttaaataaaagatataaatgcaagtcttacg

SEQ ID NO: 727 - DNA, 13672 bp, Homo sapiens
  ref <308>: DATABASE ACCESSION NUMBER: NM_002111
  ref <309>: DATABASE ENTRY DATE: 2001-06-18
ttgctgtgtgaggcagaacctgcgggggcaggggcgggctggttccctggccagccattggcagagtccgcaggctagggctgtcaatcatgctggccggcgtggccccgcctccgccggcgcggccccgcctccgccggcgcacgtctgggacgcaaggcgccgtgggggctgccgggacgggtccaagatggacggccgctcaggttctgcttttacctgcggcccagagccccattcattgccccggtgctgagcggcgccgcgagtcggcccgaggcctccggggactgccgtgccgggcgggagaccgccatggcgaccctggaaaagctgatgaaggccttcgagtccctcaagtccttccagcagcagcagcagcagcagcagcagcagcagcagcagcagcagcagcagcagcagcagcagcaacagccgccaccgccgccgccgccgccgccgcctcctcagcttcctcagccgccgccgcaggcacagccgctgctgcctcagccgcagccgcccccgccgccgcccccgccgccacccggcccggctgtggctgaggagccgctgcaccgaccaaagaaagaactttcagctaccaagaaagaccgtgtgaatcattgtctgacaatatgtgaaaacatagtggcacagtctgtcagaaattctccagaatttcagaaacttctgggcatcgctatggaactttttctgctgtgcagtgatgacgcagagtcagatgtcaggatggtggctgacgaatgcctcaacaaagttatcaaagctttgatggattctaatcttccaaggttacagctcgagctctataaggaaattaaaaagaatggtgcccctcggagtttgcgtgctgccctgtggaggtttgctgagctggctcacctggttcggcctcagaaatgcaggccttacctggtgaaccttctgccgtgcctgactcgaacaagcaagagacccgaagaatcagtccaggagaccttggctgcagctgttcccaaaattatggcttcttttggcaattttgcaaatgacaatgaaattaaggttttgttaaaggccttcatagcgaacctgaagtcaagctcccccaccattcggcggacagcggctggatcagcagtgagcatctgccagcactcaagaaggacacaatatttctatagttggctactaaatgtgctcttaggcttactcgttcctgtcgaggatgaacactccactctgctgattcttggcgtgctgctcaccctgaggtatttggtgcccttgctgcagcagcaggtcaaggacacaagcctgaaaggcagcttcggagtgacaaggaaagaaatggaagtctctccttctgcagagcagcttgtccaggtttatgaactgacgttacatcatacacagcaccaagaccacaatgttgtgaccggagccctggagctgttgcagcagctcttcagaacgcctccacccgagcttctgcaaaccctgaccgcagtcgggggcattgggcagctcaccgctgctaaggaggagtctggtggccgaagccgtagtgggagtattgtggaacttatagctggagggggttcctcatgcagccctgtcctttcaagaaaacaaaaaggcaaagtgctcttaggagaagaagaagccttggaggatgactctgaatcgagatcggatgtcagcagctctgccttaacagcctcagtgaaggatgagatcagtggagagctggctgcttcttcaggggtttccactccagggtcagcaggtcatgacatcatcacagaacagccacggtcacagcacacactgcaggcggactcagtggatctggccagctgtgacttgacaagctctgccactgatggggatgaggaggatatcttgagccacagctccagccaggtcagcgccgtcccatctgaccctgccatggacctgaatgatgggacccaggcctcgtcgcccatcagcgacagctcccagaccaccaccgaagggcctgattcagctgttaccccttcagacagttctgaaattgtgttagacggtaccgacaaccagtatttgggcctgcagattggacagccccaggatgaagatgaggaagccacaggtattcttcctgatgaagcctcggaggccttcaggaactcttccatggcccttcaacaggcacatttattgaaaaacatgagtcactgcaggcagccttctgacagcagtgttgataaatttgtgttgagagatgaagctactgaaccgggtgatcaagaaaacaagccttgccgcatcaaaggtgacattggacagtccactgatgatgactctgcacctcttgtccattgtgtccgccttttatctgcttcgtttttgctaacagggggaaaaaatgtgctggttccggacagggatgtgagggtcagcgtgaaggccctggccctcagctgtgtgggagcagctgtggccctccacccggaatctttcttcagcaaactctataaagttcctcttgacaccacggaataccctgaggaacagtatgtctcagacatcttgaactacatcgatcatggagacccacaggttcgaggagccactgccattctctgtgggaccctcatctgctccatcctcagcaggtcccgcttccacgtgggagattggatgggcaccattagaaccctcacaggaaatacattttctttggcggattgcattcctttgctgcggaaaacactgaaggatgagtcttctgttacttgcaagttagcttgtacagctgtgaggaactgtgtcatgagtctctgcagcagcagctacagtgagttaggactgcagctgatcatcgatgtgctgactctgaggaacagttcctattggctggtgaggacagagcttctggaaacccttgcagagattgacttcaggctggtgagctttttggaggcaaaagcagaaaacttacacagaggggctcatcattatacagggcttttaaaactgcaagaacgagtgctcaataatgttgtcatccatttgcttggagatgaagaccccagggtgcgacatgttgccgcagcatcactaattaggcttgtcccaaagctgttttataaatgtgaccaaggacaagctgatccagtagtggccgtggcaagagatcaaagcagtgtttacctgaaacttctcatgcatgagacgcagcctccatctcatttctccgtcagcacaataaccagaatatatagaggctataacctactaccaagcataacagacgtcactatggaaaataacctttcaagagttattgcagcagtttctcatgaactaatcacatcaaccaccagagcactcacatttggatgctgtgaagctttgtgtcttctttccactgccttcccagtttgcatttggagtttaggttggcactgtggagtgcctccactgagtgcctcagatgagtctaggaagagctgtaccgttgggatggccacaatgattctgaccctgctctcgtcagcttggttcccattggatctctcagcccatcaagatgctttgattttggccggaaacttgcttgcagccagtgctcccaaatctctgagaagttcatgggcctctgaagaagaagccaacccagcagccaccaagcaagaggaggtctggccagccctgggggaccgggccctggtgcccatggtggagcagctcttctctcacctgctgaaggtgattaacatttgtgcccacgtcctggatgacgtggctcctggacccgcaataaaggcagccttgccttctctaacaaaccccccttctctaagtcccatccgacgaaaggggaaggagaaagaaccaggagaacaagcatctgtaccgttgagtcccaagaaaggcagtgaggccagtgcagcttctagacaatctgatacctcaggtcctgttacaacaagtaaatcctcatcactggggagtttctatcatcttccttcatacctcaaactgcatgatgtcctgaaagctacacacgctaactacaaggtcacgctggatcttcagaacagcacggaaaagtttggagggtttctccgctcagccttggatgttctttctcagatactagagctggccacactgcaggacattgggaagtgtgttgaagagatcctaggatacctgaaatcctgctttagtcgagaaccaatgatggcaactgtttgtgttcaacaattgttgaagactctctttggcacaaacttggcctcccagtttgatggcttatcttccaaccccagcaagtcacaaggccgagcacagcgccttggctcctccagtgtgaggccaggcttgtaccactactgcttcatggccccgtacacccacttcacccaggccctcgctgacgccagcctgaggaacatggtgcaggcggagcaggagaacgacacctcgggatggtttgatgtcctccagaaagtgtctacccagttgaagacaaacctcacgagtgtcacaaagaaccgtgcagataagaatgctattcataatcacattcgtttgtttgaacctcttgttataaaagctttaaaacagtacacgactacaacatgtgtgcagttacagaagcaggttttagatttgctggcgcagctggttcagttacgggttaattactgtcttctggattcagatcaggtgtttattggctttgtattgaaacagtttgaatacattgaagtgggccagttcagggaatcagaggcaatcattccaaacatctttttcttcttggtattactatcttatgaacgctatcattcaaaacagatcattggaattcctaaaatcattcagctctgtgatggcatcatggccagtggaaggaaggctgtgacacatgccataccggctctgcagcccatagtccacgacctctttgtattaagaggaacaaataaagctgatgcaggaaaagagcttgaaacccaaaaagaggtggtggtgtcaatgttactgagactcatccagtaccatcaggtgttggagatgttcattcttgtcctgcagcagtgccacaaggagaatgaagacaagtggaagcgactgtctcgacagatagctgacatcatcctcccaatgttagccaaacagcagatgcacattgactctcatgaagcccttggagtgttaaatacattatttgagattttggccccttcctccctccgtccggtagacatgcttttacggagtatgttcgtcactccaaacacaatggcgtccgtgagcactgttcaactgtggatatcgggaattctggccattttgagggttctgatttcccagtcaactgaagatattgttctttctcgtattcaggagctctccttctctccgtatttaatctcctgtacagtaattaataggttaagagatggggacagtacttcaacgctagaagaacacagtgaagggaaacaaataaagaatttgccagaagaaacattttcaaggtttctattacaactggttggtattcttttagaagacattgttacaaaacagctgaaggtggaaatgagtgagcagcaacatactttctattgccaggaactaggcacactgctaatgtgtctgatccacatcttcaagtctggaatgttccggagaatcacagcagctgccactaggctgttccgcagtgatggctgtggcggcagtttctacaccctggacagcttgaacttgcgggctcgttccatgatcaccacccacccggccctggtgctgctctggtgtcagatactgctgcttgtcaaccacaccgactaccgctggtgggcagaagtgcagcagaccccgaaaagacacagtctgtccagcacaaagttacttagtccccagatgtctggagaagaggaggattctgacttggcagccaaacttggaatgtgcaatagagaaatagtacgaagaggggctctcattctcttctgtgattatgtctgtcagaacctccatgactccgagcacttaacgtggctcattgtaaatcacattcaagatctgatcagcctttcccacgagcctccagtacaggacttcatcagtgccgttcatcggaactctgctgccagcggcctgttcatccaggcaattcagtctcgttgtgaaaacctttcaactccaaccatgctgaagaaaactcttcagtgcttggaggggatccatctcagccagtcgggagctgtgctcacgctgtatgtggacaggcttctgtgcacccctttccgtgtgctggctcgcatggtcgacatccttgcttgtcgccgggtagaaatgcttctggctgcaaatttacagagcagcatggcccagttgccaatggaagaactcaacagaatccaggaataccttcagagcagcgggctcgctcagagacaccaaaggctctattccctgctggacaggtttcgtctctccaccatgcaagactcacttagtccctctcctccagtctcttcccacccgctggacggggatgggcacgtgtcactggaaacagtgagtccggacaaagactggtacgttcatcttgtcaaatcccagtgttggaccaggtcagattctgcactgctggaaggtgcagagctggtgaatcggattcctgctgaagatatgaatgccttcatgatgaactcggagttcaacctaagcctgctagctccatgcttaagcctagggatgagtgaaatttctggtggccagaagagtgccctttttgaagcagcccgtgaggtgactctggcccgtgtgagcggcaccgtgcagcagctccctgctgtccatcatgtcttccagcccgagctgcctgcagagccggcggcctactggagcaagttgaatgatctgtttggggatgctgcactgtatcagtccctgcccactctggcccgggccctggcacagtacctggtggtggtctccaaactgcccagtcatttgcaccttcctcctgagaaagagaaggacattgtgaaattcgtggtggcaacccttgaggccctgtcctggcatttgatccatgagcagatcccgctgagtctggatctccaggcagggctggactgctgctgcctggccctgcagctgcctggcctctggagcgtggtctcctccacagagtttgtgacccacgcctgctccctcatctactgtgtgcacttcatcctggaggccgttgcagtgcagcctggagagcagcttcttagtccagaaagaaggacaaataccccaaaagccatcagcgaggaggaggaggaagtagatccaaacacacagaatcctaagtatatcactgcagcctgtgagatggtggcagaaatggtggagtctctgcagtcggtgttggccttgggtcataaaaggaatagcggcgtgccggcgtttctcacgccattgctcaggaacatcatcatcagcctggcccgcctgccccttgtcaacagctacacacgtgtgcccccactggtgtggaagcttggatggtcacccaaaccgggaggggattttggcacagcattccctgagatccccgtggagttcctccaggaaaaggaagtctttaaggagttcatctaccgcatcaacacactaggctggaccagtcgtactcagtttgaagaaacttgggccaccctccttggtgtcctggtgacgcagcccctcgtgatggagcaggaggagagcccaccagaagaagacacagagaggacccagatcaacgtcctggccgtgcaggccatcacctcactggtgctcagtgcaatgactgtgcctgtggccggcaacccagctgtaagctgcttggagcagcagccccggaacaagcctctgaaagctctcgacaccaggtttgggaggaagctgagcattatcagagggattgtggagcaagagattcaagcaatggtttcaaagagagagaatattgccacccatcatttatatcaggcatgggatcctgtcccttctctgtctccggctactacaggtgccctcatcagccacgagaagctgctgctacagatcaaccccgagcgggagctggggagcatgagctacaaactcggccaggtgtccatacactccgtgtggctggggaacagcatcacacccctgagggaggaggaatgggacgaggaagaggaggaggaggccgacgcccctgcaccttcgtcaccacccacgtctccagtcaactccaggaaacaccgggctggagttgacatccactcctgttcgcagtttttgcttgagttgtacagccgctggatcctgccgtccagctcagccaggaggaccccggccatcctgatcagtgaggtggtcagatcccttctagtggtctcagacttgttcaccgagcgcaaccagtttgagctgatgtatgtgacgctgacagaactgcgaagggtgcacccttcagaagacgagatcctcgctcagtacctggtgcctgccacctgcaaggcagctgccgtccttgggatggacaaggccgtggcggagcctgtcagccgcctgctggagagcacgctcaggagcagccacctgcccagcagggttggagccctgcacggcgtcctctatgtgctggagtgcgacctgctggacgacactgccaagcagctcatcccggtcatcagcgactatctcctctccaacctgaaagggatcgcccactgcgtgaacattcacagccagcagcacgtactggtcatgtgtgccactgcgttttacctcattgagaactatcctctggacgtagggccggaattttcagcatcaataatacagatgtgtggggtgatgctgtctggaagtgaggagtccaccccctccatcatttaccactgtgccctcagaggcctggagcgcctcctgctctctgagcagctctcccgcctggatgcagaatcgctggtcaagctgagtgtggacagagtgaacgtgcacagcccgcaccgggccatggcggctctgggcctgatgctcacctgcatgtacacaggaaaggagaaagtcagtccgggtagaacttcagaccctaatcctgcagcccccgacagcgagtcagtgattgttgctatggagcgggtatctgttctttttgataggatcaggaaaggctttccttgtgaagccagagtggtggccaggatcctgccccagtttctagacgacttcttcccaccccaggacatcatgaacaaagtcatcggagagtttctgtccaaccagcagccatacccccagttcatggccaccgtggtgtataaggtgtttcagactctgcacagcaccgggcagtcgtccatggtccgggactgggtcatgctgtccctctccaacttcacgcagagggccccggtcgccatggccacgtggagcctctcctgcttctttgtcagcgcgtccaccagcccgtgggtcgcggcgatcctcccacatgtcatcagcaggatgggcaagctggagcaggtggacgtgaaccttttctgcctggtcgccacagacttctacagacaccagatagaggaggagctcgaccgcagggccttccagtctgtgcttgaggtggttgcagccccaggaagcccatatcaccggctgctgacttgtttacgaaatgtccacaaggtcaccacctgctgagcgccatggtgggagagactgtgaggcggcagctggggccggagcctttggaagtctgtgcccttgtgccctgcctccaccgagccagcttggtccctatgggcttccgcacatgccgcgggcggccaggcaacgtgcgtgtctctgccatgtggcagaagtgctctttgtggcagtggccaggcagggagtgtctgcagtcctggtggggctgagcctgaggccttccagaaagcaggagcagctgtgctgcaccccatgtgggtgaccaggtcctttctcctgatagtcacctgctggttgttgccaggttgcagctgctcttgcatctgggccagaagtcctccctcctgcaggctggctgttggcccctctgctgtcctgcagtagaaggtgccgtgagcaggctttgggaacactggcctgggtctccctggtggggtgtgcatgccacgccccgtgtctggatgcacagatgccatggcctgtgctgggccagtggctgggggtgctagacacccggcaccattctcccttctctcttttcttctcaggatttaaaatttaattatatcagtaaagagattaattttaacgaactctttctatgcccgtgtaaagtatgtgaatcgcaaggcctgtgctgcatgcgacagcgtccggggtggtggacagggcccccggccacgctccctctcctgtagccactggcatagccctcctgagcacccgctgacatttccgttgtacatgttcctgtttatgcattcacaaggtgactgggatgtagagaggcgttagtgggcaggtggccacagcaggactgaggacaggcccccattatcctaggggtgcgctcaactgcagcccctcctcctcgggcacagacgactgtcgttctccacccaccagtcagggacagcagcctccctgtcactcagctgagaaggccagccctccctggctgtgagcagcctccactgtgtccagagacatgggcctcccactcctgttccttgctagccctggggtggcgtctgcctaggagctggctggcaggtgttgggacctgctgctccatggatgcatgccctaagagtgtcactgagctgtgttttgtctgagcctctctcggtcaacagcaaagcttggtgtcttggcactgttagtgacagagcccagcatcccttctgcccccgttccagctgacatcttgcacggtgaccccttttagtcaggagagtgcagatctgtgctcatcggagactgccccacggccctgtcagagccgccactcctatccccaggacaggtccctggaccagcctcctgtttgcaggcccagaggagccaagtcattaaaatggaagtggattctggatggccgggctgctgctgatgtaggagctggatttgggagctctgcttgccgactggctgtgagacgaggcaggggctctgcttcctcagccctagaggcgagccaggcaaggttggcgactgtcatgtggcttggtttggtcatgcccgtcgatgttttgggtattgaatgtggtaagtggaggaaatgttggaactctgtgcaggtgctgccttgagacccccaagcttccacctgtccctctcctatgtggcagctggggagcagctgagatgtggacttgtatgctgcccacatacgtgagggggagctgaaagggagcccctgctcaaagggagcccctcctctgagcagcctctgccaggcctgtatgaggcttttcccaccagctcccaacagaggcctcccccagccaggaccacctcgtcctcgtggcggggcagcaggagcggtagaaaggggtccgatgtttgaggaggcccttaagggaagctactgaattataacacgtaagaaaatcaccattcttccgtattggttgggggctcctgtttctcatcctagctttttcctggaaaagcccgctagaaggtttgggaacgaggggaaagttctcagaactgttgctgctccccacccgcctcccgcctcccccgcaggttatgtcagcagctctgagacagcagtatcacaggccagatgttgttcctggctagatgtttacatttgtaagaaataacactgtgaatgtaaaacagagccattcccttggaatgcatatcgctgggctcaacatagagtttgtcttcctcttgtttacgacgtgatctaaaccagtccttagcaaggggctcagaacaccccgctctggcagtaggtgtcccccacccccaaagacctgcctgtgtgctccggagatgaatatgagctcattagtaaaaatgacttcacccacgcatatacataaagtatccatgcatgtgcatatagacacatctataattttacacacacacctctcaagacggagatgcatggcctctaagagtgcccgtgtcggttcttcctggaagttgactttccttagacccgccaggtcaagttagccgcgtgacggacatccaggcgtgggacgtggtcagggcagggctcattcattgcccactaggatcccactggcgaagatggtctccatatcagctctctgcagaagggaggaagactttatcatgttcctaaaaatctgtggcaagcacccatcgtattatccaaattttgttgcaaatgtgattaatttggttgtcaagttttgggggtgggctgtggggagattgcttttgttttcctgctggtaatatcgggaaagattttaatgaaaccagggtagaattgtttggcaatgcactgaagcgtgtttctttcccaaaatgtgcctcccttccgctgcgggcccagctgagtctatgtaggtgatgtttccagctgccaagtgctctttgttactgtccaccctcatttctgccagcgcatgtgtcctttcaaggggaaaatgtgaagctgaaccccctccagacacccagaatgtagcatctgagaaggccctgtgccctaaaggacacccctcgcccccatcttcatggagggggtcatttcagagccctcggagccaatgaacagctcctcctcttggagctgagatgagccccacgtggagctcgggacggatagtagacagcaataactcggtgtgtggccgcctggcaggtggaacttcctcccgttgcggggtggagtgaggttagttctgtgtgtctggtgggtggagtcaggcttctcttgctacctgtgagcatccttcccagcagacatcctcatcgggctttgtccctcccccgcttcctccctctgcggggaggacccgggaccacagctgctggccagggtagacttggagctgtcctccagaggggtcacgtgtaggagtgagaagaaggaagatcttgagagctgctgagggaccttggagagctcaggatggctcagacgaggacactcgcttgccgggcctggccctcctgggaaggagggagctgctcagaatgccgcatgacaactgaaggcaacctggaaggttcagggcccgctcttcccccatgtgcctgtcacgctctggtgcagtcaaaggaacgccttcccctcagttgtttctaagagcagagtctcccgctgcaatctgggtggtaactgccagccttggaggatcgtggccaacgtggacctgcctacggagggtgggctctgacccaagtggggcctccttgcccaggtctcactgctttgcaccgtggtcagagggactgtcagctgagcttgagctcccctggagccagcagggctgtgatgggcgagtcccggagccccacccagacctgaatgcttctgagagcaaagggaaggactgacgagagatgtatatttaattttttaactgctgcaaacattgtacatccaaattaaagggaaaaaatggaaaccatcaat

SEQ ID NO: 728 - DNA, 3062 bp, Homo sapiens
  ref <308>: DATABASE ACCESSION NUMBER: NM_002115
  ref <309>: DATABASE ENTRY DATE: 2001-06-18
gacaagagctcagacctgaggagagtgactagcttctctgtgtcccaggtggccaccttccactgtggaagctcatggactccattgggtcttcagggttgcggcagggggaagaaaccctgagttgctctgaggagggcttgcccgggccctcagacagctcagagctggtgcaggagtgcctgcagcagttcaaggtgacaagggcacagctacagcagatccaagccagcctcttgggttccatggagcaggcgctgaggggacaggccagccctgcccctgcggtccggatgctgcctacatacgtggggtccaccccacatggcactgagcaaggagacttcgtggtgctggagctgggggccacaggggcctcactgcgtgttttgtgggtgactctaactggcattgaggggcatagggtggagcccagaagccaggagtttgtgatcccccaagaggtgatgctgggtgctggccagcagctctttgactttgctgcccactgcctgtctgagttcctggatgcgcagcctgtgaacaaacagggtctgcagcttggcttcagcttctctttcccttgtcaccagacgggcttggacaggagcaccctcatttcctggaccaaaggttttaggtgcagtggtgtggaaggccaggatgtggtccagctgctgagagatgccattcggaggcagggggcctacaacatcgacgtggttgctgtggtgaacgacacagtgggcaccatgatgggctgtgagccgggggtcaggccgtgtgaggttgggctagttgtagacacgggcaccaacgcgtgttacatggaggaggcacggcatgtggcagtgctggacgaagaccggggccgcgtctgcgtcagcgtcgagtggggctccttaagcgatgatggggcgctgggaccagtgctgaccaccttcgaccataccctggaccatgagtccctgaatcctggtgctcagaggtttgagaagatgatcggaggcctgtacctgggtgagctggtgcggctggtgctggctcacttggcccggtgtggggtcctctttggtggctgcacctcccctgccctgctgagccaaggcagcatcctcctggaacacgtggctgagatggaggacccctctactggggcagcccgtgtccatgctatcctgcaggacttgggcctgagccctggggcttcggatgttgagcttgtgcagcacgtctgtgcggccgtgtgcacgcgggctgcccagctctgtgctgccgccctggccgctgttctctcctgcctccagcacagccgggagcaacaaacactccaggttgctgtggccaccggaggccgagtgtgtgagcggcaccccaggttctgcagcgtcctgcaggggacagtgatgctcctggccccggaatgcgatgtctccttaatcccctctgtggatggtggtggccggggagtggcgatggtgactgctgtggctgcccgtctggctgcccaccggcgcctgctggaggagaccctggccccattccggttgaaccatgatcaactggctgcggttcaggcacagatgcggaaggccatggccaaggggctccgaggggaggcctcctcccttcgcatgctgcccactttcgtccgggccacccctgacggcagcgagcgaggggatttcctggccctggacctcgggggcacgaacttccgtgtcctcctggtacgtgtgaccacaggcgtgcagatcaccagcgagatctactccattcccgagactgtggcccagggttctgggcagcagctctttgaccacatcgtggactgcatcgtggacttccagcagaagcagggcctgagcgggcagagcctcccactgggttttaccttctccttcccatgtaggcagcttggcctagaccagggcatcctcctgaactggaccaagggtttcaaggcatcagactgcgagggccaagatgtcgtgagtctgttgcgggaagccatcactcgcagacaggcagtggagctgaatgtggttgccattgtcaatgacacggtggggaccatgatgtcctgtggctatgaggacccccgttgcgagataggcctcattgtcggaaccggcaccaatgcctgctacatggaggagctccggaatgtggcgggcgtgcctggggactcaggccgcatgtgcatcaacatggagtggggcgcctttggggacgatggctctctggccatgctcagcacccgctttgatgcaagtgtggaccaggcgtccatcaaccccggcaagcagaggtttgaaaagatgatcagcggcatgtacctgggggagatcgtccgccacatccttttacatttaaccagccttggcgttctcttccggggccagcagatccagcgccttcagaccagggacatcttcaagaccaagttcctctctgagatcgaaagtgacagcctggccctgcggcaggtccgagccatcctagaggatctggggctacccctgacctcagatgacgccctgatggtgctagaggtgtgccaggctgtgtcccagagggctgcccagctctgtggggcgggtgtagctgccgtggtggagaagatccgggggaaccggggcctggaagagctggcagtgtctgtgggggtggatggaacgctctacaagctgcacccgcgcttctccagcctggtggcggccacagtgcgggagctggcccctcgctgtgtggtcacgttcctgcagtcagaggatgggtccggcaaaggtgcggccctggtcaccgctgttgcctgccgccttgcgcagttgactcgtgtctgaggaaacctccaggctgaggaggtctccgccgcagccttgctggagccgggtcggggtctgcctgtttcccagccaggcccagccacccaggactcctgggacatcccatgtgtgacccctctgcggccatttggccttgctccctggctttccctgagagaagtagcactcaggttagcaatatatatatataatttatttacaaaaaaaaaaaaa

SEQ ID NO: 729 - DNA, 1362 bp, Homo sapiens
  ref <308>: DATABASE ACCESSION NUMBER: NM_002118
  ref <309>: DATABASE ENTRY DATE: 2001-06-18
cctgtttgggacactggactcccgtgagctggaaggaacagatttaatatctaggggctgggtatccccacatcactcatttggggggtcaagggacccgggcaatatagtattctgctcagtgtctggagatcatctacccaggctggggcttctgggacaggcgaggacccacggaccctggaagagctggtccaggggactgaactcccggcatctttacagagcagagcatgatcacattcctgccgctgctgctggggctcagcctgggctgcacaggagcaggtggcttcgtggcccatgtggaaagcacctgtctgttggatgatgctgggactccaaaggatttcacatactgcatctccttcaacaaggatctgctgacctgctgggatccagaggagaataagatggccccttgcgaatttggggtgctgaatagcttggcgaatgtcctctcacagcacctcaaccaaaaagacaccctgatgcagcgcttgcgcaatgggcttcagaattgtgccacacacacccagcccttctggggatcactgaccaacaggacacggccaccatctgtgcaagtagccaaaaccactccttttaacacgagggagcctgtgatgctggcctgctatgtgtggggcttctatccagcagaagtgactatcacgtggaggaagaacgggaagcttgtcatgcctcacagcagtgcgcacaagactgcccagcccaatggagactggacataccagaccctctcccatttagccttaaccccctcttacggggacacttacacctgtgtggtagagcacattggggctcctgagcccatccttcgggactggacacctgggctgtcccccatgcagaccctgaaggtttctgtgtctgcagtgactctgggcctgggcctcatcatcttctctcttggtgtgatcagctggcggagagctggccactctagttacactcctcttcctgggtccaattattcagaaggatggcacatttcctagaggcagaatcctacaacttccactccaagtgagaaggagattcaaactcaatgatgctaccatgcctctccaacatcttcaaccccctgacattatcttggatcctatggtttctccatccaattctttgaatttcccagtctcccctatgtaaaacttagcaacttgggggacctcattcctgggactatgctgtaaccaaattattgtccaaggctatatttctgggatgaatataatctgaggaagggagttaaagaccctcctggggctctcagtgtgccatagaggacagcaactggtgattgtttcagagaaataaactttggtggaaaaa

SEQ ID NO: 730 - DNA, 1192 bp, Homo sapiens
  ref <308>: DATABASE ACCESSION NUMBER: NM_002123
  ref <309>: DATABASE ENTRY DATE: 2001-06-18
cagatccatcaggtccaagctgtgttgactaccactgcttttcccttcgtctcaattatgtcttggaagaaggctttgcggatccctggaggccttcgggtagcaactgtgaccttgatgctggcgatgctgagcaccccggtggctgagggcagagactctcccgaggatttcgtgtaccagtttaagggcatgtgctacttcaccaacgggacggagcgcgtgcgtcttgtgaccagatacatctataaccgagaggagtacgcacgcttcgacagcgacgtgggggtgtatcgggcggtgacgccgctggggccgcctgacgccgagtactggaacagccagaaggaagtcctggagaggacccgggcggagttggacacggtgtgcagacacaactaccagttggagctccgcacgaccttgcagcggcgagtggagcccacagtgaccatctccccatccaggacagaggccctcaaccaccacaacctgctggtctgctcagtgacagatttctatccagcccagatcaaagtccggtggtttcggaatgaccaggaggagacaactggcgttgtgtccaccccccttattaggaacggtgactggaccttccagatcctggtgatgctggaaatgactccccagcgtggagacgtctacacctgccacgtggagcaccccagcctccagaaccccatcatcgtggagtggcgggctcagtctgaatctgcccagagcaagatgctgagtggcattggaggcttcgtgctggggctgatcttcctcgggctgggccttattatccatcacaggagtcagaaagggctcctgcactgactcctgagactattttaactgggattggttatcacttttctgtaacgcctgcttgtccctgcccagaattcccagctgcctgtgtcagcctgtcccccgagatcagagtcctaccgtggctgtcacgcagccaccaggtcatctcctttcatccccacctcaaggctgatggctgtgaccctgcttcctgcactgacccagagcctctgcctgtgcacggccagctgcgtctactgaggccccaaggggtttctgtttctattctctcctcagactgctcaagagaagcacatgaaaaccattacctgactttagagcttttttacataattaaacatgatcctgagtt

SEQ ID NO: 731 - DNA, 1875 bp, Homo sapiens
  ref <308>: DATABASE ACCESSION NUMBER: NM_002131
  ref <309>: DATABASE ENTRY DATE: 2001-06-18
ggccggtgctgcgctcctctaattgggactccgagccggggctatttctggcgctggccgggctccaagaaggcatccgcatttgctaccagcggcggccgcggcggagccaggccggtcctcagcgcccagcaccgccgctcccggcaacccggagcgcgcaccgcagccggcggccgagctcgcgcatcccagccatcactcttccacctgctccttagagaagggaagatgagtgagtcgagctcgaagtccagccagcccttggcctccaagcaggaaaaggacggcactgagaagcggggccggggcaggccgcgcaagcagcctccgaaggagcccagcgaagtgccaacacctaagagacctcggggccgaccaaagggaagcaaaaacaagggtgctgccaagacccggaaaaccaccacaactccaggaaggaaaccaaggggcagacccaaaaaactggagaaggaggaagaggagggcatctcgcaggagtcctcggaggaggagcagtgacccatgcgtgccgcctgctcctcactggaggagcagcttccttctgggactggacagctttgctccgctcccaccgcccccgccccttccccaggcccaccatcaccaccgcctctggccgccacccccatcttccacctgtgccctcaccaccacactacacagcacaccagccgctgcagggctcccatgggctgagtggggagcagttttcccctggcctcagttcccagctccccccgcccacccacgcatacacacatgccctcctggacaaggctaacatcccacttagccgcaccctgcacctgctgcgtccccactcccttggtggtggggacattgctctctgggcttttggtttgggggcgccctctctgcctccttcactgttccctctggcttcccatagtggggcctgggagggttccccctggccttaaaaggggcccaagcccatctcatcctggcacgccctactccactgccctggcagcagcaggtgtggccaatggaggggggtgctggcccccaggattcccccagccaaactgtctttgtcaccacgtggggctcacttttcatccttccccaacttccctagtccccgtactaggttggacagcccccttcggctacaggaaggcaggaggggtgagtcccctactccctcttcactgtggccacagcccccttgccctccgcctgggatctgagtacatattgtggtgatggagatgcagtcacttattgtccaggtgaggcccaagagccctgtggccgccacctgaggtgggctggggctgctcccctaaccctactttgcttccgccactcagccatttccccctcctcagatggggcaccaataacaaggagctcaccctgcccgctcccaacccccctcctgctcctccctgccccccaaggttctggttccatttttcctctgttcacaaactacctctggacagttgtgttgttttttgttcaatgttccattcttcgacatccgtcattgctgctgctaccagcgccaaatgttcatcctcattgcctcctgttctgcccacgatcccctcccccaagatactctttgtggggaagaggggctggggcatggcaggctgggtgaccgactaccccagtcccagggaaggtgccctgcccctaggatgctgcagcagagtgagcaagggggcccgaatcgaccataaagggtgtaggggccacctcctccccctgttctgttggggaggggtagccatgatttgtcccagcctggggctccctctctggtttcctatttacagttacttgaataaaaaaaatatccttttctggaaaaaaaaa

SEQ ID NO: 732 - DNA, 1769 bp, Homo sapiens
  ref <308>: DATABASE ACCESSION NUMBER: NM_002136
  ref <309>: DATABASE ENTRY DATE: 2001-06-18
gagagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctctaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggcaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaa

SEQ ID NO: 733 - DNA, 1520 bp, Homo sapiens
  ref <308>: DATABASE ACCESSION NUMBER: NM_002145
  ref <309>: DATABASE ENTRY DATE: 2001-06-18
gaattccgggggggggtcccttccgatcctccctcctgacgccccccccagcagccccctcccccaccattgaaagccatgaattttgaatttgagagggagattgggtttataaacagccagccgtcgctcgccgagtgtctgacttccttccccgctgtcttggagacatttcaaacttcatcaatcaaggagtcgacattaattcctcctcctcctcctttcgagcaaaccttccccagcctccagcccggcgcctccacccttcagagacccaggagccaaaagcgagccgaagatgggcctgctctgccgccgccaccgccgccgccactccccgctgcccccccggcccccgagttcccttggatgaaagagaagaaatccgccaagaaacccagccaatccgccacgtctccttctccggccgcctccgccgttccggcctccggggtcggatcgcctgcagatggcctgggactgccggaggctggtggcggcggggcgcgcaggctgcgcacggcttacaccaacacgcagctgctggaactggagaaggaattccactttaataagtacctgtgccggccacgccgcgtcgagatcgcggccttgctggacctcaccgaaaggcaggtcaaagtctggtttcagaaccggcgcatgaagcacaagcggcagacgcagcaccgagagccgccggatggggagcctgcctgcccgggagccctggaggacatctgcgaccctgccgaggaacccgcggccagcccgggcggcccctccgcctcgcgggcggcgtgggaagcctgctgtcacccgccggaggtggtgccgggggccttaagcgcggacccccggcctttagccgttcgcttagagggcgcaggcgcgtcgagtcccggctgcgcgctgcgcggggccggcgggctggagcccgggccattgccagaagacgtcttctcggggcgccaggattcacctttccttcccgacctcaacttcttcgcggccgactcctgtctccagctatccggaggcctctcccctagcctacagggttctctcgacagcccggtccctttttccgaggaagagctggattttttcaccagtacgctctgtgccatcgacctgcagtttccctaacctgtttcctcctcccggtcctttcgacccccgcgctccttggccgtctactggaaaaatcgagcctctcccaccctcagtcgcatagacttatgtgttttgctaaaattcaggtattactgaattagcgtttaatccacttcctttcttcttcttctaaaatattgggcactcggttatcttttaaaattcacacagaaaaattccgtttggtagactccttccaatgaaatctcaggaataattaaactctagggggactttcttaaaaataactagagggacctattttcctcttttttatgttttagactgtagattatttattaaaattctttaataataggaaaaggggaaagtatttattgtac

SEQ ID NO: 734 - DNA, 1475 bp, Homo sapiens
  ref <308>: DATABASE ACCESSION NUMBER: NM_002164
  ref <309>: DATABASE ENTRY DATE: 2001-06-18
cccagaggagcagactacaagaatggcacacgctatggaaaactcctggacaatcagtaaagagtaccatattgatgaagaagtgggctttgctctgccaaatccacaggaaaatctacctgatttttataatgactggatgttcattgctaaacatctgcctgatctcatagagtctggccagcttcgagaaagagttgagaagttaaacatgctcagcattgatcatctcacagaccacaagtcacagcgccttgcacgtctagttctgggatgcatcaccatggcatatgtgtggggcaaaggtcatggagatgtccgtaaggtcttgccaagaaatattgctgttccttactgccaactctccaagaaactggaactgcctcctattttggtttatgcagactgtgtcttggcaaactggaagaaaaaggatcctaataagcccctgacttatgagaacatggacgttttgttctcatttcgtgatggagactgcagtaaaggattcttcctggtctctctattggtggaaatagcagctgcttctgcaatcaaagtaattcctactgtattcaaggcaatgcaaatgcaagaacgggacactttgctaaaggcgctgttggaaatagcttcttgcttggagaaagcccttcaagtgtttcaccaaatccacgatcatgtgaacccaaaagcatttttcagtgttcttcgcatatatttgtctggctggaaaggcaacccccagctatcagacggtctggtgtatgaagggttctgggaagacccaaaggagtttgcagggggcagtgcaggccaaagcagcgtctttcagtgctttgacgtcctgctgggcatccagcagactgctggtggaggacatgctgctcagttcctccaggacatgagaagatatatgccaccagctcacaggaacttcctgtgctcattagagtcaaatccctcagtccgtgagtttgtcctttcaaaaggtgatgctggcctgcgggaagcttatgacgcctgtgtgaaagctctggtctccctgaggagctaccatctgcaaatcgtgactaagtacatcctgattcctgcaagccagcagccaaaggagaataagacctctgaagacccttcaaaactggaagccaaaggaactggaggcactgatttaatgaatttcctgaagactgtaagaagtacaactgagaaatcccttttgaaggaaggttaatgtaacccaacaagagcacattttatcatagcagagacatctgtatgcattcctgtcattacccattgtaacagagccacaaactaatactatgcaatgttttaccaataatgcaatacaaaagacctcaaaatacctgtgcatttcttgtaggaaaacaacaaaaggtaattatgtgtaattatactagaagttttgtaatctgtatcttatcattggaataaaatgacattcaataaat

SEQ ID NO: 735 - DNA, 1751 bp, Homo sapiens
  ref <308>: DATABASE ACCESSION NUMBER: NM_002168
  ref <309>: DATABASE ENTRY DATE: 2001-06-18
ccagcgttagcccgcggccaggcagccgggaggagcggcgcgcgctcggacctctcccgccctgctcgttcgctctccagcttgggatggccggctacctgcgggtcgtgcgctcgctctgcagagcctcaggctcgcggccggcctgggcgccggcggccctgacagcccccacctcgcaagagcatccgcggcgccactatgccgacaaaaggatcaaggtggcgaagcccgtggtggagatggatggtgatgagatgacccgtattatctggcagttcatcaaggagaagctcatcctgccccacgtggacatccagctaaagtattttgacctcgggctcccaaaccgtgaccagactgatgaccaggtcaccattgactctgcactggccacccagaagtacagtgtggctgtcaagtgtgccaccatcacccctgatgaggcccgtgtggaagagttcaagctgaagaagatgtggaaaagtcccaatggaactatccggaacatcctgggggggactgtcttccgggagcccatcatctgcaaaaacatcccacgcctagtccctggctggaccaagcccatcaccattggcaggcacgcccatggcgaccagtacaaggccacagactttgtggcagaccgggccggcactttcaaaatggtcttcaccccaaaagatggcagtggtgtcaaggagtgggaagtgtacaactttcccgcaggcggcgtgggcatgggcatgtacaacaccgacgagtccatctcaggttttgcgcacagctgcttccagtatgccatccagaagaaatggccgctgtacatgagcaccaagaacaccatactgaaagcctacgatgggcgtttcaaggacatcttccaggagatctttgacaagcactataagaccgacttcgacaagaataagatctggtatgagcaccggctcattgatgacatggtggctcaggtcctcaagtcttcgggtggctttgtgtgggcctgcaagaactatgacggagatgtgcagtcagacatcctggcccagggctttggctcccttggcctgatgacgtccgtcctggtctgccctgatgggaagacgattgaggctgaggccgctcatgggaccgtcacccgccactatcgggagcaccagaagggccggcccaccagcaccaaccccatcgccagcatctttgcctggacacgtggcctggagcaccgggggaagctggatgggaaccaagacctcatcaggtttgcccagatgctggagaaggtgtgcgtggagacggtggagagtggagccatgaccaaggacctggcgggctgcattcacggcctcagcaatgtgaagctgaacgagcacttcctgaacaccatggacttcctcgacaccatcaagagcaacctggacagagccctgggcaggcagtagggggaggcgccacccatggctgcagtggaggggccagggctgagccggcgggtcctcctgagcgcggcagagggtgagcctcacagcccctctctggaggcctttctaggggatgtttttttataagccagatgtttttaaaagcatatgtgtgtttcccctcatggtgacgtgaggcaggagcagtgcgttttacctcagccagtcagtatgttttgcatactgtaatttatattgcccttggaacacatggtgccatatttagctactaaaaagctcttcacaaaaaaaaaaacggattccgcg

SEQ ID NO: 736 - DNA, 3085 bp, Homo sapiens
  ref <308>: DATABASE ACCESSION NUMBER: NM_002184
  ref <309>: DATABASE ENTRY DATE: 2001-06-18
gagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgagtgaaacccaatggaaaaagcatgacatttagaagtagaagacttagcttcaaatccctactccttcacttactaattttgtgatttggaaatatccgcgcaagatgttgacgttgcagacttgggtagtgcaagccttgtttattttcctcaccactgaatctacaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggcttgcctccagaaaaacctaaaaatttgagttgcattgtgaacgaggggaagaaaatgaggtgtgagtgggatggtggaagggaaacacacttggagacaaacttcactttaaaatctgaatgggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagaccatctaaagcaccaagtttctggtataaaatagatccatcccatactcaaggctacagaactgtacaactcgtgtggaagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagagggaacttagcagagagcaaatgctatttgataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtgacacattgtacatggtacgaatggcagcatacacagatgaaggtgggaaggatggtccagaattcacttttactaccccaaagtttgctcaaggagaaattgaagccatagtcgtgcctgtttgcttagcattcctattgacaactcttctgggagtgctgttctgctttaataagcgagacctaattaaaaaacacatctggcctaatgttccagatccttcaaagagtcatattgcccagtggtcacctcacactcctccaaggcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattc

SEQ ID NO: 737 - DNA, 1658 bp, Homo sapiens
  ref <308>: DATABASE ACCESSION NUMBER: NM_002185
  ref <309>: DATABASE ENTRY DATE: 2001-06-18
ctctctctctatctctctcagaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagcattcactgacctgtgcttttgaggacccagatgtcaacaccaccaatctggaatttgaaatatgtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactatagttaaacctgaggctccttttgacctgagtgtcatctatcgggaaggagccaatgactttgtggtgacatttaatacatcacacttgcaaaagaagtatgtaaaagttttaatgcatgatgtagcttaccgccaggaaaaggatgaaaacaaatggacgcatgtgaatttatccagcacaaagctgacactcctgcagagaaagctccaaccggcagcaatgtatgagattaaagttcgatccatccctgatcactattttaaaggcttctggagtgaatggagtccaagttattacttcagaactccagagatcaataatagctcaggggagatggatcctatcttactaaccatcagcattttgagttttttctctgtcgctctgttggtcatcttggcctgtgtgttatggaaaaaaaggattaagcctatcgtatggcccagtctccccgatcataagaagactctggaacatctttgtaagaaaccaagaaaaaatttaaatgtgagtttcaatcctgaaagtttcctggactgccagattcatagggtggatgacattcaagctagagatgaagtggaaggttttctgcaagatacgtttcctcagcaactagaagaatctgagaagcagaggcttggaggggatgtgcagagccccaactgcccatctgaggatgtagtcgtcactccagaaagctttggaagagattcatccctcacatgcctggctgggaatgtcagtgcatgtgacgcccctattctctcctcttccaggtccctagactgcagggagagtggcaagaatgggcctcatgtgtaccaggacctcctgcttagccttgggactacaaacagcacgctgccccctccattttctctccaatctggaatcctgacattgaacccagttgctcagggtcagcccattcttacttccctgggatcaaatcaagaagaagcatatgtcaccatgtccagcttctaccaaaaccagtgaagtgtaagaaacccagactgaacttaccgtgagcgacaaagatgatttaaaagggaagtctagagttcctagtctccctcacagcacagagaagacaaaattagcaaaaccccactacacagtctgcaagattctgaaacattgctttgaccactcttcctgagttcagtggcactcaacatgagtcaagagcatcctgcttctaccatgtggatttggtcacaaggtttaaggtgacccaatgattcagctattt

SEQ ID NO: 738 - DNA, 1610 bp, Homo sapiens
  ref <308>: DATABASE ACCESSION NUMBER: NM_002189
  ref <309>: DATABASE ENTRY DATE: 2001-06-18
cccagagcagcgctcgccacctccccccggcctgggcagcgctcgcccggggagtccagcggtgtcctgtggagctgccgccatggccccgcggcgggcgcgcggctgccggaccctcggtctcccggcgctgctactgctgctgctgctccggccgccggcgacgcggggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcctctctgctttagctaaagacgactgagaagaggtgcaaggaagcgggctccaggagcaagctcaccaggcctctcagaagtcccagcaggatctcacggactgccgggtcggcgcctcctgcgcgagggagcaggttctccgcattcccatgggcaccacctgcctgcctgtcgtgccttggacccagggcccagcttcccaggagagaccaaaggcttctgagcaggatttttatttcattacagtgtgagctgcctggaatacatgtggtaatgaaataaaaaccctgccccgaatcttccgtccctcatcctaacttgcagttcacagagaaaagtgacatacccaaagctctctgtcaattacaaggcttctcctggcgtgggagacgtctacagggaagacaccagcgtttgggcttctaaccaccctgtctccagctgctctgcacacatggacagggacctgggaaaggtgggagagatgctgagcccagcgaatcctctccattgaaggattcaggaagaagaaaactcaactcagtgccattttacgaatatatgcgtttatatttatacttccttgtctattatatctatacattatatattatttgtattttgacattgtaccttgtataaacaaaataaaacatctattttcaatatttttaaaatgca

SEQ ID NO: 739 - DNA, 2187 bp, Homo sapiens
  ref <308>: DATABASE ACCESSION NUMBER: NM_002200
  ref <309>: DATABASE ENTRY DATE: 2001-06-18
gcggcgggaggcgcagcctgggcagagctcagcttggtcccgccgcccggccggtgctccctggcgcagccacgcaggcgcaccgcagacagacccctctgccatgaaccagtccatcccagtggctcccaccccaccccgccgcgtgcggctgaagccctggctggtggcccaggtgaacagctgccagtacccagggcttcaatgggtcaacggggaaaagaaattattctgcatcccctggaggcatgccacaaggcatggtcccagccaggacggagataacaccatcttcaaggcctgggccaaggagacagggaaatacaccgaaggcgtggatgaagccgatccggccaagtggaaggccaacctgcgctgtgcccttaacaagagccgggacttccgcctcatctacgacgggccccgggacatgccacctcagccctacaagatctacgaggtctgctccaatggccctgctcccacagactcccagccccctgaggattactcttttggtgcaggagaggaggaggaagaagaggaagagctgcagaggatgttgccaagcctgagcctcacagatgcagtgcagtctggcccccacatgacaccctattctttactcaaagaggatgtcaagtggccgcccactctgcagccgcccactctgcagccgcccgtggtgctgggtccccctgctccagaccccagccccctggctcctccccctggcaaccctgctggcttcagggagcttctctctgaggtcctggagcctgggcccctgcctgccagcctgccccctgcaggcgaacagctcctgccagacctgctgatcagcccccacatgctgcctctgaccgacctggagatcaagtttcagtaccgggggcggccaccccgggccctcaccatcagcaacccccatggctgccggctcttctacagccagctggaggccacccaggagcaggtggaactcttcggccccataagcctggagcaagtgcgcttccccagccctgaggacatccccagtgacaagcagcgcttctacacgaaccagctgctggatgtcctggaccgcgggctcatcctccagctacagggccaggacctttatgccatccgcctgtgtcagtgcaaggtgttctggagcgggccttgtgcctcagcccatgactcatgccccaaccccatccagcgggaggtcaagaccaagcttttcagcctggagcattttctcaatgagctcatcctgttccaaaagggccagaccaacaccccaccacccttcgagatcttcttctgctttggggaagaatggcctgaccgcaaaccccgagagaagaagctcattactgtacaggtggtgcctgtagcagctcgactgctgctggagatgttctcaggggagctatcttggtcagctgatagtatccggctacagatctcaaacccagacctcaaagaccgcatggtggagcaattcaaggagctccatcacatctggcagtcccagcagcggttgcagcctgtggcccaggcccctcctggagcaggccttggtgttggccaggggccctggcctatgcacccagctggcatgcaataacaaggctgcagacggtgactggccctggcttcctgggtggcggtgcggactgatgtggagatgtgacagccccgatgagcacctggctggctgcagggtcctacctctgggtttcctggaagtggatttgggccaagaaggagagggagaaaggcccgagcccctgccttcccgggcctttctctcctgggctgtctctggtctggtcagcctggctctcgggaaattcagccatgagcagggaaagaactctcccaaccctggggcctagctgtataggaggaattgcctaagggtggcccactcttgtgattgccccatttcctctggcaacaaaagccagagtgttgtgggccaagtccccccacagggcctctgcagggcatggccctgatttccctggtttgagactcacttcctcatctccctgtcctctgagataatatgagtgagcacttaggtatcatatcagatgctcaaggctggcagctacccccttcttgagagtccaagaacctggagcagaaataatttttatgtatttttggattaataaatgttaaaaacag

SEQ ID NO: 740 - DNA, 679 bp, Homo sapiens
  ref <308>: DATABASE ACCESSION NUMBER: NM_002201
  ref <309>: DATABASE ENTRY DATE: 2001-06-18
gggtccccaaggaacatggctgggagccgtgaggtggtggccatggactgcgagatggtggggctggggccccaccgggagagtggcctggctcgttgcagcctcgtgaacgtccacggtgctgtgctgtacgacaagttcatccggcctgagggagagatcaccgattacagaacccgggtcagcggggtcacccctcagcacatggtgggggccacaccatttgccgtggccaggctagagatcctgcagctcctgaaaggcaagctggtggtgggtcatgacctgaagcacgacttccaggcactgaaagaggacatgagcggctacacaatctacgacacgtccactgacaggctgttgtggcgtgaggccaagctggaccactgcaggcgtgtctccctgcgggtgctgagtgagcgcctcctgcacaagagcatccagaacagcctgcttggacacagctcggtggaagatgcgagggcaacgatggagctctatcaaatctcccagagaatccgagcccgccgagggctgccccgcctggctgtgtcagactgaagccccatccagcccgttccgcagggactagaggctttcggctttttgggacagcaactaccttgcttttggaaaatacatttttaatagtaaagtggctctatattttctctacgcc

SEQ ID NO: 741 - DNA, 3110 bp, Homo sapiens
  ref <308>: DATABASE ACCESSION NUMBER: NM_002213
  ref <309>: DATABASE ENTRY DATE: 2001-06-18
cgcgccgccgctgagggaggcgccccaccatgccgcgggccccggcgccgctgtacgcctgcctcctggggctctgcgcgctcctgccccggctcgcaggtctcaacatatgcactagtggaagtgccacctcatgtgaagaatgtctgctaatccacccaaaatgtgcctggtgctccaaagaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacgcggcaccgaggtaccagaccaatccgtgcattggttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggactatccatcccttgccttgcttggagagaaattggcagagaacaacatcaacctcatctttgcagtgacaaaaaaccattatatgctgtacaagaattttacagccctgatacctggaacaacggtggagattttagatggagactccaaaaatattattcaactgattattaatgcatacaatagtatccggtctaaagtggagttgtcagtctgggatcagcctgaggatcttaatctcttctttactgctacctgccaagatggggtatcctatcctggtcagaggaagtgtgagggtctgaagattggggacacggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagagagattgcgtcgagtgcctgctgctccactctgggaaacctgacaaccagacctgccacagcctatgcagggatgaggtgatcacatgggtggacaccatcgtgaaagatgaccaggaggctgtgctatgtttctacaaaaccgccaaggactgcgtcatgatgttcacctatgtggagctccccagtgggaagtccaacctgaccgtcctcagggagccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggcttcaaatccattatacagaaagcctatctccacgcacactgtggacttcaccttcaacaaatcctacaatggcactgtggactgatgtttccttctccgaggggctggagcggggatctgatgaaaaggatcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtgagtttcctctcctgtccgtgtttgtttagtacttttataatgaaaagaaacaagattgtttgggattggaagtaaagattaaaaccaaaagaatttgtgtttgtctgataaaaaaaaaaaaaaa

SEQ ID NO: 742 - DNA, 2472 bp, Homo sapiens
  ref <308>: DATABASE ACCESSION NUMBER: NM_002219
  ref <309>: DATABASE ENTRY DATE: 2001-06-18
ctgccagggttgggtgcgccgctgaacggatggctgagggagccccgcggatcgttaggaaagccggccagctgatcgtcgtgtgttgccacccattcatgtcaagatgactaagtttggatttttgcgattgtcctatgagaagcaggacacacttttgaagcttctcattctgtcaatggctgctgtattatccttctccactcgtctgtttgctgtcctgagatttgaaagtgttatccatgagtttgatccgtactttaattatcggactaccaggttcctggctgaggaggggttttataaattccataactggtttgatgaccgagcctggtaccctttgggacgaatcattggaggaacaatttacccaggtttaatgatcacctctgctgcaatctaccatgtactccattttttccacatcaccatcgacattcggaatgtctgtgtgttcctggcccctctcttctcctccttcacctccatcgtcacgtacctccttaccaaagagctcaaggatgcaggggctgggcttcttgctgctgccatgattgctgtagttcctggatatatctcccgatctgtggctggctcctatgataatgaagggattgccatcttttgcatgctactcacctactacatgtggatcaaggcagtaaagactggttccatctgttgggcagctaagtgtgcccttgcttatttctacatggtctcgtcatggggaggttatgtgttcctgatcaacttaattcctctccacgtcctcgtgctgatgctcacaggccgtttctctcaccggatctatgtggcctactgtactgtttactgcctgggtactatactttctaggcagatctcctttgtgggtttccagcctgtcctttcatcagagcacatggcagggtttggggtctttggtctctgccagatccatgcctttgtggattacctgcgcagcaagttgaatccacaacaatttgaagttcttttccggagcgtcatctctctggtaggctttgtccttctcaccgtgggagctctcctcatgctgacaggaaaaatatctccctggacggggcgtttctactcactgctggatccctcttatgctaagaacaacatccccatcattgcttctgtgtctgagcatcagcccacaacctggtcctcatactattttgacctgcagctcctcgtcttcatgtttccagttggcctctattactgctttagcaacctgtctgatgcccggatttttatcatcatgtatggtgtgaccagcatgtacttttcagctgtaatggtgcgtctaatgctagtgttggcacctgttatgagcattctctctggcattggagtctcccaggtgctgtccacatacatgaagaatctggacataagtcgcccagacaagaagagcaagaagcaacaggattccacctaccctattaagattgaagtggcaagtgggatgatactggtcatggctttctttctcatcacctacacctttcattcaacctgggtgaccagtgaggcctactcttctccgtccattgtactatctgcccgtggtggggatggcagtaggatcatatttgatgacttccgagaagcatattattggcttcgtcataatactccagaggatgcgaaggtcatgtcctggtgggattatggctatcagattacagctatggcaaaccgaacaattttagtggacaataacacatggaataatacccatatttctcgagtagggcaggcaatggcgtccacagaggaaaaagcctatgagatcatgagggagctcgatgtcagctatgtgctggtcatttttggaggcctcactgggtattcctctgatgatatcaacaagtttctttggatggtccggattggagggagcacagatacaggcaaacatatcaaggagaatgactattatactccaactggggagttccgtgtggaccgtgaaggttctccagtgctgctcaactgcctcatgtacaagatgtgttactatcgctttggacaggtttacacagaagccaagcgtcctccaggctttgaccgtgtccgaaatgctgagattgggaataaagactttgagcttgatgtcctggaggaaggctataccacagaacattggctggtcaggatatacaaggtaaaggacctggataatcgaggcttgtcaaggacataaatgtcacgtccagctctgatatcttcgcactgagcacatcacatttaggacgttgaagattttttttttttttttttttttaatatgcagtttgtaagaacaaaactggatggcatccgaattgtctggaagttttgtcttgggcatgatgggctgggccaaatgaaatgatttttataattctaaacaggttaccaaatgaaatgtcatggctttactttggtcaattaaaggggggaattttttta

SEQ ID NO: 743 - DNA, 9517 bp, Homo sapiens; identical to SEQ ID NO: 358
  ref <308>: DATABASE ACCESSION NUMBER: NM_002222
  ref <309>: DATABASE ENTRY DATE: 2001-06-18

SEQ ID NO: 744 - DNA, 2861 bp, Homo sapiens
  ref <308>: DATABASE ACCESSION NUMBER: NM_002239
  ref <309>: DATABASE ENTRY DATE: 2001-06-18
ctccgtcccaggggagaaggagaggcgtctgcagggggcagagaccgcagctacctgccgggtgcgccccccacccaggagcgctcgcttcgccccctttcctccccccgcccccacctccttattggtgctagtttgcagcgcccagctcctgcgccttcgcttcgcgtttgaatctggctcgccccttcgtattatgtctgcactccgaaggaaatttggggacgattatcaggtagtgaccacatcgtccagcggctcgggcttgcagccccaggggccaggccaggaccctcagcagcagcttgtgcccaagaagaagcggcagcggttcgtggacaagaacggccggtgcaatgtacagcacggcaacctgggcagcgagacaagccgctacctctcggacctcttcaccacgctggtggacctcaagtggcgctggaacctcttcatcttcattctcacctacaccgtggcctggcttttcatggcgtccatgtggtgggtgatcgcctacactcggggcgacctgaacaaagcccacgtcggtaactacacgccttgcgtggccaatgtctataacttcccttctgccttcctcttcttcatcgagacggaggccaccatcggctatggctaccgatacatcacagacaagtgccccgagggcatcatcctcttcctcttccagtccatcctgggctccatcgtggacgccttcctcatcggctgcatgttcatcaagatgtcccagcccaagaagcgcgccgagaccctcatgttcagcgagcacgcggtgatctccatgagggacggaaaactcacgcttatgttccgggtgggcaacctgcgcaacagccacatggtctccgcgcagattcgctgcaagctgctcaaatctcggcagacacctgagggtgagttccttccccttgaccaacttgaactggatgtaggttttagtacaggggcagatcaactttttcttgtgtcccccctcacaatttgccacgtgatcgatgccaaaagccccttttatgacctatcccagcgaagcatgcaaactgaacagttcgagattgtcgtcatcctagaaggcattgtggaaacaactgggatgacttgtcaagctcgaacatcatatactgaagatgaagttctttggggtcatcgtttttttcctgtaatttccttagaagagggattctttaaagttgattactcccagttccacgcaacatttgaagtccccaccccaccttacagtgtgaaagagcaggaggaaatgcttctcatgtcgtcccctttaatagcaccagccataactaacagcaaagaaagacataattctgtggaatgcttagatggactagatgatattactacaaaactaccatctaagctgcagaaaattactggaagagaagactttcccaaaaaactcttgaggatgagttctacaacttcagaaaaagcctacagcttgggagacttgcccatgaaacttcaacgaataagttcagttccgggcaactcagaagaaaaactggtatctaaaaccaccaagatgttatctgatcccatgagccagtctgtggctgatttgccaccaaagcttcaaaagatggctggaggagcagctaggatggaagggaaccttccagccaaattaagaaaaatgaactctgatcgcttcacataacaaagcactcccttaggcattatttaatgtttgatttagtaatagtccaatatttggcgatgaggtaattctccctaaggaatctgaaagtatattttcctcccagttctacagcatatttcgagaacccttcctttcccaagtattgcgaatgtgcagaaagcaacagttacggagggaggacatcataaggaagttattaacgggcatgtattatcacatcaagcatgcaataatgtgcaaattttgcatttagttttatggcatgatttatatatggcatatttatattgtatattctggaaaaaaaaatatatatatatatttaaaggggagatactctccctgacatttctaacatatgtattaagccaaacatgagtgaatagctttcagggcgataaaactaaatatatgtctgtgtgtgtgtgtgtatgtatacacacatatacatatatatatacacatacatacacatacatacatacatacatatatatctgataaaattgtgatgttttgttcaaagttgtagttcttgtgcatgtttactttattagagtaggaaggctactggcattaattattaataccaaatattttagccttaaatttttgtcattttaaaatctgatttaatgttttctgctgtttaaggtcttgggaggctttcaattgtattttatatgagagaatcacacaagtttgtgctatctatggccctgcaaaaatataaccattacatgtttaaattgtaaattttagagcataccagtactcagtatagcattgaacatttcttatgatttttaaaagttgctagtactggggagaaataattgttgattaatttgagaattattcctttcctagactaattaaaatctggaaatctgttttgtatatgatctaatacaaagatgagctctgaacaaacactgaatcatgttaatagacagtagccaagttatattgaatatatcagaatctgtgtgaagttacacaattaattgtccctgtttcaaactgagtaaattggaaacattttctttctttttctggaaattttgtccattttaaaaaccaatcattttaagaagacatgacaatgcaatgaaacagatgataaatatttatgcttaaaataaaaaaaaaaaaa

SEQ ID NO: 745 - DNA, 1911 bp, Homo sapiens
  ref <308>: DATABASE ACCESSION NUMBER: NM_002243
  ref <309>: DATABASE ENTRY DATE: 2001-06-18
actttttggctgttctgaagagtgttactgtgaacattcatgcacaaatttttatgtggggataacttttaactggtgaagagtataaatcgtggttttccaagtgtagtctaaggtctaacagcatcggggatatctgggaaattatcagaactacagaccctctggctgcaccccaaacctgctgaatcggaaattctgaggcagtagcagaatcccatggtagccaggtgggtgaaggggagcgaggacgttctacctgccttgaagaagacacctgacctgcggagtgagtgaccagtgtttccagagcctggcaatggatgccattcacatcggcatgtccagcacccccctggtgaagcacactgctggggctgggctcaaggccaacagaccccgcgtcatgtccaagagtgggcacagcaacgtgagaattgacaaagtggatggcatatacctactctacctgcaagacctgtggaccacagttatcgacatgaagtggagatacaaactcaccctgttcgctgccacttttgtgatgacctggttcctttttggagtcatctactatgccatcgcgtttattcatggggacttagaacccggtgagcccatttcaaatcataccccctgcatcatgaaagtggactctctcactggggcgtttctcttttccctggaatcccagacaaccattggctatggagtccgttccatcacagaggaatgtcctcatgccatcttcctgttggttgctcagttggtcatcacgaccttgattgagatcttcatcaccggaaccttcctggccaaaatcgccagacccaaaaagcgggctgagaccatcaagttcagccactgtgcagtcatcaccaagcagaatgggaagctgtgcttggtgattcaggtagccaatatgaggaagagcctcttgattcagtgccagctctctggcaagctcctgcagacccacgtcaccaaggagggggagcggattctcctcaaccaagccactgccaaattccacgtggactcctcctctgagagccccttcctcattctgcccatgacattctaccatgtgctggatgagacgagccccctgagagacctcacaccccaaaacctaaaggagaaggagtttgagcttgtggtcctcctcaatgccactgtggaatccaccagcgctgtctgccagagccgaacatcttatatcccagaggaaatctactggggttttgagtttgtgcctgtggtatctctctccaaaaatggaaaatatgtggctgatttcagtcagtttgaacagattcggaaaagcccagattgcacattttactgtgcagattctgagaaacagcaactcgaggagaagtacaggcaggaggatcagagggaaagagaactgaggacacttttattacaacagagcaatgtctgatcacaggggcgccatccaggtttaaccctgcaagctgtttccacatcagaactcccttcaaacacaaagattgctgtgaaaacgaaaatgtgtagacgcactctcaaaaactgcacggacatacaaaatcaatcttttcctttgatcttgtggctaaaccagcatttctgtgtttgagagatttcctgttaggtgcttcgtctgaaagtgaactctcataattcaaattgtataaaataaagctacatttctaagagcttggtgtagggcaattggaataatgtcctgttggataaacagacatttagcaatgctgacattaaaaggaaatgtatttctatacaagattattagctgtaatacaagatatttatttaaccaatgaccttatggctgagagttgaattgtggttcagtattcattgatctcactgctttaaaacatgctccttttgttcaagcag

SEQ ID NO: 746 - DNA, 1882 bp, Homo sapiens
  ref <308>: DATABASE ACCESSION NUMBER: NM_002245
  ref <309>: DATABASE ENTRY DATE: 2001-06-18
gggcaggaagacggcgctgcccggaggagcggggcgggcgggcgcgcgggggagcgggcggcgggcgggagccaggcccgggcgggggcgggggcggcggggccagaagaggcggcgggccgcgctccggccggtctgcggcgttggccttggctttggctttggcggcggcggtggagaagatgctgcagtccctggccggcagctcgtgcgtgcgcctggtggagcggcaccgctcggcctggtgcttcggcttcctggtgctgggctacttgctctacctggtcttcggcgcagtggtcttctcctcggtggagctgccctatgaggacctgctgcgccaggagctgcgcaagctgaagcgacgcttcttggaggagcacgagtgcctgtctgagcagcagctggagcagttcctgggccgggtgctggaggccagcaactacggcgtgtcggtgctcagcaacgcctcgggcaactggaactgggacttcacctccgcgctcttcttcgccagcaccgtgctctccaccacaggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgagccttttgtggccacccagtcatctgcctgcgtggatggccctgcaaaccattgagcgtaggatttgttgcattatgctagagcaccagggtcagggtgcaaggaagaggcttaagtatgttcatttttatcagaatgcaaaagcgaaaattatgtcactttaagaaatagctactgtttgcaatgtcttattaaaaaacaacaaaaaaagacacatggaacaaagaagctgtgaccccagcaggatgtctaatatgtgaggaaatgagatgtccacctaaaattcatatgtgacaaaattatctcgaccttacataggaggagaatacttgaagcagtatgctgctgtggttagaagcagattttatacttttaactggaaactttggggtttgcatttagatcatttagctgatggctaaatagcaaaatttatatttagaagcaaaaaaaaaaagcatagagatgtgttttataaataggtttatgtgtactggtttgcatgtacccacccaaaatgattatttttggagaatctaagtcaaactcactatttataatgcataggtaaccattaactatgtacatataaagtataaatatgtttatattctgtacatatggtttaggtcaccagatcctagtgtagttctgaaactaagactatagatattttgtttcttttgatttctctttatactaaagaatccagagttgctacaataaaataaggggaataataaa

SEQ ID NO: 747 - DNA, 2238 bp, Homo sapiens
  ref <308>: DATABASE ACCESSION NUMBER: NM_002250
  ref <309>: DATABASE ENTRY DATE: 2001-06-18
gtccttcggtgtctgggtgtggtgagtagaggtgtgtgtcacaaagtacagaccattgtgtgtgacaaagcccatcgtgtgtctgtgtgtgtctttatccacgtggatggacgtctctttcttgctctgccccaagacacaccctagcccctccttattctcaaaagggggagctggggagcctccccctaccctggggcctcccctgcccctccccgccctgcctggccgtcaccactccccagagggcacagggctctgctgtgcctcagagcaaaagtcccagagccagcagagcaggctgacgacctgcaagccacagtggctgccctgtgcgtgctgcgaggtgggggaccctgggcaggaagctggctgagccccaagaccccgggggccatgggcggggatctggtgcttggcctgggggccttgagacgccgaaagcgcttgctggagcaggagaagtctctggccggctgggcactggtgctggcaggaactggcattggactcatggtgctgcatgcagagatgctgtggttcggggggtgctcgtgggcgctctacctgttcctggttaaatgcacgatcagcatttccaccttcttactcctctgcctcatcgtggcctttcatgccaaagaggtccagctgttcatgaccgacaacgggctgcgggactggcgcgtggcgctgaccgggcggcaggcggcgcagatcgtgctggagctggtggtgtgtgggctgcacccggcgcccgtgcggggcccgccgtgcgtgcaggatttaggggcgccgctgacctccccgcagccctggccgggattcctgggccaaggggaagcgctgctgtccctggccatgctgctgcgtctctacctggtgccccgcgccgtgctcctgcgcagcggcgtcctgctcaacgcttcctaccgcagcatcggcgctctcaatcaagtccgcttccgccactggttcgtggccaagctttacatgaacacgcaccctggccgcctgctgctcggcctcacgcttggcctctggctgaccaccgcctgggtgctgtccgtggccgagaggcaggctgttaatgccactgggcacctttcagacacactttggctgatccccatcacattcctgaccatcggctatggtgacgtggtgccgggcaccatgtggggcaagatcgtctgcctgtgcactggagtcatgggtgtctgctgcacagccctgctggtggccgtggtggcccggaagctggagtttaacaaggcagagaagcacgtgcacaacttcatgatggatatccagtataccaaagagatgaaggagtccgctgcccgagtgctacaagaagcctggatgttctacaaacatactcgcaggaaggagtctcatgctgcccgcaggcatcagcgcaagctgctggccgccatcaacgcgttccgccaggtgcggctgaaacaccggaagctccgggaacaagtgaactccatggtggacatctccaagatgcacatgatcctgtatgacctgcagcagaatctgagcagctcacaccgggccctggagaaacagattgacacgctggcggggaagctggatgccctgactgagctgcttagcactgccctggggccgaggcagcttccagaacccagccagcagtccaagtagctggacccacgaggaggaaccaggctactttccccagtactgaggtggtggacatcgtctctgccactcctgacccagccctgaacaaagcacctcaagtgcaaggaccaaagggggccctggcttggagtgggttggcttgctgatggctgctggaggggacgctggctaaagtgggtaggccttggcccacctgaggccccaggtgggaacatggtcacccccactctgcataccctcatcaaaaacactctcactatgctgctatggacgacctccagctctcagttacaagtgcaggcgactggaggcaggactcctgggtccctgggaaagagggtactaggggcccggatccaggattctgggaggcttcagttaccgctggccgagctgaagaactgggtatgaggctggggcggggctggaggtggcgccccctggtgggacaacaaagaggacaccatttttccagagctgcagagagcacctggtggggaggaagaagtgtaactcaccagcctctgctcttatctttgtaataaatgttaaagccag

SEQ ID NO: 748 - DNA, 3732 bp, Homo sapiens
  Modified_base 1 ... 3732: n = a,c,g, or t
  ref <308>: DATABASE ACCESSION NUMBER: NM_002254
  ref <309>: DATABASE ENTRY DATE: 2001-06-18
cctcccaggcgtccccaccctaggaggctgcatgcggattgaagacgtgngcctgggggctgggccggccccgctgatcccgacctagcgagcaggatagcaggaccgcccaggctgcggaggggctcgggggcaggaaggtcagagcagcaagatggccagtaagaccaaggccagcgaggccctcaaggtggtggcccggtgccgccccctcagcaggaaggaggaggctgctggtcacgagcagatcctgaccatggacgtgaaactgggccaggtgaccctgcggaacccccgcgccgccccgggggagctgcccaagaccttcacctttgacgccgtgtatgatgccagctccaagcaggccgacctgtatgacgaacgtgagcccctgatagactccgtgctccagggtttcaatggcacggtgtttgcctatggccagacgggcactggcaagacctataccatgcagggggacctggtggagcccgagctgcgcggggtcatcccgaatgcctttgagcacatcttcacccacatctcccgctcccagaaccaacagtacctggtccgggcctcctatttggagatctaccaggaagagattcgagacctgctctccaaggagccgggcaggaggctagagctgaaagagaaccccgagactggcgtctacatcaaggacctctcctccttcgtcaccaagaatgtcaaggagattgagcatgtgatgaacctggggaaccagacccgggctgtgggcagcacccacatgaatgaggtcagctcccgctcccatgccatcttcatcatcactgtggagtgcagcgaacgtggctctgatggccaggaccacatccgagtgggcaagctcaacctcgtggacctggctggcagcgagaggcagaacaaggcaggccccaacacagcgggaggggcagccacaccatcctcgggtggcggtggtggcggtggaggcagtggtggtggtgctggtggagagaggcctaaggaagcctccaaaatcaacctctcattatctgccctgggcaacgtgattgctgccctggcgggcaacaggagcacccacattccctaccgggactccaagctgacccggctgctccaggactccctgggggggaatgccaagaccatcatggtagccacactggggccagcttctcacagctacgatgagagcctctccaccttgcgctttgccaaccgagccaagaacatcaagaacaagccccgggtgaacgaggaccccaaggacacactgctgcgggaattccaagaggagattgcccgcctgaaggcccagctggagaagagggggatgctggggaagcggccccggaggaagagcagccgcaggaagaaggccgtgtccgccccgcctgggtaccctgagggcccagtgattgaggcctgggtggcagaagaggaggatgacaacaacaacaaccaccgcccgccccagcccatcctggagtcagccttggagaagaacatggagaattacctgcaggaacagaaggagcggctggaggaggataaggcagccatccaggatgaccgcagcctggtgagcgaggagaagcagaagctgctggaggagaaggagaagatgctggaggacctgcggcgggaacagcaggccacagagctgcttgcggccaagtacaaggccatggagagcaagctcctcatcgggggcaggaacatcatggatcacaccaacgaacagcagaagatgttggaactgaagaggcaggagattgccgagcagaaacgtcgtgagcgggagatgcagcaggagatgatgctccgggacgaggagactatggagctccggggcacctacacatccctgcagcaggaggtggaggtcaaaaccaagaaactcaagaagctctacgccaagctgcaggcggtgaaggcggagatccaggaccagcatgatgagtatatccgcgtgcggcaggacctggaggaggcgcagaacgagcagacccgcgaactcaagctcgggtacctaatcatcgagaacttcatcccgccggaggagaagaacaagatcatgaaccggcttttcctggactgtgaggaggagcagtggaagttccagccactggtgccagccggcgtcagtagcagccagatgaagaagcggccaacatctgcagtgggctacaagaggcctatcagccagtatgctcgggttgccatggcaatggggtcccaccccaggtacagggctgaaaacataatgtttctggagttggatgtgtcccctccagctgtctttgagatggaattctctcacgaccaagaacaagaccctcgtgcgctacacatggagaggctcatgcgattggacagctttctggaaagaccttccacgtctaaagtccgaaagtccagatcctggtgccagagtcctcagcggcctccaccttccaccacacatgcctccctggcctctgcttctctgcgccctgcaacagtggcggaccatgagtgacaaccatcacgtcaggctgcccatccaatagactcctgggatggggcagccaaccctggctcatctcatctgccgcttggtgcgtgtgcgtgtgcgtgcatgtgcgtgtgcgtgtgtgcaggggtgagaatctggcagatggtgcctctgcctgctcttcttcgcctcctttatttaattcatgttatttattcgcggagctcagttcgtgttggggagatgccctcgcctgagccgtctgggcctaccgtggtcactgcgtagctctttttcttctgacttgagagctcccccagtcagatctcaggcttgtccccctgtcagctgcctccagaagggaaggtagccagtgcctgagaagacagtcccttttctacccaccgcactccataacctccatcttctcccacactgatggcgagcagcccctgagcactttctgggactgggagactgcttggtgttccctgaggacaagagacatcctgacagtgttgggcatctgctaccccgtggacacagccccactctccactttctgagcctcagacaacctcattcagcctcttgggctccttttcaaggacattaataacctcaccaacatagctcatgcccttcagctttgacaagaactcacggcttcccaaactctgctttctgcccaccttggatgggaactgtggaccaagcaattaccatcgccttggaacctgcaggaaatggaacagcaattgagacaacttgaacagtcatcaacggaagtccctccactggattcctttgtttctgtcccctccgaggagtcattttggtcgacaggctctcaaggcaactccccattttcaagaggctgctcctgcctgcttcgatcatttctccctgcagctgcctagaccccgttcacagtgggaggagtcaatgtcattctacccctcgctaaacgaagatattaacatctattgctttttcccttcatctgtcacaggaaacagaagcccaggcacaatcttttccagctttgcctgttacccctgtttctgattgcatctttaaggtattattttgttgacaatagatcctttattcactagttacgcaaattggttcctagggggatactccttaccttcctttgtgatggcccaaaatgtctctaggtatctcaagtgataagtaaatttctacaaaaaaaaaaa

SEQ ID NO: 749 - DNA, 1976 bp, Homo sapiens
  ref <308>: DATABASE ACCESSION NUMBER: NM_002266
  ref <309>: DATABASE ENTRY DATE: 2001-06-18
gccacacggtctttgagctgagtcgaggtggaccctttgaacgcagtcgccctacagccgctgattccccccgcatcgcctcccgtggaagcccaggcccgcttcgcagctttctccctttgtctcataaccatgtccaccaacgagaatgctaatacaccagctgcccgtcttcacagattcaagaacaagggaaaagacagtacagaaatgaggcgtcgcagaatagaggtcaatgtggagctgaggaaagctaagaaggatgaccagatgctgaagaggagaaatgtaagctcatttcctgatgatgctacttctccgctgcaggaaaaccgcaacaaccagggcactgtaaattggtctgttgatgacattgtcaaaggcataaatagcagcaatgtggaaaatcagctccaagctactcaagctgccaggaaactactttccagagaaaaacagccccccatagacaacataatccgggctggtttgattccgaaatttgtgtccttcttgggcagaactgattgtagtcccattcagtttgaatctgcttgggcactcactaacattgcttctgggacatcagaacaaaccaaggctgtggtagatggaggtgccatcccagcattcatttctctgttggcatctccccatgctcacatcagtgaacaagctgtctgggctctaggaaacattgcaggtgatggctcagtgttccgagacttggttattaagtacggtgcagttgacccactgttggctctccttgcagttcctgatatgtcatctttagcatgtggctacttacgtaatcttacctggacactttctaatctttgccgcaacaagaatcctgcacccccgatagatgctgttgagcagattcttcctaccttagttcggctcctgcatcatgatgatccagaagtgttagcagatacctgctgggctatttcctaccttactgatggtccaaatgaacgaattggcatggtggtgaaaacaggagttgtgccccaacttgtgaagcttctaggagcttctgaattgccaattgtgactcctgccctaagagccatagggaatattgtcactggtacagatgaacagactcaggttgtgattgatgcaggagcactcgccgtctttcccagcctgctcaccaaccccaaaactaacattcagaaggaagctacgtggacaatgtcaaacatcacagccggccgccaggaccagatacagcaagttgtgaatcatggattagtcccattccttgtcagtgttctctctaaggcagattttaagacacaaaaggaagctgtgtgggccgtgaccaactataccagtggtggaacagttgaacagattgtgtaccttgttcactgtggcataatagaaccgttgatgaacctcttaactgcaaaagataccaagattattctggttatcctggatgccatttcaaatatctttcaggctgctgagaaactaggtgaaactgagaaacttagtataatgattgaagaatgtggaggcttagacaaaattgaagctctacaaaaccatgaaaatgagtctgtgtataaggcttcgttaagcttaattgagaagtatttctctgtagaggaagaggaagatcaaaacgttgtaccagaaactacctctgaaggctacactttccaagttcaggatggggctcctgggacctttaacttttagatcatgtagctgagacataaatttgttgtgtactacgtttggtattttgtcttattgtttctctactaagaactctttcttaaatgtggtttgttactgtagcactttttacactgaaactatacttgaacagttccaactgtacatacatactgtatgaagcttgtcctctgactaggtttctaatttctatgtggaatttcctatcttgcagcatcctgtaaataaacattcaagtccacccttaaaaaaaa

SEQ ID NO: 750 - DNA, 1752 bp, Homo sapiens
  ref <308>: DATABASE ACCESSION NUMBER: NM_002273
  ref <309>: DATABASE ENTRY DATE: 2001-06-18
ctgctccttctaggatctccgcctggttcggcccgcctgcctccactcctgcctccaccatgtccatcagggtgacccagaagtcctacaaggtgtccacctctggcccccgggccttcagcagccgctcctacacgagtgggcccggttcccgcatcagctcctcgagcttctcccgagtgggcagcagcaactttcgcggtggcctgggcggcggctatggtggggccagcggcatgggaggcatcaccgcagttacggtcaaccagagcctgctgagcccccttgtcctggaggtggaccccaacatccaggccgtgcgcacccaggagaaggagcagatcaagaccctcaacaacaagtttgcctccttcatagacaaggtacggttcctggagcagcagaacaagatgctggagaccaagtggagcctcctgcagcagcagaagacggctcgaagcaacatggacaacatgttcgagagctacatcaacaaccttaggcggcagctggagactctgggccaggagaagctgaagctggaggcggagcttggcaacatgcaggggctggtggaggacttcaagaacaagtatgaggatgagatcaataagcgtacagagatggagaacgaatttgtcctcatcaagaaggatgtggatgaagcttacatgaacaaggtagagctggagtctcgcctggaagggctgaccgacgagatcaacttcctcaggcagctatatgaagaggagatccgggagctgcagtcccagatctcggacacatctgtggtgctgtccatggacaacagccgctccctggacatggacagcatcattgctgaggtcaaggcacagtacgaggatattgccaaccgcagccgggctgaggctgagagcatgtaccagatcaagtatgaggagctgcagagcctggctgggaagcacggggatgacctgcggcgcacaaagactgagatctctgagatgaaccggaacatcagccggctccaggctgagattgagggcctcaaaggccagagggcttccctggaggccgccattgcagatgccgagcagcgtggagagctggccattaaggatgccaacgccaagttgtccgagctggaggccgccctgcagcgggccaagcaggacatggcgcggcagctgcgtgagtaccaggagctgatgaacgtcaagctggccctggacatcgagatcgccacctacaggaagctgctggagggcgaggagagccggctggagtctgggatgcagaacatgagtattcatacgaagaccaccagcggctatgcaggtggtctgagctcggcctatgggggcctcacaagccccggcctcagctacagcctgggctccagctttggctctggcgcgggctccagctccttcagccgcaccagctcctccagggccgtggttgtgaagaagatcgagacacgtgatgggaagctggtgtctgagtcctctgacgtcctgcccaagtgaacagctgcggcagcccctcccagcctacccctcctgcgctgccccagagcctgggaaggaggccgctatgcagggtagcactgggaacaggagacccacctgaggctcagccctagccctcagcccacctggggagtttactacctggggaccccccttgcccatgcctccagctacaaaacaattcaattgctttttttttttggtccaaaataaaacctcagctagctctgccaaaccc

SEQ ID NO: 751 - DNA, 1518 bp, Homo sapiens
  ref <308>: DATABASE ACCESSION NUMBER: NM_002281
  ref <309>: DATABASE ENTRY DATE: 2001-06-18
atgacctgcggatcaggatttggtgggcgcgccttcagctgcatctcggcctgcgggccgcgccccggccgctgctgcatcaccgccgccccctaccgtggcatctcctgctaccgcggcctcaccgggggcttcggcagccacagcgtgtgcggaggctttcgggccggctcctgcggacgcagcttcggctaccgctccgggggcgtgtgcgggcccagtcccccatgcatcaccaccgtgtcggtcaacgagagcctcctcacgcccctcaacctggagatcgaccccaacgcgcagtgcgtgaagcaggaggagaaggagcagatcaagtccctcaacagcaggttcgcggccttcatcgacaaggtgcgcttcctggagcagcagaacaaactgctggagacaaagctgcagttctaccagaaccgcgagtgttgccagagcaacctggagcccctgtttgagggctacatcgagactctgcggcgggaggccgagtgcgtggaggccgacagcgggaggctggcctcagagcttaaccacgtgcaggaggtgctggagggctacaagaagaagtatgaggaggaggtttctctgagagcaacagctgagaacgagtttgtggctctgaagaaggatgtggactgcgcctacctccgcaagtcagacctggaggccaacgtggaggccctgatccaggagatcgacttcctgaggcggctgtatgaggaggagatccgcattctccagtcgcacatctcagacacctccgtggttgtcaagctggacaacagccgggacctgaacatggactgcatcattgccgagattaaggcacagtatgacgacattgtcacccgcagccgggccgaggccgagtcctggtaccgcagcaagtgtgaggagatgaaggccacggtgatcaggcacggggagaccctgcgccgcaccaaggaggagatcaatgagctgaaccgcatgatccaaaggctgacggccgaggtggagaatgccaagtgccagaactccaagctggaggccgcggtggctcagtctgagcagcagggtgaggcagccctcagtgatgcccgctgcaagctggccgagctggagggcgccctgcagaaggccaagcaggacatggcctgcctgatcagggagtaccaggaggtgatgaactccaagctgggcctggacatcgagatcgccacctacaggcgcctgctggagggcgaggagcagaggctatgtgaaggcattggggctgtgaatgtctgtgtcagcagctcccggggcggggtcgtgtgcggggacctctgcgtgtcaggctcccggccagtgactggcagtgtctgcagcgctccgtgcaacgggaacgtggcggtgagcaccggcctgtgtgcgccctgcggccaattgaacaccacctgcggagggggttcctgcggcgtgggctcctgtggtatcagctccctgggtgtggggtcttgcggcagcagctgccggaaatgttag

SEQ ID NO: 752 - DNA, 5815 bp, Homo sapiens
  ref <308>: DATABASE ACCESSION NUMBER: NM_002292
  ref <309>: DATABASE ENTRY DATE: 2001-06-18
gaaggcagtttccggagggaaggggtagggttggggtgggggcgctctccgcccggtgttgcgctccttcccagaatccgctccggcctttccttcctgccgcgattcccaactttgctcaaagtcgctggactctaagctgtcggagggaccgctggacagacctgggaactgacagagggcctggagggaaacaggccaaagacccacaggcagagttgacacggaaccccaaagcaaggaggagggctcgggccgagaccgttcacctccccttatccctgttcccctcttcaggatggagctgacctcaagggaaagagggaggggacagcctctgccctgggaacttcgactgggcctactgctaagcgtgctggctgccacactggcacaggcccctgccccggatgtgcctggctgttccaggggaagctgctaccccgccacgggcgacctgctggtgggccgagctgacagactgactgcctcatccacttgtggcctgaatggcccccagccctactgcatcgtcagtcacctgcaggacgaaaagaagtgcttcctttgtgactcccggcgccccttctctgctagagacaacccacacagccatcgcatccagaatgtagtcaccagctttgcaccacagcggcgggcagcctggtggcagtcagagaatggtatccctgcggtcaccatccagctggacctggaggctgagtttcatttcacacacctcattatgaccttcaagacatttcgccctgctgccatgctggtggaacgctcagcagactttggccgaacctggcatgtgtaccgatatttctcctatgactgtggggctgacttcccaggagtcccactagcacccccacggcactgggatgatgtagtctgtgagtcccgctactcagagattgagccatccactgaaggcgaggtcatctatcgtgtgctggaccctgccatccctatcccagacccctacagctcacggattcagaacctgttgaagatcaccaacctacgggtgaacctgactcgtctacacacgttgggagacaacctactcgacccacggagggagatccgagagaagtactactatgccctctatgagctggttgtacgtggcaactgcttctgctacggacacgcctcagagtgtgcacccgccccaggggcaccagcccatgctgagggcatggtgcacggagcttgcatctgcaaacacaacacacgtggcctcaactgcgagcagtgtcaggatttctatcgtgacctgccctggcgtccggctgaggacggccatagtcatgcctgtaggaagtgtgagtgccatgggcacacccacagctgccacttcgacatggccgtatacctggcatctggcaatgtgagtggaggtgtgtgtgatggatgtcagcataacacagctgggcgccactgtgagctctgtcggcccttcttctaccgtgacccaaccaaggacctgcgggatccggctgtgtgccgctcctgtgattgtgaccccatgggttctcaagacggtggtcgctgtgattcccatgatgaccctgcactgggactggtctccggccagtgtcgctgcaaagaacatgtggtgggcactcgctgccagcaatgccgtgatggcttctttgggctcagcatcagtgaccgtctgggctgccggcgatgtcaatgtaatgcacggggcacagtgcctgggagcactccttgtgaccccaacagtggatcctgttactgcaaacgtctagtgactggacgtggatgtgaccgctgcctgcctggccactggggcctgagccacgacctgctcggctgccgcccctgtgactgcgacgtgggtggtgctttggatccccagtgtgatgagggcacaggtcaatgccactgccgccagcacatggttgggcgacgctgtgagcaggtgcaacctggctacttccggcccttcctggaccacctaatttgggaggctgaggacacccgagggcaggtgctcgatgtggtggagcgcctggtgacccccggggaaactccatcctggactggctcaggcttcgtgcggctacaggaaggtcagaccctggagttcctggtggcctctgtgccgaaggctatggactatgacctgctgctgcgcttagagccccaggtccctgagcaatgggcagagttggaactgattgtgcagcgtccagggcctgtgcctgcccacagcctgtgtgggcatttggtgcccaaggatgatcgcatccaagggactctgcaaccacatgccaggtacttgatatttcctaatcctgtctgccttgagcctggtatctcctacaagctgcatctgaagctggtacggacagggggaagtgcccagcctgagactccctactctggacctggcctgctcattgactcgctggtgctgctgccccgtgtcctggtgctagagatgtttagtgggggtgatgctgctgccctggagcgccaggccacctttgaacgctaccaatgccatgaggagggtctggtgcccagcaagacttctccctctgaggcctgcgcacccctcctcatcagcctgtccaccctcatctacaatggtgccctgccatgtcagtgcaaccctcaaggttcactgagttctgagtgcaaccctcatggtggtcagtgcctgtgcaagcctggagtggttgggcgccgctgtgacctctgtgcccctggctactatggctttggccccacaggctgtcaagcctgccagtgcagccacgagggggcactcagcagtctctgtgaaaagaccagtgggcaatgtctctgtcgaactggtgcctttgggcttcgctgtgaccgctgccagcgtggccagtggggattccctagctgccggccatgtgtctgcaatgggcatgcagatgagtgcaacacccacacaggcgcttgcctgggctgccgtgatcacacagggggtgagcactgtgaaaggtgcattgctggtttccacggggacccacggctgccatatgggggccagtgccggccctgtccctgtcctgaaggccctgggagccaacggcactttgctacttcttgccaccaggatgaatattcccagcagattgtgtgccactgccgggcaggctatacggggctgcgatgtgaagcttgtgcccctgggcactttggggacccatcaaggccaggtggccggtgccaactgtgtgagtgcagtgggaacattgacccaatggatcctgatgcctgtgacccccacacgggccaatgcctgcgctgtttacaccacacagagggtccacactgtgcccactgcaagcctggcttccatgggcaggctgcccgacagagctgtcaccgctgcacatgcaacctgctgggcacaaatccgcagcagtgcccatctcctgaccagtgccactgtgatccaagcagtgggcagtgcccatgcctccccaatgtccagggccctagctgtgaccgctgtgcccccaacttctggaacctcaccagtggccatggttgccagccttgtgcctgccacccaagccgggccagaggccccacctgcaacgagttcacagggcagtgccactgccgtgccggctttggagggcggacttgttctgagtgccaagagctccactggggagaccctgggttgcagtgccatgcctgtgattgtgactctcgtggaatagatacacctcagtgtcaccgcttcacaggtcactgcagctgccgcccaggggtgtctggtgtgcgctgtgaccagtgtgcccgtgcgttctcaggaatctttcctgcctgccatccctgccatgcatgcttcggggattgggaccgagtggtgcaggacttggcagcccgtacacagcgcctagagcagcgggcgcaggagttgcaacagacgggtgtgctgggtgcctttgagagcagcttctggcacatgcaggagaagctgggcattgtgcagggcatcgtaggtgcccgcaacacctcagccgcctccactgcacagcttgtggaggccacagaggagctgcggcgtgaaattggggaggccactgagcacctgactcagctcgaggcagacctgacagatgtgcaagatgagaacttcaatgccaaccatgcactaagtggtctggagcgagataggcttgcacttaatctcacactgcggcagctcgaccagcatcttgacttgctcaaacattcaaacttcctgggtgcctatgacagcatccggcatgcccatagccagtctgcagaggcagaacgtcgtgccaatacctcagccctggcagtacctagccctgtgagcaactcggcaagtgctcggcatcggacagaggcactgatggatgctcagaaggaggacttcaacagcaaacacatggccaaccagcgggcacttggcaagctctctgcccatacccacaccctgagcctgacagacataaatgagctggtgtgtggggcaccaggggatgcaccctgtgctacaagcccttgtgggggtgccggctgtcgagatgaggatgggcagccgcgctgtgggggcctcagctgcaatggggcagcggctacagcagacctagcactgggccgggcccggcacacacaggcagagctgcagcgggcactggcagaaggtggtagcatcctcagcagagtggctgagactcgtcggcaggcaagcgaggcacagcagcgggcccaggcagccctggacaaggctaatgcttccaggggacaggtggaacaggccaaccaggaacttcaagaacttatccagagtgtgaaggacttcctcaaccaggagggggctgatcctgatagcattgaaatggtggccacacgggtgctagagctctccatcccagcttcagctgagcagatccagcacctggcgggcgcgattgcagagcgagtccggagcctggcagatgtggatgcgatcctggcacgtactgtaggagatgtgcgtcgtgccgagcagctactgcaggatgcacggcgggcaaggagctgggctgaggatgagaaacagaaggcagagacagtacaggcagcactggaggaggcccagcgggcacagggtattgcccagggtgccatccggggggcagtggctgacacacgggacacagagcagaccctgtaccaggtacaggagaggatggcaggtgcagagcgggcactgagctctgcaggtgaaagggctcggcagttggatgctctcctggaggctctgaaattgaaacgggcaggaaatagtctggcagcctctacagcagaagaaacggcaggcagtgcccagggtcgtgcccaggaggctgagcagctgctacgcggtcctctgggtgatcagtaccagacggtgaaggccctagctgagcgcaaggcccaaggtgtgctggctgcacaggcaagggcagaacaactgcgggatgaggctcgggacctgttgcaagccgctcaggacaagctgcagcggctacaggaattggaaggcacctatgaggaaaatgagcgggcactggagagtaaggcagcccagttggacgggttggaggccaggatgcgcagcgtgcttcaagccatcaacttgcaggtgcagatctacaacacctgccagtgacccctgcccaaggcctaccccagttcctagcactgccccacatgcatgtctgcctatgcactgaagagctcttggcccggcagggcccccaataaaccagtgtgaacccccaaaaaaaaa

SEQ ID NO: 753 - DNA, 3723 bp, Homo sapiens
  ref <308>: DATABASE ACCESSION NUMBER: NM_002298
  ref <309>: DATABASE ENTRY DATE: 2001-06-18
tttttctttcctggctgatgatttgtcattctagtcacttcctgccttgtgaccacacacccaggcttgacaaagctgttctgcagatcagaaagaaggggttcctggtcatacaccagtactaccaaggacagcttttttcctgcaagatctgttacctaaagcaataaaaaatggccagaggatcagtgtccgatgaggaaatgatggagctcagagaagcttttgccaaagttgatactgatggcaatggatacatcagcttcaatgagttgaatgacttgttcaaggctgcttgcttgcctttgcctgggtatagagtacgagaaattacagaaaacctgatggctacaggtgatctggaccaagatggaaggatcagctttgatgagtttatcaagattttccatggcctaaaaagcacagatgttgccaagacctttagaaaagcaatcaataagaaggaagggatttgtgcaatcggtggtacttcagagcagtctagcgttggcacccaacactcctattcagaggaagaaaagtatgcctttgtcaactggataaacaaagccctggaaaatgatcctgattgtcggcatgtcatcccaatgaacccaaacacgaatgatctctttaatgctgttggagatggcattgtcctttgtaaaatgatcaacctgtcagtgccagacacaattgatgaaagaacaatcaacaaaaagaagctaacccctttcaccattcaggaaaatctgaacttggctctgaactctgcctcagccatcgggtgccatgtggtcaacataggggctgaggacctgaaggaggggaagccttatctggtcctgggacttctgtggcaagtcatcaagattgggttgtttgctgacattgaactcagcagaaatgaagctctgattgctcttttgagagaaggtgagagcctggaggatttgatgaaactctcccctgaagagctcttgctgaggtgggctaattaccacctggaaaatgcaggctgcaacaaaattggcaacttcagtactgacatcaaggactcaaaagcttattaccacctgcttgagcaggtggctccaaaaggagatgaagaaggtgttcctgctgttgttattgacatgtcaggactgcgggagaaggatgacatccagagggcagaatgcatgctgcagcaggcggagaggctgggctgccggcagtttgtcacagccacagatgttgtccgagggaaccccaagttgaacttggcttttattgccaacctctttaacagataccctgccctgcacaaaccagagaaccaggacattgactggggggctcttgaaggtgagacgagagaagagcggacatttaggaactggatgaactccctgggtgttaaccctcgagtcaatcatttgtacagtgacttatcagatgccctggtcatcttccagctctatgaaaagatcaaagttcctgttgactggaacagagtaaacaaaccgccataccccaaactgggaggcaatatgaagaagcttgagaattgtaactacgcggtagaattggggaagaatcaagcgaagttctccctggttggcatcggtggacaagatctcaatgaaggaaaccgcactctcacactggccttgatttggcagctaatgagaaggtatacactgaatatcctcgaagaaattggtggtggccagaaggtcaatgatgacattattgtcaactgggtgaatgaaacattgagggaagcagagaaaagttcatccatctctagtttcaaggacccgaagattagtacaagtctgcctgttctggacctcatcgatgccatccaaccaggttccattaactatgaccttctgaagacagaaaatctgaatgatgatgagaaactcaacaatgcaaaatatgccatctctatggcccgaaaaattggagcaagagtgtatgccctgccagaagacctggttgaagtgaaccccaaaatggtcatgaccgtgtttgcctgcctcatggggaaaggaatgaagagggtgtgaggccaatggggctgggtgggaggcggtgcactcactcctgactgcccggcacagatgctccagggatgattcaagccattccaaagttcaacttggtgacactctataagattccaaaaagcacatattagtgcagccaagtagcctctcctgtatttaacaaaaagtgcttcattctttgcaggaggcccaacctcctatatataggtttctattcttgatttatttgcttcttcgaaaatctagaggaaaagaaagaagttattttccaggtacccttctcgcttttgccattagccaaggatagaagctgcagtggtattaattttgatataatctttcaaaccagcttgttgtggcttcccttttctttgttcaagatgagggccaggaggggaaacatcacacctgccctaaaccctgttcctggaggtcagcatttgatctgttgcaagcccctctttctgtcccctcttcctaccctgcctcccatgactttgctcctcacacttttggaaccatgccttccgggggggcccatctcttctggcggtccttgtctctgggccacttggagtgtgtgataaatcagtcaagctgttgaagtctcaggagtctctggtagcctgcagaagtaagcctcatcatcagagcctttcctcaaaactggagtcccaaatgtcatcaggttttgttttttttcagccactaagaacccctctgcttttaactctagaatttgggcttggaccagatctaacatcttgaatactctgccctctagagccttcagccttaatggaaggttggatccaaggaggtgtaatggaatcggaatcaagccactcggcaggcatggagctataactaagcatccttagggttctgcctctccaggcattagccctcacattagatctagttactgtggtatggctaatacctgtcaacatttggaggcaatcctaccttgcttttgcttctagagcttagcatatctgattgttgtcaggccatattatcaatgtttacttttttggtactataaaagctttctgccacccctaaactccaggggggacaatatgtgccaatcaatagcacccctactcacatacacacacacctagccagctgtcaagggcagaatgaatctatgctggataagaaatggtggaactgcgttatgaagagctaatttactggacaaagaattccaaagcaaaaccagaacagtatgaatttgagcaggtctcataggttgagcaatttccccctaaaccaactgaaggctaaaaagcaacaggccattgtgaaccaatgcaagacgccctctatcatggtgaaaagctccatcaatgaggtatcttctttagtggtggtatgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctcccaggaagaaagaatgttactgccttaataaaaaatgaaaagagaatgatgctcaaaatctttccaaataaaatgttccctat

SEQ ID NO: 754 - DNA, 1272 bp, Homo sapiens
  ref <308>: DATABASE ACCESSION NUMBER: NM_002300
  ref <309>: DATABASE ENTRY DATE: 2001-06-18
gccggaggagacgcacgcagctgactttgtcttctccgcacgactgttacagaggtctccagagccttctctctcctgtgcaaaatggcaactcttaaggaaaaactcattgcaccagttgcggaagaagaggcaacagttccaaacaataagatcactgtagtgggtgttggacaagttggtatggcgtgtgctatcagcattctgggaaagtctctggctgatgaacttgctcttgtggatgttttggaagataagcttaaaggagaaatgatggatctgcagcatgggagcttatttcttcagacacctaaaattgtggcagataaagattattctgtgaccgccaattctaagattgtagtggtaactgcaggagtccgtcagcaagaaggggagagtcggctcaatctggtgcagagaaatgttaatgtcttcaaattcattattcctcagatcgtcaagtacagtcctgattgcatcataattgtggtttccaacccagtggacattcttacgtatgttacctggaaactaagtggattacccaaacaccgcgtgattggaagtggatgtaatctggattctgctagatttcgctaccttatggctgaaaaacttggcattcatcccagcagctgccatggatggattttgggggaacatggcgactcaagtgtggctgtgtggagtggtgtgaatgtggcaggtgtttctctccaggaattgaatccagaaatgggaactgacaatgatagtgaaaattggaaggaagtgcataagatggtggttgaaagtgcctatgaagtcatcaagctaaaaggatataccaactgggctattggattaagtgtggctgatcttattgaatccatgttgaaaaatctatccaggattcatcccgtgtcaacaatggtaaaggggatgtatggcattgagaatgaagtcttcctgagccttccatgtatcctcaatgcccggggattaaccagcgttatcaaccagaagctaaaggatgatgaggttgctcagctcaagaaaagtgcagataccctgtgggacatccagaaggacctaaaagacctgtgactagtgagctctaggctgtagaaatttaaaaactacaatgtgattaactcgagcctttagttttcatccatgtacatggatcacagtttgctttgatcttcttcaatatgtgaatttgggctcacagaatcaaagcctatgcttggtagctcttgaacaaataaaattaactattgtagtgtg

SEQ ID NO: 755 - DNA, 1620 bp, Homo sapiens
  ref <308>: DATABASE ACCESSION NUMBER: NM_002308
  ref <309>: DATABASE ENTRY DATE: 2001-06-18
caaaggacttcctagtgggtgtgaaaggcagcggtggccacagaggcggcggagagatggccttcagcggttcccaggctccctacctgagtccagctgtccccttttctgggactattcaaggaggtctccaggacggacttcagatcactgtcaatgggaccgttctcagctccagtggaaccaggtttgctgtgaactttcagactggcttcagtggaaatgacattgccttccacttcaaccctcggtttgaagatggagggtacgtggtgtgcaacacgaggcagaacggaagctgggggcccgaggagaggaggacacacatgcctttccagaaggggatgccctttgacctctgcttcctggtgcagagctcagatttcaaggtgatggtgaacgggatcctcttcgtgcagtacttccaccgcgtgcccttccaccgtgtggacaccatcttcgtcaatggctctgtgcagctgtcctacatcagcttccagcctcccggcgtgtggcctgccaacccggctcccattacccagacagtcatccacacagtgcagagcgcccctggacagatgttctctactcccgccatcccacctatgatgtacccccaccccgcctatccgatgcctttcatcaccaccattctgggagggctgtacccatccaagtccatcctcctgtcaggcactgtcctgcccagtgctcagaggttccacatcaacctgtgctctgggaaccacatcgccttccacctgaacctccgttttgatgagaatgctgtggtccgcaacacccagatcgacaactcctgggggtctgaggagcgaagtctgccccgaaaaatgcccttcgtccgtggccagagcttctcagtgtggatcttgtgtggagctcactgcctcaaggtggccgtggatggtcagcacctgtttgaatactaccatcgcctgaggaacctgcccaccatcaacagactggaagtggggggcgacatccagctgacccatgtgcagacataggcggcttcctggccctggggccgggggctggggtgtggggcagtctgggtcctctcatcatccccacttcccaggcccagcctttccaaccctgcctgggatctgggctttaatgcagaggccatgtccttgtctggtcctgcttctggctacagccaccctggaacggagaaggcagctgacggggattgccttcctcagccgcagcagcacctggggctccagctgctggaatcctaccatcccaggaggcaggcacagccagggagaggggaggagtgggcagtgaagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcaaaaaaaaaaaaaaaaaaaaa

SEQ ID NO: 756 - DNA, 3332 bp, Homo sapiens
  ref <308>: DATABASE ACCESSION NUMBER: NM_002314
  ref <309>: DATABASE ENTRY DATE: 2001-06-18
gcgccgagccggtttccccgccggtgtccgagaggcgcccccggcccggcccggcccggcccgcgccctccgcccccgcctccccgggccggcggcggtgggcgagctcgcgggcccggccgcccccagccccagccccgccgggccccgccccccgtcgagtgcatgaggttgacgctactttgttgcacctggagggaagaacgtatgggagaggaaggaagcgagttgcccgtgtgtgcaagctgcggccagaggatctatgatggccagtacctccaggccctgaacgcggactggcacgcagactgcttcaggtgttgtgactgcagtgcctccctgtcgcaccagtactatgagaaggatgggcagctcttctgcaagaaggactactgggcccgctatggcgagtcctgccatgggtgctctgagcaaatcaccaagggactggttatggtggctggggagctgaagtaccaccccgagtgtttcatctgcctcacgtgtgggacctttatcggtgacggggacacctacacgctggtggagcactccaagctgtactgcgggcactgctactaccagactgtggtgacccccgtcatcgagcagatcctgcctgactcccctggctcccacctgccccacaccgtcaccctggtgtccatcccagcctcatctcatggcaagcgtggactttcagtctccattgaccccccgcacggcccaccgggctgtggcaccgagcactcacacaccgtccgcgtccagggagtggatccgggctgcatgagcccagatgtgaagaattccatccacgtcggagaccggatcttggaaatcaatggcacgcccatccgaaatgtgcccctggacgagattgacctgctgattcaggaaaccagccgcctgctccagctgaccctcgagcatgaccctcacgatacactgggccacgggctggggcctgagaccagccccctgagctctccggcttatactcccagcggggaggcgggcagctctgcccggcagaaacctgtcttgaggagctgcagcatcgacaggtctccgggcgctggctcactgggctccccggcctcccagcgcaaggacctgggtcgctctgagtccctccgcgtagtctgccggccacaccgcatcttccggccgtcggacctcatccacggggaggtgctgggcaagggctgcttcggccaggctatcaaggtgacacaccgtgagacaggtgaggtgatggtgatgaaggagctgatccggttcgacgaggagacccagaggacgttcctcaaggaggtgaaggtcatgcgatgcctggaacaccccaacgtgctcaagttcatcggggtgctctacaaggacaagaggctcaacttcatcactgagtacatcaagggcggcacgctccggggcatcatcaagagcatggacagccagtacccatggagccagagagtgagctttgccaaggacatcgcatcagggatggcctacctccactccatgaacatcatccaccgagacctcaactcccacaactgcctggtccgcgagaacaagaatgtggtggtggctgacttcgggctggcgcgtctcatggtggacgagaagactcagcctgagggcctgcggagcctcaagaagccagaccgcaagaagcgctacaccgtggtgggcaacccctactggatggcacctgagatgatcaacggccgcagctatgatgagaaggtggatgtgttctcctttgggatcgtcctgtgcgagatcatcgggcgggtgaacgcagaccctgactacctgccccgcaccatggactttggcctcaacgtgcgaggattcctggaccgctactgccccccaaactgccccccgagcttcttccccatcaccgtgcgctgttgcgatctggaccccgagaagaggccatcctttgtgaagctggaacactggctggagaccctccgcatgcacctggccggccacctgccactgggcccacagctggagcagctggacagaggtttctgggagacctaccggcgcggcgagagcggactgcctgcccaccctgaggtccccgactgagccagggccactcagctgcccctgtccccacctctggagaatccacccccaccagattcctccgcgggaggtggccctcagctgggacagtggggacccaggcttctcctcagagccaggccctgacttgccttctcccaccccgtggaccgcttcccctgccttctctctgccgtggcccagagccggcccagctgcacacacacaccatgctctcgccctgctgtaacctctgtcttggcagggctgtcccctcttgcttctccttgcatgagctggagggcctgtgtgagttacgcccctttccacacgccgctgccccagcaaccctgttcacgctccacctgtctggtccatagctccctggaggctgggccaggaggcagcctccgaaccatgccccatataacgcttgggtgcgtgggagggcgcacatcagggcagaggccaagttccaggtgtctgtgttcccaggaaccaaatggggagtctggggcccgttttccccccagggggtgtctaggtagcaacaggtatcgaggactctccaaacccccaaagcagagagagggctgatcccatggggcggaggtccccagtggctgagcaaacagccccttctctcgctttgggtcttttttttgtttctttcttaaagccactttagtgagaagcaggtaccaagcctcagggtgaagggggtcccttgagggagcgtggagctgcggtgccctggccggcgatggggaggagccggctccggcagtgagaggataggcacagtggaccgggcaggtgtccaccagcagctcagcccctgcagtcatctcagagccccttcccgggcctctcccccaaggctccctgcccctcctcatgcccctctgtcctctgcgttttttctgtgtaatctattttttaagaagagtttgtattattttttcatacggctgcagcagcagctgccaggggcttgggattttatttttgtggcgggcgggggtgggagggccattttgtcactttgcctcagttgagcatctaggaagtattaaaactgtgaagctttctcagtgcactttgaacctggaaaacaatcccaacaggcccgtgggaccatgacttagggaggtgggacccacccacccccatccaggaaccgtgacgtccaaggaaccaaacccagacgcagaacaataaaataaattccgtactccccaccc

SEQ ID NO: 757 - DNA, 1493 bp, Homo sapiens
  ref <308>: DATABASE ACCESSION NUMBER: NM_002337
  ref <309>: DATABASE ENTRY DATE: 2001-06-18
tgagcgggggatgatggcgccgcggagggtcaggtcgtttctgcgcgggctcccggcgctgctactgctgctgctcttcctcgggccctggcccgctgcgagccacggcggcaagtactcgcgggagaagaaccagcccaagccgtccccgaaacgcgagtccggagaggagttccgcatggagaagttgaaccagctgtgggagaaggcccagcgactgcatcttcctcccgtgaggctggccgagctccacgctgatctgaagatacaggagagggacgaactcgcctggaagaaactaaagcttgacggcttggacgaagatggggagaaggaagcgagactcatacgcaacctcaatgtcatcttggccaagtatggtctggacggaaagaaggacgctcggcaggtgaccagcaactccctcagtggcacccaggaagacgggctggatgaccccaggctggaaaagctgtggcacaaggcgaagacctctgggaaattctccggcgaagaactggacaagctctggcgggagttcctgcatcacaaagagaaagttcacgagtacaacgtcctgctggagaccctgagcaggaccgaagaaatccacgagaacgtcattagcccctcggacctgagcgacatcaagggcagcgtcctgcacagcaggcacacggagctgaaggagaagctgcgcagcatcaaccagggcctggaccgcctgcgcagggtcagccaccagggctacagcactgaggctgagttcgaggagcccagggtgattgacctgtgggacctggcgcagtccgccaacctcacggacaaggagctggaggcgttccgggaggagctcaagcacttcgaagccaaaatcgagaagcacaaccactaccagaagcagctggagattgcgcacgagaagctgaggcacgcagagagcgtgggcgacggcgagcgtgtgagccgcagccgcgagaagcacgccctgctggaggggcggaccaaggagctgggctacacggtgaagaagcatctgcaggacctgtccggcaggatctccagagctcggcacaacgaactctgaaggcactggggagcccagcccggcagggaagaggccagcgtgaaggacctgggctcttggccgtggcatttccgtggacagcccgccgtcagggtggctggggctggcacgggtgtcgaggcaggaaggattgtttctggtgactgcagccgctgccgtcgcgacacagggcttggtggtggtagcatttgggtctgagatcggcccagctctgactgaaggggcttggcttccactcagcatcagcgtggcagtcaccaccccagtgaggacctcgatgtccagctgctgtcaggtctgatagtcctctgctaaaacaacacgatttacataaaaaatcttacacatctgccaccggaaataccatgcacagagtccttaaaaaatagagtgcagtatttaaacc

SEQ ID NO: 758 - DNA, 894 bp, Homo sapiens
  ref <308>: DATABASE ACCESSION NUMBER: NM_002341
  ref <309>: DATABASE ENTRY DATE: 2001-06-18
cagtctcaatgggggcactggggctggagggcaggggtgggaggctccaggggaggggttccctcctgctagctgtggcaggagccacttctctggtgaccttgttgctggcggtgcctatcactgtcctggctgtgctggccttagtgccccaggatcagggaggactggtaacggagacggccgaccccggggcacaggcccagcaaggactggggtttcagaagctgccagaggaggagccagaaacagatctcagccccgggctcccagctgcccacctcataggcgctccgctgaaggggcaggggctaggctgggagacgacgaaggaacaggcgtttctgacgagcgggacgcagttctcggacgccgaggggctggcgctcccgcaggacggcctctattacctctactgtctcgtcggctaccggggccgggcgccccctggcggcggggacccccagggccgctcggtcacgctgcgcagctctctgtaccgggcggggggcgcctacgggccgggcactcccgagctgctgctcgagggcgccgagacggtgactccagtgctggacccggccaggagacaagggtacgggcctctctggtacacgagcgtggggttcggcggcctggtgcagctccggaggggcgagagggtgtacgtcaacatcagtcaccccgatatggtggacttcgcgagagggaagaccttctttggggccgtgatggtggggtgagggaatatgagtgcgtggtgcgagtgcgtgaatattgggggcccggacgcccaggaccccatggcagtgggaaaaatgtaggagactgtttggaaattgattttgaacctgatgaaaataaagaatggaaagcttcagtgctgccgataaa

SEQ ID NO: 759 - DNA, 2136 bp, Homo sapiens
  ref <308>: DATABASE ACCESSION NUMBER: NM_002342
  ref <309>: DATABASE ENTRY DATE: 2001-06-18
gccctggaggcccggcctggccgctcccggccctggggtgcacatcggccctgagtcccgtcccaggctctgggctcgggcagccgccgccaccgctgcccaggacgtcgggcctcctgccttcctcccaggcccccacgttgctggccgcctggccgagtggccgccatgctcctgccttgggccacctctgcccccggcctggcctgggggcctctggtgctgggcctcttcgggctcctggcagcatcgcagccccaggcggtgcctccatatgcgtcggagaaccagacctgcagggaccaggaaaaggaatactatgagccccagcaccgcatctgctgctcccgctgcccgccaggcacctatgtctcagctaaatgtagccgcatccgggacacagtttgtgccacatgtgccgagaattcctacaacgagcactggaactacctgaccatctgccagctgtgccgcccctgtgacccagtgatgggcctcgaggagattgccccctgcacaagcaaacggaagacccagtgccgctgccagccgggaatgttctgtgctgcctgggccctcgagtgtacacactgcgagctactttctgactgcccgcctggcactgaagccgagctcaaagatgaagttgggaagggtaacaaccactgcgtcccctgcaaggcagggcacttccagaatacctcctcccccagcgcccgctgccagccccacaccaggtgtgagaaccaaggtctggtggaggcagctccaggcactgcccagtccgacacaacctgcaaaaatccattagagccactgcccccagagatgtcaggaaccatgctgatgctggccgttctgctgccactggccttctttctgctccttgccaccgtcttctcctgcatctggaagagccacccttctctctgcaggaaactgggatcgctgctcaagaggcgtccgcagggagagggacccaatcctgtagctggaagctgggagcctccgaaggcccatccatacttccctgacttggtacagccactgctacccatttctggagatgtttccccagtatccactgggctccccgcagccccagttttggaggcaggggtgccgcaacagcagagtcctctggacctgaccagggagccgcagttggaacccggggagcagagccaggtggcccacggtaccaatggcattcatgtcaccggcgggtctatgactatcactggcaacatctacatctacaatggaccagtactggggggaccaccgggtcctggagacctcccagctacccccgaacctccataccccattcccgaagagggggaccctggccctcccgggctctctacaccccaccaggaagatggcaaggcttggcacctagcggagacagagcactgtggtgccacaccctctaacaggggcccaaggaaccaatttatcacccatgactgacggagtctgagaaaaggcagaagaaggggggcacaagggcactttctcccttgaggctgccctgcccacgtgggattcacaggggcctgagtagggcccggggaagcagagccctaagggattaaggctcagacacctctgagagcaggtgggcactggctgggtacggtgccctccacaggactctccctactgcctgagcaaacctgaggcctcccggcagacccacccaccccctggggctgctcagcctcaggcacggacagggcacatgataccaactgctgcccactacggcacgccgcaccggagcacggcaccgagggagccgccacacggtcacctgcaaggacgtcacgggcccctctaaaggattcgtggtgctcatccccaagcttcagagaccctttggggttccacacttcacgtggactgaggtagaccctgcatgaagatgaaattatagggaggacgctccttccctcccctcctagaggagaggaaagggagtcattaacaactagggggttgggtaggattcctaggtatggggaagagttttggaaggggaggaaaatggcaagtgtatttatattgtaaccacatgcaaataaaaagaatgggacctaaactcgtgccgctcgtgccgaattcctgcag

SEQ ID NO: 760 - DNA, 1145 bp, Homo sapiens
  ref <308>: DATABASE ACCESSION NUMBER: NM_002346
  ref <309>: DATABASE ENTRY DATE: 2001-06-18
gctccggccagccgcggtccagagcgcgcgaggttcggggagctccgccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgcccaagtgggccagctgccctcacttctggggtggatgatgtgaccttccttgggggactgcggaagggacgagggttccctggagtcttacggtccaacatcagaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgcccaaatccagccagtcctgccccagcccacccccacattggagccctcctgctgctttggtgcctcaaataaatacagatgtcccc

SEQ ID NO: 761 - DNA, 6928 bp, Homo sapiens
  ref <308>: DATABASE ACCESSION NUMBER: NM_002349
  ref <309>: DATABASE ENTRY DATE: 2001-06-18
ggcgggagcgcgtgcgcccgaggacccggccggaaggcttgcgccagctcaggatgaggacaggctgggcgacccctcgccgcccggcggggctcctcatgctgctcttctggttcttcgatctcgcggagccctctggccgcgcagctaatgaccccttcaccatcgtccatggaaatacgggcaagtgcatcaagccagtgtatggctggatagtagcagacgactgtgatgaaactgaggacaagttatggaagtgggtgtcccagcatcggctctttcatttgcactcccaaaagtgccttggcctcgatattaccaaatcggtaaatgagctgagaatgttcagctgtgactccagtgccatgctgtggtggaaatgtgagcaccactctctgtacggagctgcccggtaccggctggctctgaaggatggacatggcacagcaatctcaaatgcatctgatgtctggaagaaaggaggctcagaggaaagcctttgtgaccagccttatcatgagatctataccagagatgggaactcttatgggagaccttgtgaatttccattcttaattgatgggacctggcatcatgattgcattcttgatgaagatcatagtgggccatggtgtgccaccaccttaaattatgaatatgaccgaaagtggggcatctgcttaaagcctgaaaacggttgtgaagataattgggaaaagaacgagcagtttggaagttgctaccaatttaatactcagacggctctttcttggaaagaagcttatgtttcatgtcagaatcaaggagctgatttactgagcatcaacagtgctgctgaattaacttaccttaaagaaaaagaaggcattgctaagattttctggattggtttaaatcagctatactctgctagaggctgggaatggtcagaccacaaaccattaaactttctcaactgggatccagacaggcccagtgcacctactataggtggctccagctgtgcaagaatggatgctgagtctggtctgtggcagagcttttcctgtgaagctcaactgccctatgtctgcaggaaaccattaaataatacagtggagttaacagatgtctggacatactcagatacccgctgtgatgcaggctggctgccaaataatggattttgctatctgctggtaaatgaaagtaattcctgggataaggcacatgcgaaatgcaaagccttcagtagtgacctaatcagcattcattctctagcagatgtggaggtggttgtcacaaaactccataatgaggatatcaaagaagaagtgtggataggccttaagaacataaacataccaactttatttcagtggtcagatggtactgaagttactctaacatattgggatgagaatgagccaaatgttccctacaataagacgcccaactgtgtttcctacttaggagagctaggtcagtggaaagtccaatcatgtgaggagaaactaaaatatgtatgcaagagaaagggagaaaaactgaatgacgcaagttctgataagatgtgtcctccagatgagggctggaagagacatggagaaacctgttacaagatttatgaggatgaggtcccttttggaacaaactgcaatctgactatcactagcagatttgagcaagaatacctaaatgatttgatgaaaaagtatgataaatctctaagaaaatacttctggactggcctgagagatgtagattcttgtggagagtataactgggcaactgttggtggaagaaggcgggctgtaaccttttccaactggaattttcttgagccagcttccccgggcggctgcgtggctatgtctactggaaagtctgttggaaagtgggaggtgaaggactgcagaagcttcaaagcactttcaatttgcaagaaaatgagtggaccccttgggcctgaagaagcatcccctaagcctgatgacccctgtcctgaaggctggcagagtttccccgcaagtctttcttgttataaggtattccatgcagaaagaattgtaagaaagaggaactgggaagaagctgaacgattctgccaagcccttggagcacacctttctagcttcagccatgtggatgaaataaaggaatttcttcactttttaacggaccagttcagtggccagcattggctgtggattggtttgaataaaaggagcccagatttacaaggatcctggcaatggagtgatcgtacaccagtgtctactattatcatgccaaatgagtttcagcaggattatgacatcagagactgtgctgctgtcaaggtatttcataggccatggcgaagaggctggcatttctatgatgatagagaatttatttatttgaggccttttgcttgtgatacaaaacttgaatgggtgtgccaaattccaaaaggccgtactccaaaaacaccagactggtacaatccagaccgtgctggaattcatggacctccacttataattgaaggaagtgaatattggtttgttgctgatcttcacctaaactatgaagaagccgtcctgtactgtgccagcaatcacagctttcttgcgactataacatcttttgtgggactaaaagccatcaaaaacaaaatagcaaatatatctggtgatggacagaagtggtggataagaattagcgagtggccaatagatgatcattttacatactcacgatatccatggcaccgctttcctgtgacatttggagaggaatgcttgtacatgtctgccaagacttggcttatcgacttaggtaaaccaacagactgtagtaccaagttgcccttcatctgtgaaaaatataatgtttcttcgttagagaaatacagcccagattctgcagctaaagtgcaatgttctgagcaatggattccttttcagaataagtgttttctaaagatcaaacccgtgtctctcacattttctcaagcaagcgatacctgtcactcctatggtggcacccttccttcagtgttgagccagattgaacaagactttattacatccttgcttccggatatggaagctactttatggattggtttgcgctggactgcctatgaaaagataaacaaatggacagataacagagagctgacgtacagtaactttcacccattattggttagtgggaggctgagaataccagaaaatttttttgaggaagagtctcgctaccactgtgccctaatactcaacctccaaaaatcaccgtttactgggacgtggaattttacatcctgcagtgaacgccactttgtgtctctctgtcagaaatattcagaagttaaaagcagacagacgttgcagaatgcttcagaaactgtaaagtatctaaataatctgtacaaaataatcccaaagactctgacttggcacagtgctaaaagggagtgtctgaaaagtaacatgcagctggtgagcatcacggacccttaccagcaggcattcctcagtgtgcaggcgctccttcacaactcttccttatggatcggactcttcagtcaagatgatgaactcaactttggttggtcagatgggaaacgtcttcattttagtcgctgggctgaaactaatgggcaactcgaagactgtgtagtattagacactgatggattctggaaaacagttgattgcaatgacaatcaaccaggtgctatttgctactattcaggaaatgagactgaaaaagaggtcaaaccagttgacagtgttaaatgtccatctcctgttctaaatactccgtggataccatttcagaactgttgctacaatttcataataacaaagaataggcatatggcaacaacacaggatgaagttcatactaaatgccagaaactgaatccaaaatcacatattctgagtattcgagatgaaaaggagaataactttgttcttgagcaactgctgtacttcaattatatggcttcatgggtcatgttaggaataacttatagaaataattctcttatgtggtttgataagaccccactgtcatatacacattggagagcaggaagaccaactataaaaaatgagaagtttttggctggtttaagtactgacggcttctgggatattcaaacctttaaagttattgaagaagcagtttattttcaccagcacagcattcttgcttgtaaaattgaaatggttgactacaaagaagaacataatactacactgccacagtttatgccatatgaagatggtatttacagtgttattcaaaaaaaggtaacatggtatgaagcattaaacatgtgttctcaaagtggaggtcacttggcaagcgttcacaaccaaaatggccagctctttctggaagatattgtaaaacgtgatggatttccactatgggttgggctctcaagtcatgatggaagtgaatcaagttttgaatggtctgatggtagtacatttgactatatcccatggaaaggccaaacatctcctggaaattgtgttctcttggatccaaaaggaacttggaaacatgaaaaatgcaactctgttaaggatggtgctatttgttataaacctacaaaatctaaaaagctgtcccgtcttacatattcatcaagatgtccagcagcaaaagagaatgggtcacggtggatccagtacaagggtcactgttacaagtctgatcaggcattgcacagtttttcagaggccaaaaaattgtgttcaaaacatgatcactctgcaactatcgtttccataaaagatgaagatgagaataaatttgtgagcagactgatgagggaaaataataacattaccatgagagtttggcttggattatctcaacattctgttgaccagtcttggagttggttagatggatcagaagtgacatttgtcaaatgggaaaataaaagtaagagtggtgttggaagatgtagcatgttgatagcttcaaatgaaacttggaaaaaagttgaatgtgaacatggttttggaagagttgtctgcaaagtgcctctgggccctgattacacagcaatagctatcatagttgccacactaagtatcttagttctcatgggcggactgatttggttcctcttccaaaggcaccgtttgcacctggcgggtttctcatcagttcgatatgcacaaggagtgaatgaagatgagattatgcttccttctttccatgactaaattcttctaaaagttttctaatttgcactaatgtggttatggagaaattagtcacttaaaatgtcccagtgtcagtatttactctgctccaaagtagaactcttaaatactttttcagttgtttagatcttaggcatgtgctggtatccacagttaattccctgctaaatgccatgtttatcaccctaattaatagaatggaggggactccaaagctggaactgaagtccaaattgtttgtacagtaatatgtttaatgttcattttctctgtatgaatgtgattggtaactaggatatgtatattttaatagaatttttaacaaaacttcttagaaaattaaaataggcatattactaggtgacatgtctactttttaatttttaagagcatccggccaaatgcaaaattagtacctcaaagtaaaaattgaactgtaaactctatcagcattgtttcaaaatagtcatttttagcactggggaaaaataaacaataagacatgcttactttttaatttttatttttttgagactgagtctctctctgttgcccaggctggagtacaatggcgtgatctcggctcactgcaaatctccgcctcccaggttcaagcgattctcctgcctcagcctcctgagtagctgggattacaggcaactgccaccatgcccggctaatttttgtatttttagtagagatggggtttcaccatgttggccaggctggtctcgaactcgtgaccgcagtgatcctcccgcctcggcctcccaaagtgctgggattacaggcatgagccaccgcgcctggcctctgcttactttttatatagcaaaatgattccccttggcaagatgtttcttatattattccaaagttatttcataccattattatgtaaatatgaagagtttttttctgtttataattgtttataaaacaatgacttttaaagatttagtgcttaacattttcccaagtgtgggaacattatttttagattgagtaggtaccttgtagcagtgtgctttgcattttctgatgtattacatgactgtttcttttgtaaagagaatcaactaggtatttaagactgataattttacaatttatatgcttcacatagcatgtcaacttttgactaagaattttgttttacttttttaacatgtgttaaacagagaaagggtccatgaaggaaagtgtatgagttgcatttgtaaaaatgagactttttcagtggaactctaaaccttgtgatgactactaacaaatgtaaaattatgagtgattaagaaaacattgctttgtggttatcactttaagttttgacacctagattatagtcttagtaatagcatccactggaaaaggtgaaaatgttttattcagcatttaacttacatttgtactttagagtatttttgtataaaatccatagatttattttacatttagagtatttacactatgataaagttgtaaataattttctaagacagtttttatatagtctacagttgtcctgatttcttattgaatttgttagactagttctcttgtcttgtgatctgtgtacaattttagtcactaagactttcctccaagaactaagccaacttgatgtgaaaagcacggctgtatataatggtgatgtcataataaagttgttttatcttttaagtaaaaaaaaaaaaaaaaaaaaa

SEQ ID NO: 762 - DNA, 2298 bp, Homo sapiens
  ref <308>: DATABASE ACCESSION NUMBER: NM_002350
  ref <309>: DATABASE ENTRY DATE: 2001-06-18
tcggccgagcccagagacagccagttcctctcccgccgcgccgggccgcgtgccgctcgctccccggccgtggcgcctccgggccagacgcgctgcagcctccagcccgcggcaagcgggcggggcggccgcgccacccccggccccgcgccagcagcccctcgccgcgcgtccagcgttcccggccagcagcctccccatacgcagtcctgctggaccgccccgtcgcgccccccactctgaactcaagtcaccgtggagctccgccgccccgaaactttcacgcgagcgggaaatatgggatgtataaaatcaaaagggaaagacagcttgagtgacgatggagtagatttgaagactcaaccagtacgtaatactgaaagaactatttatgtgagagatccaacgtccaataaacagcaaaggccagttccagaatctcagcttttacctggacagaggtttcaaactaaagatccagaggaacaaggagacattgtggtagccttgtacccctatgatggcatccacccggacgacttgtctttcaagaaaggagagaagatgaaagtcctggaggagcatggagaatggtggaaagcaaagtcccttttaacaaaaaaagaaggcttcatccccagcaactatgtggccaaactcaacaccttagaaacagaagagtggtttttcaaggatataaccaggaaggacgcagaaaggcagcttttggcaccaggaaatagcgctggagctttccttattagagaaagtgaaacattaaaaggaagcttctctctgtctgtcagagactttgaccctgtgcatggtgatgttattaagcactacaaaattagaagtctggataatgggggctattacatctctccacgaatcacttttccctgtatcagcgacatgattaaacattaccaaaagcaggcagatggcttgtgcagaagattggagaaggcttgtattagtcccaagccacagaagccatgggataaagatgcctgggagatcccccgggagtccatcaagttggtgaaaaggcttggcgctgggcagtttggggaagtctggatgggttactataacaacagtaccaaggtggctgtgaaaaccctgaagccaggaactatgtctgtgcaagccttcctggaagaagccaacctcatgaagaccctgcagcatgacaagctcgtgaggctctacgctgtggtcaccagggaggagcccatttacatcatcaccgagtacatggccaagggcagtttgctggatttcctgaagagcgatgaaggtggcaaagtgctgcttccaaagctcattgacttttctgctcagattgcagagggaatggcatacatcgagcggaagaactacattcaccgggacctgcgagcagctaatgttctggtctccgagtcactaatgtgcaaaattgcagattttggccttgctagagtaattgaagataatgagtacacagcaagggaaggtgctaagttccctattaagtggacggctccagaagcaatcaactttggatgtttcactattaagtctgatgtgtggtcctttggaatcctcctatacgaaattgtcacctatgggaaaattccctacccagggagaactaatgccgacgtgatgaccgccctgtcccagggctacaggatgccccgtgtggagaactgcccagatgagctctatgacattatgaaaatgtgctggaaagaaaaggcagaagagagaccaacgtttgactacttacagagcgtcctggatgatttctacacagccacggaagggcaataccagcagcagccttagagcacagggagacccgtccatttggcaggggtggctgcctcatttagagaggaaaagtaaccatcactggttgcacttatgatttcatgtgcggggatcatctgccgtgcctggatcctgaaatagaggctaaattactcaggaagaacaccctctaaatgggaaagtattctgtactcttagatggattctccactcagttgcaacttggacttgtcctcagcagctggtaatcttgctctgcttgacaacatctgagtgcagccgtttgagaagaaaacatctattctctccaaaaatgcacccaactagctctatgtttacaaatggacataggactcaaagtttcagagaccattgcaatgaatccccaataattgcagaactaaactcatttataaagctaaaataaccggatatatacatagcatgacatttctttgtgctttggcttacttgttt

SEQ ID NO: 763 - DNA, 2589 bp, Homo sapiens
  ref <308>: DATABASE ACCESSION NUMBER: NM_002356
  ref <309>: DATABASE ENTRY DATE: 2001-06-18
caaccagggagatttctccattttcctcttgtctacagtgcggctacaaatctgggatttttttattacttctttttttttcgaactacacttgggctcctttttttgtgctcgacttttccaccctttttccctccctcctgtgctgctgctttttgatctcttcgactaaaatttttttatccggagtgtatttaatcggttctgttctgtcctctccaccacccccacccccctccctccggtgtgtgtgccgctgccgctgttgccgccgccgctgctgctgctgctcgccccgtcgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggagaatggccacgtgaaggtaaacggcgacgcttcgcccgcggccgccgagtcgggcgccaaggaggagctgcaggccaacggcagcgccccggccgccgacaaggaggagcccgcggccgccgggagcggggcggcgtcgccctcctcggccgagaaaggtgagccggccgccgccgctgcccccgaggccggggccagcccggtagagaaggaggcccccgcggaaggcgaggctgccgagcccggctcggccacggccgcggagggagaggccgcgtcggccgcctcctcgacttcttcgcccaaggccgaggacggggccacgccctcgcccagcaacgagaccccgaaaaaaaaaaagaagcgcttttccttcaagaagtctttcaagctgagcggcttctccttcaagaagaacaagaaggaggctggagaaggcggtgaggctgaggcgcccgctgccgaaggcggcaaggacgaggccgccgggggcgcagctgcggccgccgccgaggcgggcgcggcctccggggagcaggcagcggcgccgggcgaggaggcggcagcgggcgaggagggggcggcgggtggcgacccgcaggaggccaagccccaggaggccgctgtcgcgccagagaagccgcccgccagcgacgagaccaaggccgccgaggagcccagcaaggtggaggagaaaaaggccgaggaggccggggccagcgccgccgcctgcgaggccccctccgccgccgggcccggcgcgcccccggagcaggaggcagcccccgcggaggagcccgcggccgccgcagcctcgtcagcctgcgcagccccctcacaggaggcccagcccgagtgcagtccagaagcccccccagcggaggcggcagagtaaaagagcaagcttttgtgagataatcgaagaacttttctcccccgtttgtttgttggagtggtgccaggtactgttttggagaacttgtctacaaccagggattgattttaaagatgtctttttttattttacttttttttaagcaccaaattttgttgtttttttttttctcccctccccacagatcccatctcaaatcattctgttaaccaccattccaacaggtcgaggagagcttaaacaccttcttcctctgccttgtttctcttttattttttattttttcgcatcagtattaatgtttttgcatactttgcatctttattcaaaagtgtaaactttctttgtcaatctatggacatgcccatatatgaaggagatgggtgggtcaaaaagggatatcaaatgaagtgataggggtcacaatggggaaattgaagtggtgcataacattgccaaaatagtgtgccactagaaatggtgtaaaggctgtctttttttttttttttaaagaaaagttattaccatgtattttgtgaggcaggtttacaacactacaagtcttgagttaagaaggaaagaggaaaaaagaaaaaacaccaatacccagatttaaaaaaaaaaaaacgatcatagtcttaggagttcatttaaaccataggaacttttcacttatctcatgttagctgtaccagtcagtgattaagtagaactacaagttgtataggctttattgtttattgctggtttatgaccttaataaagtgtaattatgtattaccagcagggtgtttttaactgtgactattgtataaaaacaaatcttgatatccagaagcacatgaagtttgcaactttccaccctgcccatttttgtaaaactgcagtcatcttggaccttttaaaacacaaattttaaactcaaccaagctgtgataagtggaatggttactgtttatactgtggtatgtttttgattacagcagataatgctttcttttccagtcgtctttgagaataaaggaaaaaaaatcttcagatgcaatggttttgtgtagcatcttgtctatcatgttttgtaaatactggagaagctttgaccaatttgacttagagatggaatgtaactttgcttacaaaaattgctattaaactcctgcttaaggtgttctaattttctgtgagcacactaaaagcgaaaaataaatgtgaataaaatgt

SEQ ID NO: 764 - DNA, 1390 bp, Homo sapiens
  ref <308>: DATABASE ACCESSION NUMBER: NM_002358
  ref <309>: DATABASE ENTRY DATE: 2001-06-18
gggaagtgctgttggagccgctgtggttgctgtccgcggagtggaagcgcgtgcttttgtttgtgtccctggccatggcgctgcagctctcccgggagcagggaatcaccctgcgcgggagcgccgaaatcgtggccgagttcttctcattcggcatcaacagcattttatatcagcgtggcatatatccatctgaaacctttactcgagtgcagaaatacggactcaccttgcttgtaactactgatcttgagctcataaaatacctaaataatgtggtggaacaactgaaagattggttatacaagtgttcagttcagaaactggttgtagttatctcaaatattgaaagtggtgaggtcctggaaagatggcagtttgatattgagtgtgacaagactgcaaaagatgacagtgcacccagagaaaagtctcagaaagctatccaggatgaaatccgttcagtgatcagacagatcacagctacggtgacatttctgccactgttggaagtttcttgttcatttgatctgctgatttatacagacaaagatttggttgtacctgaaaaatgggaagagtcgggaccacagtttattaccaattctgaggaagtccgccttcgttcatttactactacaatccacaaagtaaatagcatggtggcctacaaaattcctgtcaatgactgaggatgacatgaggaaaataatgtaattgtaattttgaaatgtggttttcctgaaatcaggtcatctatagttgatatgttttatttcattggttaatttttacatggagaaaaccaaaatgatacttactgaactgtgtgtaattgttcctttatttttttggtacctatttgacttaccatggagttaacatcatgaatttattgcacattgttcaaaaggaaccaggaggtttttttgtcaacattgtgatgtatattcctttgaagatagtaactgtagatggaaaaacttgtgctataaagctagatgctttcctaaatcagatgttttggtcaagtagtttgactcagtataggtagggagatatttaagtataaaatacaacaaaggaagtctaaatattcagaatctttgttaaggtcctgaaagtaactcataatctataaacaatgaaatattgctgtatagctccttttgaccttcatttcatgtatagttttccctattgaatcagtttccaattatttgactttaatttatgtaacttgaacctatgaagcaatggatatttgtactgtttaatgttctgtgatacagaactcttaaaaatgttttttcatgtgttttataaaatcaagttttaagtgaaagtgaggaaataaagttaagtttgttttaaaaaaaaaaaaaaaaaa

SEQ ID NO: 765 - DNA, 698 bp, Homo sapiens
  ref <308>: DATABASE ACCESSION NUMBER: NM_002370
  ref <309>: DATABASE ENTRY DATE: 2001-06-18
ggcgccgccgcaaacgtcagtgtacgaggcagacggcggcagtgcggcttgctcttggaagttcaggctcggttgtcttttgggagccatggagagtgacttttatctgcgttactacgtggggcacaagggcaagttcggccacgagttcctggagtttgagtttcgaccggacgggaagttaagatatgccaacaacagcaattacaagaatgatgtcatgatcagaaaagaggcttatgtacataaaagcgtgatggaggaactgaagagaataattgacgacagtgaaattaccaaagaggatgatgcattgtggcctcctcctgaccgagtgggccggcaggagcttgaaatcgtcattggagatgaacacatttcttttacaacatcaaaaattggttcccttattgatgtcaatcaatccaaggatccagaaggcttacgagtattttattatcttgtccaggacctgaagtgtttggtcttcagtcttattggattacacttcaagattaaaccaatctagactgaatattggtgtggacatggggggtgggtgggagtagaaaattttgtgtatatcagggcagtatttttttatgaactataaatgattgtctttaataaatatgtgataaaatccaatttttattattttataaagacctgaacatgtgaaaaaaaaaaaaaaaaaa

SEQ ID NO: 766 - DNA, 2212 bp, Homo sapiens
  ref <308>: DATABASE ACCESSION NUMBER: NM_002395
  ref <309>: DATABASE ENTRY DATE: 2001-06-18
ccgccgccacagctgcagtcagcaccgtcaccccagcagcatccgccgcctgcaccgcgcgtgcggcccgccccggcctgaccccgccgccgaacccggcgccagccatggagcccgaagccccccgtcgccgccacacccatcagcgcggctacctgctgacacggaaccctcacctcaacaaggacttggcctttaccctggaagagagacagcaattgaacattcatggattgttgccaccttccttcaacagtcaggagatccaggttcttagagtagtaaaaaatttcgagcatctgaactctgactttgacaggtatcttctcttaatggatctccaagatagaaatgaaaaactcttttatagagtgctgacatctgacattgagaaattcatgcctattgtttatactcccactgtgggtctggcttgccaacaatatagtttggtgtttcggaagccaagaggtctctttattactatccacgatcgagggcatattgcttcagttctcaatgcatggccagaagatgtcatcaaggccattgtggtgactgatggagagcgtattcttggcttgggagaccttggctgtaatggaatgggcatccctgtgggtaaattggctctatatacagcttgcggagggatgaatcctcaagaatgtctgcctgtcattctggatgtgggaaccgaaaatgaggagttacttaaagatccactctacattggactacggcagagaagagtaagaggttctgaatatgatgattttttggacgaattcatggaggcagtttcttccaagtatggcatgaattgccttattcagtttgaagattttgccaatgtgaatgcatttcgtctcctgaacaagtatcgaaaccagtattgcacattcaatgatgatattcaaggaacagcatctgttgcagttgcaggtctccttgcagctcttcgaataaccaagaacaaactgtctgatcaaacaatactattccaaggagctggagaggctgccctagggattgcacacctgattgtgatggccttggaaaaagaaggtttaccaaaagagaaagccatcaaaaagatatggctggttgattcaaaaggattaatagttaagggacgtgcttccttaacacaagagaaagagaagtttgcccatgaacatgaagaaatgaagaacctagaagccattgttcaagaaataaaaccaactgccctcataggagttgctgcaattggtggtgcattctcagaacaaattctcaaagatatggctgccttcaatgaacggcctattatttttgctttgagtaatccaactagcaaagcagaatgttctgcagagcagtgctacaaaataaccaagggacgtgcaatttttgccagtggcagtccttttgatccagtcactcttccaaatggacagaccctatatcctggccaaggcaacaattcctacgtgttccctggagttgctcttggtgttgtggcgtgtggattgaggcagatcacagataatattttcctcactactgctgaggttatagctcagcaagtgtcagataaacacttggaagagggtcggctttatcctcctttgaataccattagagatgtttctctgaaaattgcagaaaagattgtgaaagatgcataccaagaaaagacagccacagtttatcctgaaccgcaaaacaaagaagcatttgtccgctcccagatgtatagtactgattatgaccagattctacctgattgttattcttggcctgaagaggtgcagaaaatacagaccaaagttgaccagtaggataatagcaaacatttctaactctattaatgaggtctttaaacctttcataatttttaaaggttggaatcttttataatgattcataagacacttagattaagattttactttaacagtctaaaaattgatagaagaatatcgatataaattgggataaacatcacatgagacaattttgcttcactttgccttctggttatttatggtttctgtctgaattattctgcctacgttctctttaaaagctgttgtacgtactacggagaaactcatcatttttatacaggacactaatgggaagaccaaaattactaataaattgaaataaccaacattaaaactcataattattttgttgaccattttgttaaaatctacttttc

SEQ ID NO: 767 - DNA, 2545 bp, Homo sapiens
  ref <308>: DATABASE ACCESSION NUMBER: NM_002416
  ref <309>: DATABASE ENTRY DATE: 2001-06-18
atccaatacaggagtgacttggaactccattctatcactatgaagaaaagtggtgttcttttcctcttgggcatcatcttgctggttctgattggagtgcaaggaaccccagtagtgagaaagggtcgctgttcctgcatcagcaccaaccaagggactatccacctacaatccttgaaagaccttaaacaatttgccccaagcccttcctgcgagaaaattgaaatcattgctacactgaagaatggagttcaaacatgtctaaacccagattcagcagatgtgaaggaactgattaaaaagtgggagaaacaggtcagccaaaagaaaaagcaaaagaatgggaaaaaacatcaaaaaaagaaagttctgaaagttcgaaaatctcaacgttctcgtcaaaagaagactacataagagaccacttcaccaataagtattctgtgttaaaaatgttctattttaattataccgctatcattccaaaggaggatggcatataatacaaaggcttattaatttgactagaaaatttaaaacattactctgaaattgtaactaaagttagaaagttgattttaagaatccaaacgttaagaattgttaaaggctatgattgtctttgttcttctaccacccaccagttgaatttcatcatgcttaaggccatgattttagcaatacccatgtctacacagatgttcacccaaccacatcccactcacaacagctgcctggaagagcagccctaggcttccacgtactgcagcctccagagagtatctgaggcacatgtcagcaagtcctaagcctgttagcatgctggtgagccaagcagtttgaaattgagctggacctcaccaagctgctgtggccatcaacctctgtatttgaatcagcctacaggcctcacacacaatgtgtctgagagattcatgctgattgttattgggtatcaccactggagatcaccagtgtgtggctttcagagcctcctttctggctttggaagccatgtgattccatcttgcccgctcaggctgaccactttatttctttttgttcccctttgcttcattcaagtcagctcttctccatcctaccacaatgcagtgcctttcttctctccagtgcacctgtcatatgctctgatttatctgagtcaactcctttctcatcttgtccccaacaccccacagaagtgctttcttctcccaattcatcctcactcagtccagcttagttcaagtcctgcctcttaaataaacctttttggacacacaaattatcttaaaactcctgtttcacttggttcagtaccacatgggtgaacactcaatggttaactaattcttgggtgtttatcctatctctccaaccagattgtcagctccttgagggcaagagccacagtatatttccctgtttcttccacagtgcctaataatactgtggaactaggttttaataattttttaattgatgttgttatgggcaggatggcaaccagaccattgtctcagagcaggtgctggctctttcctggctactccatgttggctagcctctggtaacctcttacttattatcttcaggacactcactacagggaccagggatgatgcaacatccttgtctttttatgacaggatgtttgctcagcttctccaacaataagaagcacgtggtaaaacacttgcggatattctggactgtttttaaaaaatatacagtttaccgaaaatcatataatcttacaatgaaaaggactttatagatcagccagtgaccaaccttttcccaaccatacaaaaattccttttcccgaaggaaaagggctttctcaataagcctcagctttctaagatctaacaagatagccaccgagatccttatcgaaactcattttaggcaaatatgagttttattgtccgtttacttgtttcagagtttgtattgtgattatcaattaccacaccatctcccatgaagaaagggaacggtgaagtactaagcgctagaggaagcagccaagtcggttagtggaagcatgattggtgcccagttagcctctgcaggatgtggaaacctccttccaggggaggttcagtgaattgtgtaggagaggttgtctgtggccagaatttaaacctatactcactttcccaaattgaatcactgctcacactgctgatgatttagagtgctgtccggtggagatcccacccgaacgtcttatctaatcatgaaactccctagttccttcatgtaacttccctgaaaaatctaagtgtttcataaatttgagagtctgtgacccacttaccttgcatctcacaggtagacagtatataactaacaaccaaagactacatattgtcactgacacacacgttataatcatttatcatatatatacatacatgcatacactctcaaagcaaataatttttcacttcaaaacagtattgacttgtataccttgtaatttgaaatattttctttgttaaaatagaatggtatcaataaatagaccattaatcag

SEQ ID NO: 768 - DNA, 1973 bp, Homo sapiens
  ref <308>: DATABASE ACCESSION NUMBER: NM_002421
  ref <309>: DATABASE ENTRY DATE: 2001-06-18
gggatattggagtagcaagaggctgggaagccatcacttaccttgcactgagaaagaagacaaaggccagtatgcacagctttcctccactgctgctgctgctgttctggggtgtggtgtctcacagcttcccagcgactctagaaacacaagagcaagatgtggacttagtccagaaatacctggaaaaatactacaacctgaagaatgatgggaggcaagttgaaaagcggagaaatagtggcccagtggttgaaaaattgaagcaaatgcaggaattctttgggctgaaagtgactgggaaaccagatgctgaaaccctgaaggtgatgaagcagcccagatgtggagtgcctgatgtggctcagtttgtcctcactgaggggaaccctcgctgggagcaaacacatctgacctacaggattgaaaattacacgccagatttgccaagagcagatgtggaccatgccattgagaaagccttccaactctggagtaatgtcacacctctgacattcaccaaggtctctgagggtcaagcagacatcatgatatcttttgtcaggggagatcatcgggacaactctccttttgatggacctggaggaaatcttgctcatgcttttcaaccaggcccaggtattggaggggatgctcattttgatgaagatgaaaggtggaccaacaatttcagagagtacaacttacatcgtgttgcggctcatgaactcggccattctcttggactctcccattctactgatatcggggctttgatgtaccctagctacaccttcagtggtgatgttcagctagctcaggatgacattgatggcatccaagccatatatggacgttcccaaaatcctgtccagcccatcggcccacaaaccccaaaagcgtgtgacagtaagctaacctttgatgctataactacgattcggggagaagtgatgttctttaaagacagattctacatgcgcacaaatcccttctacccggaagttgagctcaatttcatttctgttttctggccacaactgccaaatgggcttgaagctgcttacgaatttgccgacagagatgaagtccggtttttcaaagggaataagtactgggctgttcagggacagaatgtgctacacggataccccaaggacatctacagctcctttggcttccctagaactgtgaagcatatcgatgctgctctttctgaggaaaacactggaaaaacctacttctttgttgctaacaaatactggaggtatgatgaatataaacgatctatggatccaggttatcccaaaatgatagcacatgactttcctggaattggccacaaagttgatgcagttttcatgaaagatggatttttctatttctttcatggaacaagacaatacaaatttgatcctaaaacgaagagaattttgactctccagaaagctaatagctggttcaactgcaggaaaaattgaacattactaatttgaatggaaaacacatggtgtgagtccaaagaaggtgttttcctgaagaactgtctattttctcagtcatttttaacctctagagtcactgatacacagaatataatcttatttatacctcagtttgcatatttttttactatttagaatgtagccctttttgtactgatataatttagttccacaaatggtgggtacaaaaagtcaagtttgtggcttatggattcatataggccagagttgcaaagatcttttccagagtatgcaactctgacgttgatcccagagagcagcttcagtgacaaacatatcctttcaagacagaaagagacaggagacatgagtctttgccggaggaaaagcagctcaagaacacatgtgcagtcactggtgtcaccctggataggcaagggataactcttctaacacaaaataagtgttttatgtttggaataaagtcaaccttgtttctactgtttt

SEQ ID NO: 769 - DNA, 1778 bp, Homo sapiens
  ref <308>: DATABASE ACCESSION NUMBER: NM_002426
  ref <309>: DATABASE ENTRY DATE: 2001-06-18
tagaagtttacaatgaagtttcttctaatactgctcctgcaggccactgcttctggagctcttcccctgaacagctctacaagcctggaaaaaaataatgtgctatttggtgagagatacttagaaaaattttatggccttgagataaacaaacttccagtgacaaaaatgaaatatagtggaaacttaatgaaggaaaaaatccaagaaatgcagcacttcttgggtctgaaagtgaccgggcaactggacacatctaccctggagatgatgcacgcacctcgatgtggagtccccgatctccatcatttcagggaaatgccaggggggcccgtatggaggaaacattatatcacctacagaatcaataattacacacctgacatgaaccgtgaggatgttgactacgcaatccggaaagctttccaagtatggagtaatgttacccccttgaaattcagcaagattaacacaggcatggctgacattttggtggtttttgcccgtggagctcatggagacttccatgcttttgatggcaaaggtggaatcctagcccatgcttttggacctggatctggcattggaggggatgcacatttcgatgaggacgaattctggactacacattcaggaggcacaaacttgttcctcactgctgttcacgagattggccattccttaggtcttggccattctagtgatccaaaggctgtaatgttccccacctacaaatatgtcgacatcaacacatttcgcctctctgctgatgacatacgtggcattcagtccctgtatggagacccaaaagagaaccaacgcttgccaaatcctgacaattcagaaccagctctctgtgaccccaatttgagttttgatgctgtcactaccgtgggaaataagatctttttcttcaaagacaggttcttctggctgaaggtttctgagagaccaaagaccagtgttaatttaatttcttccttatggccaaccttgccatctggcattgaagctgcttatgaaattgaagccagaaatcaagtttttctttttaaagatgacaaatactggttaattagcaatttaagaccagagccaaattatcccaagagcatacattcttttggttttcctaactttgtgaaaaaaattgatgcagctgtttttaacccacgtttttataggacctacttctttgtagataaccagtattggaggtatgatgaaaggagacagatgatggaccctggttatcccaaactgattaccaagaacttccaaggaatcgggcctaaaattgatgcagtcttctattctaaaaacaaatactactatttcttccaaggatctaaccaatttgaatatgacttcctactccaacgtatcaccaaaacactgaaaagcaatagctggtttggttgttagaaatggtgtaattaatggtttttgttagttcacttcagcttaataagtatttattgcatatttgctatgtcctcagtgtaccactacttagagatatgtatcataaaaataaaatctgtaaaccataggtaatgattatataaaatacataatatttttcaattttgaaaactctaattgtccattcttgcttgactctactattaagtttgaaaatagttaccttcaaagcaagataattctatttgaagcatgctctgtaagttgcttcctaacatccttggactgagaaattatacttacttctggcataactaaaattaagtatatatattttggctcaaataaaattg

SEQ ID NO: 770 - DNA, 1771 bp, Homo sapiens
  ref <308>: DATABASE ACCESSION NUMBER: NM_002435
  ref <309>: DATABASE ENTRY DATE: 2001-06-18
cgagcatggccgctccgcgagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggctcaaaggtcaaggacacctttaatggcaacctgcccttcctcttcaaagtgctctcagttgaaacacccctgtccatccaggcacaccctaacaaggagctggcagagaagctgcacctccaggctccgcagcactaccccgatgccaaccacaagccagagatggccattgccctcacccccttccagggcttgtgtggcttccggccagttgaggagattgtaacctttctaaagaaggtgcctgagtttcagttcctgattggagatgaggcagcaacacacctgaagcagaccatgagccatgactcccaggctgtggcctcctctctgcagagctgtttctcccacctgatgaagagtgagaagaaggtggtggtggaacagctcaacctgttggtgaagcggatctcccagcaagcggctgccggaaacaacatggaggacatctttggggagcttttgctacagctgcaccagcagtacccaggtgatatcggctgctttgccatctacttcctgaacctgcttaccctgaagcctggggaggccatgtttctggaggccaacgtaccccatgcctacctgaaaggagactgcgtggagtgcatggcgtgttcagacaacacagttcgtgctggcctgacacccaagttcattgatgtgccaaccctgtgtgaaatgctcagctatacccctagctccagcaaggacaggctctttctcccaacacggagtcaggaagacccctacctctcaatctatgacccccctgtaccagacttcaccattatgaagacggaggtccctggctctgtcactgaatacaaggtcttggcactggactctgccagcatcctcctgatggtacaggggacagtaatagccagcacacccacaacccagacaccaatccctctgcaacgtggtggcgtgctcttcattggggccaatgagagtgtctcactgaagcttactgagccgaaggacctgctgatattccgtgcctgctgtctgctgtaaaggctgcagcctccccagctctcctctgccagccaccctaaattccagccaacctcacctcctcgggcccagctcaagcccccttccttgctctggaccccttaggtataccctggaagagctggggtgggggaggagggagcgtgaaggtagtgactcctgaacacacccaggtggaaccatctttggggaggagaggcccgtgtgaggggtctgatactccctttgtcttccctctctactcctcgctacacctgagccaggctcttgccaactctgttccagcctatggctttaggctagctgttaaatatgtgacccagcattagctcagcatctgtcagagcaagagaccaggtaatttctaagaacagggttctagcgatgggactgcccatttcctcagctgcagaggaggaaagggaaagggtaggcctgtagactaacgctgtttacacccttgttctgtcaaagcaattaaagatcacttgtgt

SEQ ID NO: 771 - DNA, 5185 bp, Homo sapiens
  ref <308>: DATABASE ACCESSION NUMBER: NM_002438
  ref <309>: DATABASE ENTRY DATE: 2001-06-18
gggaacttggattaggtggagaggcagttggggggcctcgttgttttgcgtcttagttccgccctcctgtccatcaggagaaggaaaggataaaccctgggccatgaggctacccctgctcctggtttttgcctctgtcattccgggtgctgttctcctactggacaccaggcaatttttaatctataatgaagatcacaagcgctgcgtggatgcagtgagtcccagtgccgtccaaaccgcagcttgcaaccaggatgccgaatcacagaaattccgatgggtgtccgaatctcagattatgagtgttgcatttaaattatgcctgggagtgccatcaaaaacagactgggttgctatcactctctatgcctgtgactcaaaaagtgaatttcagaaatgggagtgcaaaaatgacacacttttggggatcaaaggagaagatttattttttaactacggcaacagacaagaaaagaatattatgctctacaagggatcgggtttatggagcaggtggaagatctatggaaccacagacaatctgtgctccagaggttatgaagccatgtatacgctactaggcaatgccaatggagcaacctgtgcattcccgttcaagtttgaaaacaagtggtacgcagattgcacgagtgctgggcggtcggatggatggctctggtgcggaaccactactgactatgacacagacaagctatttggatattgtccattgaaatttgagggcagtgaaagcttatggaataaagacccgctgaccagcgtttcctaccagataaactccaaatccgctttaacgtggcaccaagcgaggaaaagctgccaacaacagaacgctgagctcctgagcatcacagagatacatgagcaaacatacctgacaggattaaccagttccttgacctcaggactctggattggacttaacagtctgagcttcaacagcggttggcagtggagtgaccgcagtcctttccgatatttgaactggttaccaggaagtccatcagctgaacctggaaaaagctgtgtgtcactaaatcctggaaaaaatgctaaatgggaaaatctggaatgtgttcagaaactgggctatatttgcaaaaagggcaacaccactttaaattcttttgttattccctcagaaagtgatgtgcctactcactgtcctagtcagtggtggccgtatgccggtcactgttacaagattcacagagatgagaaaaaaatccagagggatgctctgaccacctgcaggaaggaaggcggtgacctcacaagtatccacaccatcgaggaattggactttattatctcccagctaggatatgagccaaatgacgaattgtggatcggcttaaatgacattaagattcaaatgtactttgagtggagtgatgggacccctgtaacgtttaccaaatggcttcgtggagaaccaagccatgaaaacaacagacaggaggattgtgtggtgatgaaaggcaaggatgggtactgggcagatcggggctgtgagtggcctcttggctacatctgcaagatgaaatcacgaagccaaggtccagaaatagtggaagtcgaaaaaggctgcaggaaaggctggaaaaaacatcacttttactgctatatgattggacatacgctttcaacatttgcagaagcaaaccaaacctgtaataatgagaatgcttatttaacaactattgaagacagatatgaacaagccttcctgactagtttcgttggcttaaggcctgaaaaatatttctggacaggactttcagatatacaaaccaaagggacttttcagtggaccatcgaggaagaggttcggttcacccactggaattcagatatgccagggcgaaagccagggtgtgttgccatgagaaccgggattgcagggggcttatgggatgttttgaaatgtgatgaaaaggcaaaatttgtgtgcaagcactgggcagaaggagtaacccacccaccgaagcccacgacgactcccgaacccaaatgtccggaggattggggcgccagcagtagaacaagcttgtgtttcaagctgtatgcaaaaggaaaacatgagaagaaaacgtggtttgaatctcgagatttttgtcgagctctgggtggagacttagctagcatcaataacaaagaggaacagcaaacaatatggcgattaataacagctagtggaagctaccacaaactgttttggttgggattgacatatggaagcccttcagaaggttttacttggagtgatggttctcctgtttcatatgaaaactgggcttatggagaacctaataattatcaaaatgttgaatactgtggtgagctgaaaggtgaccctactatgtcttggaatgatattaattgtgaacaccttaacaactggatttgccagatacaaaaaggacaaacaccaaaacctgagccaacaccagctcctcaagacaatccaccagttactgaagatgggtgggttatttacaaagactaccagtattatttcagcaaagagaaggaaaccatggacaatgcgcgagcgttttgcaagaggaattttggtgatcttgtttctattcaaagtgaaagtgaaaagaagtttctatggaaatatgtaaacagaaatgatgcacagtctgcatattttattggtttattgatcagcttggataaaaagtttgcttggatggatggaagcaaagtggattacgtgtcttgggccacaggtgaacccaattttgcaaatgaagatgaaaactgtgtgaccatgtattcaaattcagggttttggaatgacattaactgtggctatccaaacgccttcatttgccagcgacataacagtagtatcaatgctaccacagttatgcctaccatgccctcggtcccatcagggtgcaaggaaggttggaatttctacagcaacaagtgtttcaaaatctttggatttatggaagaagaaagaaaaaattggcaagaggcacgaaaagcttgtataggctttggagggaatctggtctccatacaaaatgaaaaagagcaagcatttcttacctatcacatgaaggactccactttcagtgcctggactgggctgaatgatgtcaattcagaacacacgttcctttggacggatggacgaggagtccattacacaaactgggggaaaggttaccctggtggaagaagaagcagtctttcttatgaagatgctgactgtgttgttattattggaggtgcatcaaatgaagcaggaaaatggatggatgatacctgcgacagtaaacgaggctacatatgccagacacgatccgacccttccttgactaatcctccagcaacgattcaaacagatggctttgttaaatatggcaaaagcagctattcactcatgagacaaaaatttcaatggcatgaagcggagacatactgcaagcttcacaattcccttatagccagcattctggatccctacagtaatgcatttgcgtggctgcagatggaaacatctaatgaacgtgtgtggatcgccctgaacagtaacttgactgataatcaatacacttggactgataagtggagggtgaggtacactaactgggctgctgatgagcccaaattgaaatcagcatgtgtttatctggatcttgatggctactggaagacagcacattgcaatgaaagtttttactttctctgtaaaagatcagatgaaatccctgctactgaacccccacaactgcctggcagatgcccggagtcagatcacacagcatggattcctttccatggtcactgttactatattgagtcctcatatacaagaaactggggccaagcttctctggaatgtcttcgaatgggttcctctctggtttccattgaaagtgctgcagaatccagttttctgtcatatcgggttgagccacttaaaagtaaaaccaatttttggataggattgttcagaaatgttgaagggacgtggctgtggataaataacagtccggtctcctttgtcaactggaacacaggagatccctctggtgaacggaatgattgtgtagctttacatgcgtcttctgggttttggagtaatattcactgttcttcctacaaaggatatatttgtaaaagaccaaaaattattgatgctaaacctactcatgaattacttacaacaaaagctgacacaaggaagatggacccttctaaaccgtcttccaacgtggccggagtagtcatcattgtgatcctcctgattttaacgggtgctggccttgccgcctatttcttttataagaaaagacgtgtgcacctacctcaagagggcgcctttgaaaacactctgtattttaacagtcagtcaagcccaggaactagtgatatgaaagatctcgtgggcaatattgaacagaatgaacactcggtcatctagtacctcaatgcgattctgagatatttgaatttcataaaattgtaactgaaatttaaaatttttagttcaatgtgattgttttctttaaaatgagtactgaattgtactggtctgtccttttttcctttgcctaattgaagaaataattgcttgttttctagcctggcaagatattttcataaaagagggataacaatgctgattactaccttttaaaatattttagataaatgcacagcaccacagcaccacatctaagcattagtgatgggtagctgatgtcagcttcatgtggattttaagcactctagaaacaatgaagcttcttggcatattttaaggagctcccaaaatgtgttacctattaaattgtaactcagcaagtagaagaccatttgaaaagtcaggtacaaatttcctcaagtggcataaaaatgtagtcagttttctcttttaccagtttttatttccactccaattatttagaactttatttgtacatgtgcagaagaataaggcagctgagaatcttgtttcccccaagagagttttacaggctgagtgttgcaaatgtgttctttgtcctgttatatgtatatcaggaatacaaggatgtgaaataaaactgtaaatttgcataactggatgtacttagataatgtgaaataaacattaaagacaaggtctatttttaataaaaaaaaaaaaaaa

SEQ ID NO: 772 - DNA, 3879 bp, Homo sapiens
  ref <308>: DATABASE ACCESSION NUMBER: NM_002444
  ref <309>: DATABASE ENTRY DATE: 2001-06-18
ggcacgaggccagccgaatccaagccgtgtgtactgcgtgctcagcactgcccgacagtcctagctaaacttcgccaactccgctgcctttgccgccaccatgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaaggcccagatggtacaggaagacttggagaagacccgtgctgagctgaagactgccatgagtacacctcatgtggcagagcctgctgagaatgagcaggatgagcaggatgagaatggggcagaggctagtgctgacctacgggctgatgctatggccaaggaccgcagtgaggaggaacgtaccactgaggcagagaagaatgagcgtgtgcagaagcacctgaaggccctcacttcggagctggccaatgccagagatgagtccaagaagactgccaatgacatgatccatgctgagaacatgcgactgggccgagacaaatacaagaccctgcgccagatccggcagggcaacaccaagcagcgcattgacgaatttgagtctatgtaatgggcacccagcctctagggacccctcctccctttttccttgtccccacactcctacacctaactcacctaactcatactgtgctggagccactaactagagcagccctggagtcatgccaagcatttaatgtagccatgggaccaaacctagccccttagcccccacccacttccctgggcaaatgaatggctcactatggtgccaatggaacctcctttctcttctctgttccattgaatctgtatggctagaatatcctacttctccagcctagaggtactttccacttgattttgcaaatgcccttacacttactgttgtcctatgggagtcaagtgtggagtaggttggaagctagctcccctcctctcccctccactgtcttcttcaggtcctgagattacacggtggagtgtatgcggtctaggaatgagacaggacctagatatcttctccagggatgtcaactgacctaaaatttgccctcccatcccgtttagagttatttaggctttgtaacgattgggggaataaaaagatgttcagtcatttttgtttctacctcccagatcggatctgttgcaaactcagcctcaataagccttgtcgttgactttagggactcaatttctccccagggtggatgggggaaatggtgccttcaagaccttcaccaaacatactagaagggcattggccattctattgtggcaaggctgagtagaagatcctaccccaattccttgtaggagtataggccggtctaaagtgagctctatgggcagatctaccccttacttattattccagatctgcagtcacttcgtgggatctgcccctccctgcttcaatacccaaatcctctccagctataacagtagggatgagtacccaaaagctcagccagccccatcaggactcttgtgaaaagagaggatatgttcacacctagcgtcagtattttccctgctaggggttttaggtctcttcccctctcagagctacttgggccatagctcctgctccacagccatcccagccttggcatctagagcttgatgccagtaggctcaactagggagtgagtgcaaaaagctgagtatggtgagagaagcctgtgccctgatccaagtttactcaaccctctcaggtgaccaaaatccccttctcatcactcccctcaaagaggtgactgggccctgcctctgtttgacaaacctctaacccaggtcttgacaccagctgttctgtcccttggagctgtaaaccagagagctgctgggggattctggcctagtcccttccacacccccaccccttgctctcaacccaggagcatccacctccttctctgtctcatgtgtgctcttcttctttctacagtattatgtactctactgatatctaaatattgatttctgccttccttgctaatgcaccattagaagatattagtcttggggcaggatgattttggcctcattactttaccacccccacacctggaaagcatatactatattacaaaatgacattttgccaaaattattaatataagaagctttcagtattagtgatgtcatctgtcactataggtcatacaatccattcttaaagtacttgttatttgtttttattattactgtttgtcttctccccagggttcagtccctcaaggggccatcctgtcccaccatgcagtgccccctagcttagagcctccctcaattccccctggccaccaccccccactctgtgcctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggtttttaaaaaattgtttttggaggggtttatgctcaatccatgttctatttcagtgccaataaaatttaggtgacttcaaaaaaaaaaaa

SEQ ID NO: 773 - DNA, 2808 bp, Homo sapiens
  ref <308>: DATABASE ACCESSION NUMBER: NM_002449
  ref <309>: DATABASE ENTRY DATE: 2001-06-18
ggggggggggggcagcctctcgggaagagccaatcaggggcgagcgtcttctcgtcgcacgaggcccggcgcggattggcggcgcgcgtctcccacttcccctcggaggaaaggctcagctcccagcgcgcccctcccgtctccgcagcaaaaaagtttgagtcgccgctgccgggttgccagcggagtcgcgcgtcgggagctacgtagggcagagaagtcatggcttctccgtccaaaggcaatgacttgttttcgcccgacgaggagggcccagcagtggtggccggaccaggcccggggctggggggcgccgcgggggccgcggaggagcgccgcgtcaaggtctccagcctgcccttcagcgtggaggcgctcatgtccgacaagaagccgcccaaggagtcgcccgctgtgcctcccgaaggcgcctcggccggggcccacctgcggccactgctgctgtcggggcaccgcgctcgggaagcgcacagccccgggccgctggtgaagcccttcgagaccgcctcggtcaagtcgggaaattcagaagatggagcggcgtggatgcaggaacccggccgatattcgccgccgccaagacatatgagccctaccacctgcaccctgaggaaacacaagaccaatcggaagccgcgcacgccctttaccacatcccagctcctcgccctggagcgcaagttccgtcagaaacagtacctctccattgcagagcgtgcagagttctccagctctctgaacctcacagagacccaggtcaaaatctggttccagaaccgaagcgccaaggcgaaaagactgcaggaggcggaactggaaaagctgaaaatggctgcaaaacctatgctaccctccagcttcagtctccccttccccatcagctcgcccctgcaggcagcgtccatatacgcagcatcctacccgttccatagacctgtgcttcccatcccgcccgtgggactctatgccacgccagtgggatatggcatgtaccacctgtcctaaggaagaccagatcaatagactccatgatggatgcttgtttcaaagggtttcctctccctctccacaaaggcatagccagccagtactcctgcgctgctaagccctcgacgttgcaccccaccccctctaacggctagctgacagggccacaccacatagctgaaatttcgttctgtaggcggaggcaccaagccctgcttttcttggtgtaacttccagagtccccccttttttcccttgcacaaaagcttggctctgatggtttttttggcatgatgtatatatatatatacgaaaaatactacagaccctttttatcagcagacgtaaaaattcaaattattttaaaaggcaaaatttatatacatatgtgctttttttctatatctcaccttcccaaaaagacacatgtgtaagtccatttgttgtattttcttaaagagggagacaaattcggaggagcgccgcgtcaaggtctccagcctgcccttcagcgtggaggcgctcatgtccgatttgcaaaaatgtgctaaagtcaatgatttttaccgggattattgacttctgcttatacaagaagccgcccaaggagtcgcccgctgtgcctcccgaaggcgcctcggccggcctgcggaaaaacaaaagaaaacagacacaatgcagcagccagaaaatattagatatggagagattatggccactgctgctgaccggccacggcgtccgggaagcgcacagccccgggccgctggtgatcaaagtgaacccacatcatatttctgcattttacttgcattaaaagaaacctctttataagcccttcgagaccgcctcggtcaagtcgggaaattcagaagatggagcggcgtggatgctacatacgttgttcctatctcccgcccacgcccacacatatttttaaagtttttaggaacccggccgatattcgccgccgccaagacatatgagccctaccacctgcaccctgacctttttaagaatatttttgtaagaccaatacctgggatgagaagaatccgtagactgccggaaacacaagaccaatcggaagccgcgcacgccctttaccacatcccagctcctcgccctggaggtgaggtagaaaaattagaaatacttcctaattcttctcaaggctgttggtaactttggagcgcaagttccgtcagaaacagtacctctccattgcagagcgtgcagagttctctatttcagataattggagagtaaaatgttaaaacctgtgagaggattgtacagctctctgaacctcacagacccaggtcaaaaggttctgagaaatactaggtacattcatcctcacagattgcaaaggtgctttgggtgggggtttagtaattttctgcttaaaaaatgagtatcttgtaaccattacctatatctaaatattcttgaacaattagtagatccagaaagaaaaaaaaaatatgcttctctgtgtgtgtacctgttgtatgtcctaacttattagaaaaattttatatctttttacatgtggggggcagaaggtaaagcatgtttgacttgtgaaaatgggatgtcaaacagccataagttccctggtattcaccttcctgtccatctgtcccctccatcggtatacctttatccctttgaaagggtgcttgtacaatttgatatattttattgaagagttatctcttattctgaattaaattaagcatttgttttattctgaattaaattaagcatttgttttattgcagtaaagtttgtcca

SEQ ID NO: 774 - DNA, 415 bp, Homo sapiens
  ref <308>: DATABASE ACCESSION NUMBER: NM_002450
  ref <309>: DATABASE ENTRY DATE: 2001-06-18
ccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtgggctgtgcmaagtgtgcccagggctgcatctgcaaagggacgtcagacaagtgcagctgctgtgcctgatgccaggacagctgtgctctcagatgtaaatagagcaacctatataaacctggatttttttttttttttttttgtacaaccctgacccgtttgctacatctttttttctatgaaatatgtgaatggcaataaattcatctagactaaaaaaaaaaaaaaaaaaaaaaaaaaaaaaaa

SEQ ID NO: 775 - DNA, 1721 bp, Homo sapiens
  ref <308>: DATABASE ACCESSION NUMBER: NM_002456
  ref <309>: DATABASE ENTRY DATE: 2001-06-18
gaattccctggctgcttgaatctgttctgccccctccccacccatttcaccaccaccatgacaccgggcacccagtctcctttcttcctgctgctgctcctcacagtgcttacagttgttacaggttctggtcatgcaagctctaccccaggtggagaaaaggagacttcggctacccagagaagttcagtgcccagctctactgagaagaatgctgtgagtatgaccagcagcgtactctccagccacagccccggttcaggctcctccaccactcagggacaggatgtcactctggccccggccacggaaccagcttcaggttcagctgccacctggggacaggatgtcacctcggtcccagtcaccaggccagccctgggctccaccaccccgccagcccacgatgtcacctcagccccggacaacaagccagccccgggctccaccgcccccccagcccacggtgtcacctcggccccggacaccaggccgcccccgggctccaccgcccccccagcccacggtgtcacctcggccccggacaccaggccgcccccgggctccaccgcgcccgcagcccacggtgtcacctcggccccggacaccaggccggccccgggctccaccgcccccccagcccatggtgtcacctcggccccggacaacaggcccgccttggcgtccaccgcccctccagtccacaatgtcacctcggcctcaggctctgcatcaggctcagcttctactctggtgcacaacggcacctctgccagggctaccacaaccccagccagcaagagcactccattctcaattcccagccaccactctgatactcctaccacccttgccagccatagcaccaagactgatgccagtagcactcaccatagcacggtacctcctctcacctcctccaatcacagcacttctccccagttgtctactggggtctctttctttttcctgtcttttcacatttcaaacctccagtttaattcctctctggaagatcccagcaccgactactaccaagagctgcagagagacatttctgaaatgtttttgcagatttataaacaagggggttttctgggcctctccaatattaagttcaggccaggatctgtggtggtacaattgactctggccttccgagaaggtaccatcaatgtccacgacgtggagacacagttcaatcagtataaaacggaagcagcctctcgatataacctgacgatctcagacgtcagcgtgagtgatgtgccatttcctttctctgcccagtctggggctggggtgccaggctggggcatcgcgctgctggtgctggtctgtgttctggttgcgctggccattgtctatctcattgccttggctgtctgtcagtgccgccgaaagaactacgggcagctggacatctttccagcccgggatacctaccatcctatgagcgagtaccccacctaccacacccatgggcgctatgtgccccctagcagtaccgatcgtagcccctatgagaaggtttctgcaggtaatggtggcagcagcctctcttacacaaacccagcagtggcagccacttctgccaacttgtaggggcacgtcgccctctgagctgagtggccagccagtgccattccactccactcagggctctctgggccagtcctcctgggagcccccaccacaacacttcccaggcatggaattcc

SEQ ID NO: 776 - DNA, 2627 bp, Homo sapiens
  ref <308>: DATABASE ACCESSION NUMBER: NM_002466
  ref <309>: DATABASE ENTRY DATE: 2001-06-18
gctgacgccttcgagcgcggcccggggcccggagcggccggagcagcccgggtcctgaccccggcccggctcccgctccgggctctgccggcgggcgggcgagcgcggcgcggtccgggccggggggatgtctcggcggacgcgctgcgaggatctggatgagctgcactaccaggacacagattcagatgtgccggagcagagggatagcaagtgcaaggtcaaatggacccatgaggaggacgagcagctgagggccctggtgaggcagtttggacagcaggactggaagttcctggccagccacttccctaaccgcactgaccagcaatgccagtacaggtggctgagagttttgaatccagaccttgtcaaggggccatggaccaaagaggaagaccaaaaagtcatcgagctggttaagaagtatggcacaaagcagtggacactgattgccaagcacctgaagggccggctggggaagcagtgccgtgaacgctggcacaaccacctcaaccctgaggtgaagaagtcttgctggaccgaggaggaggaccgcatcatctgcgaggcccacaaggtgctgggcaaccgctgggccgagatcgccaagatgttgccagggaggacagacaatgctgtgaagaatcactggaactctaccatcaaaaggaaggtggacacaggaggcttcttgagcgagtccaaagactgcaagcccccagtgtacttgctgctggagctcgaggacaaggacggcctccagagtgcccagcccacggaaggccagggaagtcttctgaccaactggccctccgtccctcctaccataaaggaggaggaaaacagtgaggaggaacttgcagcagccaccacatcgaaggaacaggagcccatcggtacagatctggacgcagtgcgaacaccagagcccttggaggaattcccgaagcgtgaggaccaggaaggctccccaccagaaacgagcctgccttacaagtgggtggtggaggcagctaacctcctcatccccgctgtgggttctagcctctctgaagccctggacttgatcgagtcggaccctgatgcttggtgtgacctgagtaaatttgacctccctgaggaaccatctgcagaggacagtatcaacaacagcctagtgcagctgcaagcgtcacatcagcagcaagtcctgccaccccgccagccttccgccctggtgcccagtgtgaccgagtaccgcctggatggccacaccatctcagacctgagccggagcagccggggcgagctgatccccatctcccccagcactgaagtcgggggctctggcattggcacaccgccctctgtgctcaagcggcagaggaagaggcgtgtggctctgtcccctgtcactgagaatagcaccagtctgtccttcctggattcctgtaacagcctcacgcccaagagcacacctgttaagaccctgcccttctcgccctcccagtttctgaacttctggaacaaacaggacacattggagctggagagcccctcgctgacatccaccccagtgtgcagccagaaggtggtggtcaccacaccactgcaccgggacaagacacccctgcaccagaaacatgctgcgtttgtaaccccagatcagaagtactccatggacaacactccccacacgccaaccccgttcaagaacgccctggagaagtacggacccctgaagcccctgccacagaccccgcacctggaggaggacttgaaggaggtgctgcgttctgaggctggcatcgaactcatcatcgaggacgacatcaggcccgagaagcagaagaggaagcctgggctgcggcggagccccatcaagaaagtccggaagtctctggctcttgacattgtggatgaggatgtgaagctgatgatgtccacactgcccaagtctctatccttgccgacaactgccccttcaaactcttccagcctcaccctgtcaggtatcaaagaagacaacagcttgctcaaccagggcttcttgcaggccaagcccgagaaggcagcagtggcccagaagccccgaagccacttcacgacacctgcccctatgtccagtgcctggaagacggtggcctgcggggggaccagggaccagcttttcatgcaggagaaagcccggcagctcctgggccgcctgaagcccagccacacatctcggaccctcatcttgtcctgaggtgttgagggtgtcacgagcccattctcatgtttacaggggttgtgggggcagagggggtctgtgaatctgagagtcattcaggtgacctcctgcagggagccttctgccaccagcccctccccagactctcaggtggaggcaacagggccatgtgctgccctgttgccgagcccagctgtgggcggctcctggtgctaacaacaaagttccacttccaggtctgcctggttccctccccaaggccacagggagctccgtcagcttctcccaagcccacgtcaggcctggcctcatctcagaccctgcttaggatgggggatgtggccaggggtgctcctgtgctcaccctctcttggtgcatttttttggaagaataaaattgcctctctctttg

SEQ ID NO: 777 - DNA, 2561 bp, Homo sapiens
  ref <308>: DATABASE ACCESSION NUMBER: NM_002482
  ref <309>: DATABASE ENTRY DATE: 2001-06-18
gcctgagtgagtctctggcgtcccaaattgcctgtttttctcgcaggctctattccgttcgctggttcgccacctcaggggaacgatggccatggagtccacagccactgccgccgtcgccgcggacgtggtttctgccgacaaaattgaagatgtccctgctccttctacatctgcagataaagtggagagtctggatgtggatagtgaagctaagaaactattgggtttaggacagaaacatctggtgatgggggatattccagcagctgtcaatgcattccaggaagcagctagtcttttaggtaagaagtatggagagacagctaatgagtgtggagaagccttctttttctatgggaaatcacttctggagttggcaagaatggagaatggtgtgttgggaaacgccttggaaggtgtgcatgtggaagaggaagaaggagaaaaaacagaagatgaatctctggtagaaaataatgataacatagatgaggaagcaagggaagagttgagagaacaggtttatgacgccatgggagaaaaagaagaagccaaaaaaacagaagacaagtctttggcaaagcctgaaactgataaagaacaggacagtgaaatggagaagggtggaagagaagatatggatataagtaaatctgcagaggagccacaggaaaaagttgacttgactctagattggttaactgaaacctctgaagaggcaaaaggaggagcagcaccagaaggaccgaatgaagctgaggtcacttctgggaagccagaacaggaagtaccagatgctgaggaagaaaaatcagtttctggaactgatgtccaagaagagtgcagagaaaaaggaggtcaggagaagcagggagaggtaattgtgagcatagaggagaagccaaaagaagtttcagaagagcagcctgtggtgactctagaaaagcagggcactgcagtggaggtagaagcagagtctttagacccgacagtcaagccagtggatgtgggtggggacgagccagaggagaaggtagttacctctgaaaacgaggcaggaaaggcggttcttgaacaactggtaggtcaagaagtaccacctgctgaagagtcaccagaggtgcaaacagaggctgcagaggcctcagctgtagaggctggatcagaagtctctgaaaagcctgggcaggaggctccagttctccctaaggatggtgcagtcaatggaccgtcagttgtaggagatcagactcctattgaaccacagacttctatagaaagactgacagaaacaaaagatggctcaggactagaggagaaggtcagggcaaagctggttcctagtcaggaggagactaagctgtctgtagaagagtctgaggcagctggagatggggttgataccaaggtagcccagggagctactgagaaatcacctgaagacaaagttcagatagctgctaatgaagagacacaagagagagaagaacagatgaaagagggtgaagaaactgaaggctcggaagaggatgataaagaaaatgataagactgaagaaatgccaaatgattcagtccttgaaaacaagtctcttcaagaaaatgaggaggaggagattgggaacctagagcttgcctgggatatgctggatttagcaaagatcatttttaaaaggcaagaaacaaaagaagcacagctttatgctgcccaggcacatcttaaactcggagaagttagtgttgaatctgaaaactatgtgcaagctgtggaggagttccagtcctgccttaacctgcaggaacagtacctggaagcccacgaccgtctgcttgcagagacccactaccagctgggcttggcttatgggtacaactctcagtatgatgaggcagtggcacagttcagcaaatctattgaagtcattgagaacagaatggctgtactaaacgagcaggtgaaggaggctgaaggatcgtctgaatacaagaaagaaattgaggaactaaaggaactgctacccgaaattagagagaagatagaagatgcaaaggagtctcagcgtagtgggaatgtagctgaactggctctgaaagctactctggtggagagttctacttcaggtttcactcctggtggaggaggctcttcagtctccatgattgccagtagaaagccaacagacggtgcttcctcatcaaattgtgtgactgatatttcccaccttgtcagaaagaagaggaaaccagaggaagagagtccccggaaagatgatgcaaagaaagccaaacaagagccggaggtgaacggaggcagtggggatgctgtcccgagtggaaatgaagtttcggaaaacatggaggaggaggctgagaatcagctgaaacgcggagcagcagtggaggggacactggaggctggagctacagttgaaagcactgcatgttaagagggggcacagcctcctcccaagggaaagtgtttttgtatataatgtattttttcacttttggaggattctttttgtataacttcaataaagattgtaagcaaaaaaaaaa

SEQ ID NO: 778 - DNA, 2119 bp, Homo sapiens
  ref <308>: DATABASE ACCESSION NUMBER: NM_002497
  ref <309>: DATABASE ENTRY DATE: 2001-06-18
ggcacgagtaggggtggcgggtcagtgctgctcgggggcttctccatccaggtccctggagttcctggtccctggagctccgcacttggcgcgcaacctgcgtgaggcagcgcgactctggcgactggccggccatgccttcccgggctgaggactatgaagtgttgtacaccattggcacaggctcctacggccgctgccagaagatccggaggaagagtgatggcaagatattagtttggaaagaacttgactatggctccatgacagaagctgagaaacagatgcttgtttctgaagtgaatttgcttcgtgaactgaaacatccaaacatcgttcgttactatgatcggattattgaccggaccaatacaacactgtacattgtaatggaatattgtgaaggaggggatctggctagtgtaattacaaagggaaccaaggaaaggcaatacttagatgaagagtttgttcttcgagtgatgactcagttgactctggccctgaaggaatgccacagacgaagtgatggtggtcataccgtattgcatcgggatcttaaaccagccaatgttttcctggatggcaagcaaaacgtcaagcttggagactttgggctagctagaatattaaaccatgacacgagttttgcaaaaacatttgttggcacaccttattacatgtctcctgaacaaatgaatcgcatgtcctacaatgagaaatcagatatctggtcattgggctgcttgctgtatgagttatgtgcattaatgcctccatttacagcttttagccagaaagaactcgctgggaaaatcagagaaggcaaattcaggcgaattccataccgttactctgatgaattgaatgaaattattacgaggatgttaaacttaaaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcagaaagaacaggagctttgtgttcgtgagagactagcagaggacaaactggctagagcagaaaatctgttgaagaactacagcttgctaaaggaacggaagttcctgtctctggcaagtaatccagaacttcttaatcttccatcctcagtaattaagaagaaagttcatttcagtggggaaagtaaagagaacatcatgaggagtgagaattctgagagtcagctcacatctaagtccaagtgcaaggacctgaagaaaaggcttcacgctgcccagctgcgggctcaagccctgtcagatattgagaaaaattaccaactgaaaagcagacagatcctgggcatgcgctagccaggtagagagacacagagctgtgtacaggatgtaatattaccaacctttaaagactgatattcaaatgctgtagtgttgaatacttggccccatgagccatgcctttctgtatagtacacatgatatttcggaattggttttactgttcttcagcaactattgtacaaaatgttcacatttaatttttctttcttcttttaagaacatattataaaaagaatactttcttggttgggcttttaatcctgtgtgtgattactagtaggaacatgagatgtgacattctaaatcttgggagaaaaaataatattaggaaaaaaatatttatgcaggaagagtagcactcactgaatagttttaaatgactgagtggtatgcttacaattgtcatgtctagatttaaattttaagtctgagattttaaatgtttttgagcttagaaaacccagttagatgcaatttggtcattaataccatgacatcttgcttataaatattccattgctctgtagttcaaatctgttagctttgtgaaaattcatcactgtgatgtttgtattctttttttttttctgtttaacagaatatgagctgtctgtcatttacctacttctttcccactaaataaaagaattcttcagtta

SEQ ID NO: 779 - DNA, 2669 bp, Homo sapiens
  ref <308>: DATABASE ACCESSION NUMBER: NM_002510
  ref <309>: DATABASE ENTRY DATE: 2001-06-18
cagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatgaaagaccttctgcttacatgagggagcacaatcaattaaatggctggtcttctgatgaaaatgactggaatgaaaaactctacccagtgtggaagcggggagacatgaggtggaaaaactcctggaagggaggccgtgtgcaggcggtcctgaccagtgactcaccagccctcgtgggctcaaatataacatttgcggtgaacctgatattccctagatgccaaaaggaagatgccaatggcaacatagtctatgagaagaactgcagaaatgaggctggtttatctgctgatccatatgtttacaactggacagcatggtcagaggacagtgacggggaaaatggcaccggccaaagccatcataacgtcttccctgatgggaaaccttttcctcaccaccccggatggagaagatggaatttcatctacgtcttccacacacttggtcagtatttccagaaattgggacgatgttcagtgagagtttctgtgaacacagccaatgtgacacttgggcctcaactcatggaagtgactgtctacagaagacatggacgggcatatgttcccatcgcacaagtgaaagatgtgtacgtggtaacagatcagattcctgtgtttgtgactatgttccagaagaacgatcgaaattcatccgacgaaaccttcctcaaagatctccccattatgtttgatgtcctgattcatgatcctagccacttcctcaattattctaccattaactacaagtggagcttcggggataatactggcctgtttgtttccaccaatcatactgtgaatcacacgtatgtgctcaatggaaccttcagccttaacctcactgtgaaagctgcagcaccaggaccttgtccgccaccgccaccaccacccagaccttcaaaacccaccccttctttaggacctgctggtgacaaccccctggagctgagtaggattcctgatgaaaactgccagattaacagatatggccactttcaagccaccatcacaattgtagagggaatcttagaggttaacatcatccagatgacagacgtcctgatgccggtgccatggcctgaaagctccctaatagactttgtcgtgacctgccaagggagcattcccacggaggtctgtaccatcatttctgaccccacctgcgagatcacccagaacacagtctgcagccctgtggatgtggatgagatgtgtctgctgactgtgagacgaaccttcaatgggtctgggacgtactgtgtgaacctcaccctgggggatgacacaagcctggctctcacgagcaccctgatttctgttcctgacagagacccagcctcgcctttaaggatggcaaacagtgccctgatctccgttggctgcttggccatatttgtcactgtgatctccctcttggtgtacaaaaaacacaaggaatacaacccaatagaaaatagtcctgggaatgtggtcagaagcaaaggcctgagtgtctttctcaaccgtgcaaaagccgtgttcttcccgggaaaccaggaaaaggatccgctactcaaaaaccaagaatttaaaggagtttcttaaatttcgaccttgtttctgaagctcacttttcagtgccattgatgtgagatgtgctggagtggctattaacctttttttcctaaagattattgttaaatagatattgtggtttggggaagttgaattttttataggttaaatgtcattttagagatggggagagggattatactgcaggcagcttcagccatgttgtgaaactgataaaagcaacttagcaaggcttcttttcattattttttatgtttcacttataaagtcttaggtaactagtaggatagaaacactgtgtcccgagagtaaggagagaagctactattgattagagcctaacccaggttaactgcaagaagaggcgggatactttcagctttccatgtaactgtatgcataaagccaatgtagtccagtttctaagatcatgttccaagctaactgaatcccacttcaatacacactcatgaactcctgatggaacaataacaggcccaagcctgtggtatgatgtgcacacttgctagactcagaaaaaatactactctcataaatgggtgggagtattttggtgacaacctactttgcttggctgagtgaaggaatgatattcatatattcatttattccatggacatttagttagtgctttttatataccaggcatgatgctgagtgacactcttgtgtatatttccaaatttttgtatagtcgctgcacatatttgaaatcatatattaagactttccaaagatgaggtccctggtttttcatggcaacttgatcagtaaggatttcacctctgtttgtaactaaaaccatctactatatgttagacatgacattctttttctctccttcctgaaaaataaagtgtgggaagagacaaaaaaaaaaaaa

SEQ ID NO: 780 - DNA, 670 bp, Homo sapiens
  ref <308>: DATABASE ACCESSION NUMBER: NM_002512
  ref <309>: DATABASE ENTRY DATE: 2001-06-18
cggccacgaggcggaatcccttctgctctcccagcgcagcgccgccgcccggcccctccagcttcccggaccatggccaacctggagcgcaccttcatcgccatcaagccggacggcgtgcagcgcggcctggtgggcgagatcatcaagcgcttcgagcagaagggattccgcctcgtggccatgaagttcctccgggcctctgaagaacacctgaagcagcactacattgacctgaaagaccgaccattcttccctgggctggtgaagtacatgaactcagggccggttgtggccatggtctgggaggggctgaacgtggtgaagacaggccgagtgatgcttggggagaccaatccagcagattcaaagccaggcaccattcgtggggacttctgcattcaggttggcaggaacatcattcatggcagtgattcagtaaaaagtgctgaaaaagaaatcagcctatggtttaagcctgaagaactggttgactacaagtcttgtgctcatgactgggtctatgaataagaggtggacacaacagcagtctccttcagcacggcgtggtgtgtccctggacacagctcttcattccattgacttagaggcaacaggattgatcattcttttatagagcatatttgccaataaagcttttggaagccgg

SEQ ID NO: 781 - DNA, 3671 bp, Homo sapiens
  ref <308>: DATABASE ACCESSION NUMBER: NM_002515
  ref <309>: DATABASE ENTRY DATE: 2001-06-18
gaattccgacaaaacaaaagggagaaccttctcccggtagcagcggcaggaactgcaaacatgatggcggcagctcccatccagcagaacgggacccacactggggttcccatagacctggacccgccggactcgcggaaaaggccgctggaagccccccctgaagccggcagcaccaagaggaccaatacgggcgaagacggccagtattttctaaaggttctcatacctagttatgctgctggatctataattgggaagggaggacagacaattgttcagttgcaaaaagaaactggagccaccatcaagctgtctaagctgtctaagtccaaagatttttacccaggtactactgagcgagtgtgcttgatccagggaacggttgaagcactgaatgcagttcatggattcattgcagaaaaaattcgagaaatgccccaaaatgtggccaagacagaaccagtcagcattctacaaccccagaccaccgttaatccagatcgcatcaaacaaacattgccatcttccccaactaccaccaagtcctctccatctgatcccatgaccacctccagagctaatcaggtaaagattatagttcccaacagcacagcaggtctgataatagggaagggaggtgctactgtgaaggctgtaatggagcagtcaggggcttgggtgcagctttcccagaaacctgatgggatcaacttgcaagagagggttgtcactgtgagtggagaacctgaacaaaaccgaaaagctgttgaacttatcatccagaagatacaagaggatccacaaagtggcagctgtctcaatatcagttatgccaatgtgacaggtccagtggcaaattccaatccaaccggatctccttatgcaaacactgctgaagtgttaccaactgctgcagcagctgcagggctattaggacatgctaaccttgctggcgttgcagcctttccagcagttttatctggcttcacaggcaatgacctggtggccatcacctctgcacttaatacattagccagctatggatataatctcaacactttaggtttaggtctcagtcaagcagcagcaacaggggctttggctgcagcagctgccagtgccaacccagcagcagcagcagccaatttattggccacctatgccagtgaagcctcagccagtggcagcacagctggtggtacggcggggacatttgcattaggtagcctggctgctgctactgctgcaaccaatggatattttggagctgcttctcccctagctgccagtgccattctaggaacagaaaagtccacagatggatccaaggatgtagttgaaatagcagtgccagaaaacttagttggtgcaatacttggcaaaggagggaaaacattagtggaataccaggagttgactggtgcaaggatacagatctccaaaaaaggagaattcgtacctggcacaaggaatcggaaggtaaccattactggaacaccagctgcaacacaggctgctcaatatttaattacacaaaggatcacatatgagcaaggagttcgggctgccaatcctcagaaagtgggttgagtgccccagttacacatcagattgttttaacccctcctttaccccattttcaagaaggatgtactgtactttgcagaagtgaagtttttctgttattaatatataattatgcaaatgaatgcgactatgttgacaatgtgtatatgtaaataatatgtgttttaccagatgtttcatagaaagaattttttcttgatctgttttgttctctatactttgcttgtgtatatttgtcagaggtgtttctagtgtaagatttaagcctgccattttaccagcattattgtagtttaatgattgaatgtagacagggatatgcgtatagttttcagtattagttctagataacactaaattaactactgttaggttgagtatggtggggtcagtgacctaaaatggagtgaggccaaagcactgtcctgtaagtcttacttcctgcttagggcacagtgaagtaggaaacaatattttgaaaataagttttaaatttaaaatgatcaaaaagcaatatagttgcataaaagcactgtaaaatatttaaaaggttaaaactgtggaaaattatattggtaagtttacagatcaataaaagcacctgttctccatctgaactagacaatggaaataatgctgcatgctgccatggcccattcttcatcatttgtaagttcaacaaaagttctcacatggagtcccacctcttcagaggttgcacatttgtttttaagactgaattcactactgatcccatcgcctggccgagacagtcattactccattaacatcctcactgtttagacacataactgtggtacaggattggaaattataaacaaaagtgaaagtgccaacaaattattgatagctgataatgtttcatatctgcaactgcttgataagtatgttgcattttaagagcttataattgtgtataatttgttaacactagaaacctattagtattgtgaatgtagattttactgtgaagctatctgtgatttagctgtttgctcccatgatggagtctttgcagcatggcgctagcagccaatgcagtttctaatactcggtaatttgcatgttttgtggagcatttttatgtcaccaaccagacagtatttcctgcatgcttatttagaagaggcagcttatcttgagaggtagtgttatctacctttgtcaggctttttgacaggtcatttcagagtaagcctttgttcccaagacccaacaactgtcaccctcttctgtacctctcctgagtgccaactgtccaggccatttgacacaccatctgttaacctctgagtttgcccactcaaggccactcataggggcatcctagccctgtgcactcagcactcataggatcatccagactctcatgcggcatgcagtctaatcatgacaaataatgctgctactctgatatctggctgagcaactgaattacaaaagagaattacttccatctcaacttcaacccattgattacgtccatcctagcaagctaaatggcatcccagctgctcctttctgtgcaaccaattaaagaacaatgagtgtgatgctccatgtctgaatttcgtccagcctctctctgaactgtgatctttgtcctcatgaactttcccttttgttcattgaactatatggactcttcatttcatattgatttactgtgcaatttacttttggacattgagaacttgaaattatttcctgatcccttccccttccactattaataattcatttctgtcaaactgtaagagtagactcattttttttttttttagtttttaacattggactgttatttcatttagagttctctatctctaaatatttatttagagaatgattttaaaagggaatgatatgcttgtttaaatgaaagagaaaagctgtagtaaactgtgttaattggtaatgactatttatcgtcgatactctgtagctgtgtaagttttgacaaatagtgtatctcgtggaatcagtggttagcattgccgctattatatttactcattttatcattataaatgtgtttagttcatcatgtagcatcaaaa

SEQ ID NO: 782 - DNA, 1963 bp, Homo sapiens
  ref <308>: DATABASE ACCESSION NUMBER: NM_002524
  ref <309>: DATABASE ENTRY DATE: 2001-06-18
gaaacgtcccgtgtgggaggggcgggtctgggtgcggctgccgcatgactcgtggttcggaggcccacgtggccggggcggggactcaggcgcctggcagccgactgattacgtagcgggcggggccggaagtgccgctccttggtgggggctgttcatggcggttccggggtctccaacatttttcccggtctgtggtcctaaatctgtccaaagcagaggcagtggagcttgaggttcttgctggtgtgaaatgactgagtacaaactggtggtggttggagcaggtggtgttgggaaaagcgcactgacaatccagctaatccagaaccactttgtagatgaatatgatcccaccatagaggattcttacagaaaacaagtggttatagatggtgaaacctgtttgttggacatactggatacagctggacaagaagagtacagtgccatgagagaccaatacatgaggacaggcgaaggcttcctctgtgtatttgccatcaataatagcaagtcatttgcggatattaacctctacagggagcagattaagcgagtaaaagactcggatgatgtacctatggtgctagtgggaaacaagtgtgatttgccaacaaggacagttgatacaaaacaagcccacgaactggccaagagttacgggattccattcattgaaacctcagccaagaccagacagggtgttgaagatgctttttacacactggtaagagaaatacgccagtaccgaatgaaaaaactcaacagcagtgatgatgggactcagggttgtatgggattgccatgtgtggtgatgtaacaagatacttttaaagttttgtcagaaaagagccactttcaagctgcactgacaccctggtcctgacttcctggaggagaagtattcctgttgctgtcttcagtctcacagagaagctcctgctacttccccagctctcagtagtttagtacaataatctctatttgagaagttctcagaataactacctcctcacttggctgtctgaccagagaatgcacctcttgttactccctgttatttttctgccctgggttcttccacagcacaaacacacctcaacacacctctgccaccccaggtttttcatctgaaaagcagttcatgtctgaaacagagaaccaaaccgcaaacgtgaaattctattgaaaacagtgtcttgagctctaaagtagcaactgctggtgattttttttttctttttactgttgaacttagaactatgcctaatttttggagaaatgtcataaattactgttttgccaagaatatagttattattgctgtttggtttgtttataatgttatcggctctattctctaaactggcatctgctctagattcataaatacaaaaatgaatactgaattttgagtctatcctagtcttcacaactttgacgtaattaaatccaacttttcacagtgaagtgcctttttcctagaagtggtttgtagactcctttataatatttcagtggaatagatgtctcaaaaatccttatgcatgaaatgaatgtctgagatacgtctgtgacttatctaccattgaaggaaagctatatctatttgagagcagatgccattttgtacatgtatgaaattggttttccagaggcctgttttggggctttcccaggagaaagatgaaactgaaagcatatgaataatttcacttaataatttttacctaatctccacttttttcataggttactacctatacaatgtatgtaatttgtttcccctagcttactgataaacctaatattcaatgaacttccatttgtattcaaatttgtgtcataccagaaagctctacatttgcagatgttcaaatattgtaaaactttggtgcattgttatttaatagctgtgatcagtgattttcaaacctcaaatatagtatattaacaaatt

SEQ ID NO: 783 - DNA, 2062 bp, Homo sapiens
  ref <308>: DATABASE ACCESSION NUMBER: NM_002539
  ref <309>: DATABASE ENTRY DATE: 2001-06-18
gtcagtccctcctgtagccgccgccgccgccgcccgccgcccctctgccagcagctccggcgccacctcgggccggcgtctccggcgggcgggagccaggcgctgacgggcgcggcgggggcggccgagcgctcctgcggctgcgactcaggctccggcgtctgcgcttccccatggggctggcctgcggcgcctgggcgctctgagattgtcactgctgttccaagggcacacgcagagggatttggaattcctggagagttgcctttgtgagaagctggaaatatttctttcaattccatctcttagttttccataggaacatcaagaaatcatgaacaactttggtaatgaagagtttgactgccacttcctcgatgaaggttttactgccaaggacattctggaccagaaaattaatgaagtttcttcttctgatgataaggatgccttctatgtggcagacctgggagacattctaaagaaacatctgaggtggttaaaagctctccctcgtgtcacccccttttatgcagtcaaatgtaatgatagcaaagccatcgtgaagacccttgctgctaccgggacaggatttgactgtgctagcaagactgaaatacagttggtgcagagtctgggggtgcctccagagaggattatctatgcaaatccttgtaaacaagtatctcaaattaagtatgctgctaataatggagtccagatgatgacttttgatagtgaagttgagttgatgaaagttgccagagcacatcccaaagcaaagttggttttgcggattgccactgatgattccaaagcagtctgtcgtctcagtgtgaaattcggtgccacgctcagaaccagcaggctccttttggaacgggcgaaagagctaaatatcgatgttgttggtgtcagcttccatgtaggaagcggctgtaccgatcctgagaccttcgtgcaggcaatctctgatgcccgctgtgtttttgacatgggggctgaggttggtttcagcatgtatctgcttgatattggcggtggctttcctggatctgaggatgtgaaacttaaatttgaagagatcaccggcgtaatcaacccagcgttggacaaatactttccgtcagactctggagtgagaatcatagctgagcccggcagatactatgttgcatcagctttcacgcttgcagttaatatcattgccaagaaaattgtattaaaggaacagacgggctctgatgacgaagatgagtcgagtgagcagacctttatgtattatgtgaatgatggcgtctatggatcatttaattgcatactctatgaccacgcacatgtaaagccccttctgcaaaagagacctaaaccagatgagaagtattattcatccagcatatggggaccaacatgtgatggcctcgatcggattgttgagcgctgtgacctgcctgaaatgcatgtgggtgattggatgctctttgaaaacatgggcgcttacactgttgctgctgcctctacgttcaatggcttccagaggccgacgatctactatgtgatgtcagggcctgcgtggcaactcatgcagcaattccagaaccccgacttcccacccgaagtagaggaacaggatgccagcaccctgcctgtgtcttgtgcctgggagagtgggatgaaacgccacagagcagcctgtgcttcggctagtattaatgtgtagatagcactctggtagctgttaactgcaagtttagcttgaattaagggatttggggggaccatgtaacttaattactgctagttttgaaatgtctttgtaagagtagggtcgccatgatgcagccatatggaagactaggatatgggtcacacttatctgtgttcctatggaaactatttgaatatttgttttatatggatttttattcactcttcagacacgctactcaagagtgcccctcagctgctgaacaagcatttgtagcttgtacaatggcagaatgggccaaaagcttagtgttgtgacctgtttttaaaataaagtatcttgaaataattaggc

SEQ ID NO: 784 - DNA, 2557 bp, Homo sapiens
  Modified_base 1 ... 2557: n = a,c,g, or t
  ref <308>: DATABASE ACCESSION NUMBER: NM_002542
  ref <309>: DATABASE ENTRY DATE: 2001-06-18
ttcgcttgaacccgggaggcggagcttgcagtgagccgagatcgcgccatcacactccagctcaggcgacagagtgagactccgtctcaaagaaaaaaaacttgcagcctgatagttaagatacagcaaccccaaatccctatgctaaaaggtgagaatggcccagataaaggtcatgtctcctagctccctgctttttnatgccatcctccagaagggaagaaattaaataatccatcctcctactccaggcgactagaaggcaggctgcctcagggccacacactgggacttggactcaacctgatgggcttctgggcccagccccagacaaacccccggcaaacgtcccattccgaggaaagcatgagcagatggagtatggaagaaatgcccaagacggcaggcagcagctgtggcggccggcgggacgacaatccgaggagaggcctctgatgtcctgaggtctcagaggacgcctaaaggccttgaatgggacaagcttagcgggcgggcgcagaagagaataatactctggagacacttcccgagggctctggggccggagctgtgttcgctccggttcttggtgaagacagggttcgtgggaggcggcccaaggagggcgaacgcctaagactgcaaaggctcgggggagaacggctctcggagaacgggctggggaaggacgtggctctgaagacggacagccctgaggaaccgcggggcgcccagatggaactcgttagcgccccgagtgcagacaatcccggagggggaaaggcgagcagctggcagagagcccagtgccggccaaccgcgcgagcgcctcagaacggcccgcccaccctgatttctcattggcgcctcctacctcctcctcggattggctacctctaggtgaaatgagcggtggttgagccctacttccggtggtgctgtggtctgcccctggagaacccagaagaacacagctgtgcgcgcccacaggctctgggggcgggagaagataagtcgcaaggagggggcgggacctacacctcaggaaagccggagaattggggcacgaagcggggctttgatgacccgcaaagggcgaggcatgcaggaggtggaggaattaagtgaaacagggaaggttgttaaacagcaccgtgtgggcgaggccttaagggtcgtggtccttgtctgggcggggtctttgggcgtcgacgaggcctggttctgggtaggcggggctactacggggcggtgcctgctgtggaaatgcctgcccgcgcgcttctgcccaggcgcatggggcatcgtactctagcctccactcctgccctgtgggcctccatcccgtgccctcgctctgagctgcgcctggacctggttctgccttctggacaatctttccggtggagggagcaaagtcctgcacactggagtggtgtactagcggatcaagtatggacactgactcagactgaggagcagctccactgcactgtgtaccgaggagacaagagccaggctagcaggcccacaccagacgagctggaggccgtgcgcaagtacttccagctagatgttaccctggctcaactgtatcaccactggggttccgtggactcccacttccaagaggtggctcagaaattccaaggtgtgcgactgctgcgacaagaccccatcgaatgccttttctcttttatctgttcctccaacaacaacatcgcccgcatcactggcatggtggagcggctgtgccaggcttttggacctcggctcatccagcttgatgatgtcacctaccatggcttccccagcctgcaggccctggctgggccagaggtggaggctcatctcaggaagctgggcctgggctatcgtgcccgttacgtgagtgccagtgcccgagccatcctggaagaacagggcgggctagcctggctgcagcagctacgagagtcctcatatgaggaggcccacaaggccctctgcatcctgcctggagtgggcaccaaggtggctgactgcatctgcctgatggccctagacaagccccaggctgtgcccgtggatgtccatatgtggcacattgcccaacgtgactacagctggcaccctaccacgtcccaggcgaagggaccgagcccccagaccaacaaggaactgggaaactttttccggagcctgtggggaccttatgctggctgggcccaagcggtgctgttcagtgccgacctgcgccaatcccgccatgctcaggagccaccagcaaagcgcagaaagggttccaaagggccggaaggctagatggggcaccctggacaaagaaattccccaagcaccttcccctccattccccacttctctctccccatccccacccagtctcatgttggggaggggcctccctgtgactacctcaaaggccaggcacccccaaatcaagcagtcagtttgcacaacaagatggggtgggggatattgagggagacagcgctaaggatggttttatcttccctttattacaagaaggaacaataaaatagaaacatttgtatgg

SEQ ID NO: 785 - DNA, 1535 bp, Homo sapiens
  ref <308>: DATABASE ACCESSION NUMBER: NM_002555
  ref <309>: DATABASE ENTRY DATE: 2001-06-18
ggcacgaggaggtcacctggagcgctcaccccaccggcacccgtgcccaagcccgcccctgcaaaggcaggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccggtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtgtttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccagccgcccagatggtcatcacggacctgtcggcacccgaggagcggcccgcggccctgggccggctgggcctctgcttcggcgtcggagtcatcctcggctccctgctgggcgggaccctggtctccgcgtacgggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggtgacccagggcctggtcatcgggcagctgagcagccacttctcggaggaggtgatgctccgggccagcgtgctggtcttcatcgtggtgggcctggccatggcctggatgtccagcgtcttccacttctgcctcctggtgcccggcctggtgttcagcctctgcaccctcaacgtggtcaccgacagcatgctgatcaaggctgtctccacctcggacacagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctgcccagacacagactggcaataaactcctgctccctcaaaaaaaaaaaaaaaa

SEQ ID NO: 786 - DNA, 1978 bp, Homo sapiens
  ref <308>: DATABASE ACCESSION NUMBER: NM_002561
  ref <309>: DATABASE ENTRY DATE: 2001-06-18
ggcacgagggtccgcaagcccggctgagagcgcgccatggggcaggcgggctgcaaggggctctgcctgtcgctgttcgactacaagaccgagaagtatgtcatcgccaagaacaagaaggtgggcctgctgtaccggctgctgcaggcctccatcctggcgtacctggtcgtatgggtgttcctgataaagaagggttaccaagacgtcgacacctccctgcagagtgctgtcatcaccaaagtcaagggcgtggccttcaccaacacctcggatcttgggcagcggatctgggatgtcgccgactacgtcattccagcccagggagagaacgtcttttttgtggtcaccaacctgattgtgacccccaaccagcggcagaacgtctgtgctgagaatgaaggcattcctgatggcgcgtgctccaaggacagcgactgccacgctggggaagcggttacagctggaaacggagtgaagaccggccgctgcctgcggagagggaacttggccaggggcacctgtgagatctttgcctggtgcccgttggagacaagctccaggccggaggagccattcctgaaggaggccgaagacttcaccattttcataaagaaccacatccgtttccccaaattcaacttctccaaaaacaatgtgatggacgtcaaggacagatctttcctgaaatcatgccactttggccccaagaaccactactgccccatcttccgactgggctccatcgtccgctgggccgggagcgacttccaggatatagccctgcgaggtggcgtgataggaattaatattgaatggaactgtgatcttgataaagctgcctctgagtgccaccctcactattcttttagccgtctggacaataaactttcaaagtctgtctcctccgggtacaacttcagatttgccagatattaccgagacgcagccggggtggagttccgcaccctgatgaaagcctacgggatccgctttgacgtgatggtgaacggcaagggtgctttcttctgcgacctggtactcatctacctcatcaaaaagagagagttttaccgtgacaagaagtacgaggaagtgaggggcctagaagacagttcccaggaggccgaggacgaggcatcggggctggggctatctgagcagctcacatctgggccagggctgctggggatgccggagcagcaggagctgcaggagccacccgaggcgaagcgtggaagcagcagtcagaaggggaacggatctgtgtgcccacagctcctggagccccacaggagcacgtgaattgcctctgcttacgttcaggccctgtcctaaacccagccgtctagcacccagtgatcccatgcctttgggaatcccaggatgctgcccaacgggaaatttgtacattgggtgctatcaatgccacatcacagggaccagccatcacagagcaaagtgacctccacgtctgatgctggggtcatcaggacggacccatcatggctgtctttttgccccaccccctgccgtcagttcttcctttctccgtggctggcttcccgcactagggaacgggttgtaaatggggaacatgacttccttccggagtccttgagcacctcagctaaggaccgcagtgccctgtagagttcctagattacctcactgggaatagcattgtgcgtgtccggaaaagggctccatttggttccagcccactcccctctgcaagtgccacagcttccctcagagcatactctccagtggatccaagtactctctctcctaaagacaccaccttcctgccagctgtttgcccttaggccagtacacagaattaaagtgggggagatggcagacgctttctgggacctgcccaagatatgtattctctgacactcttatttggtcataaaacaataaatggtgtcaatttcaaaaaaaaaaaaaaaaaaaaaaaaaaaaaaaaaaa

SEQ ID NO: 787 - DNA, 4403 bp, Homo sapiens
  ref <308>: DATABASE ACCESSION NUMBER: NM_002570
  ref <309>: DATABASE ENTRY DATE: 2001-06-18
cgggaacgcgccgcggccgcctcctcctccccggctcccgcccgcggcggtgttggcggcggcggtggcggcggcggcggcgcttccccggcgcggagcggctttaaaaggcggcactccaccccccggcgcactcgcagctcgggcgccgcgcgagcctgtcgccgctatgcctccgcgcgcgccgcctgcgcccgggccccggccgccgccccgggccgccgccgccaccgacaccgccgcgggcgcggggggcgcggggggcgcggggggcgccggcgggcccgggttccggccgctcgcgccgcgtccctggcgctggctgctgctgctggcgctgcctgccgcctgctccgcgcccccgccgcgccccgtctacaccaaccactgggcggtgcaagtgctgggcggcccggccgaggcggaccgcgtggcggcggcgcacggctacctcaacttgggccagattggaaacctggaagattactaccatttttatcacagcaaaacctttaaaagatcaaccttgagtagcagaggccctcacaccttcctcagaatggacccccaggtgaaatggctccagcaacaggaagtgaaacgaagggtgaagagacaggtgcgaagtgacccgcaggccctttacttcaacgaccccatttggtccaacatgtggtacctgcattgtggcgacaagaacagtcgctgccggtcggaaatgaatgtccaggcagcgtggaagaggggctacacaggaaaaaacgtggtggtcaccatccttgatgatggcatagagagaaatcaccctgacctggccccaaattatgattcctacgccagctacgacgtgaacggcaatgattatgacccatctccacgatatgatgccagcaatgaaaataaacacggcactcgttgtgcgggagaagttgctgcttcagcaaacaattcctactgcatcgtgggcatagcgtacaatgccaaaataggaggcatccgcatgctggacggcgatgtcacagatgtggtcgaggcaaagtcgctgggcatcagacccaactacatcgacatttacagtgccagctgggggccggacgacgacggcaagacggtggacgggcccggccgactggctaagcaggctttcgagtatggcattaaaaagggccggcagggcctgggctccattttcgtctgggcatctgggaatggcgggagagagggggactactgctcgtgcgatggctacaccaacagcatctacaccatctccgtcagcagcgccaccgagaatggctacaagccctggtacctggaagagtgtgcctccaccctggccaccacctacagcagtggggccttttatgagcgaaaaatcgtcaccacggatctgcgtcagcgctgtaccgatggccacactgggacctcagtctctgcccccatggtggcgggcatcatcgccttggctctagaagcaaacagccagttaacctggagggacgtccagcacctgctagtgaagacatcccggccggcccacctgaaagcgagcgactggaaagtaaacggcgcgggtcataaagttagccatttctatggatttggtttggtggacgcagaagctctcgttgtggaggcaaagaagtggacagcagtgccatcgcagcacatgtgtgtggccgcctcggacaagagacccaggagcatccccttagtgcaggtgctgcggactacggccctgaccagcgcctgcgcggagcactcggaccagcgggtggtctacttggagcacgtggtggttcgcacctccatctcacacccacgccgaggagacctccagatctacctggtttctccctcgggaaccaagtctcaacttttggcaaagaggttgctggatctttccaatgaagggtttacaaactgggaattcatgactgtccactgctggggagaaaaggctgaagggcagtggaccttggaaatccaagatctgccatcccaggtccgcaacccggagaagcaagggaagttgaaagaatggagcctcatactgtatggcacagcagagcacccgtaccacaccttcagtgcccatcagtcccgctcgcggatgctggagctctcagccccagagctggagccacccaaggctgccctgtcaccctcccaggtggaagttcctgaagatgaggaagattacacagctcaatccaccccaggctctgctaatattttacagaccagtgtgtgccatccggagtgtggtgacaaaggctgtgatggccccaatgcagaccagtgcttgaactgcgtccacttcagcctggggagtgtcaagaccagcaggaagtgcgtgagtgtgtgccccttgggctactttggggacacagcagcaagacgctgtcgccggtgccacaaggggtgtgagacctgctccagcagagctgcgacgcagtgcctgtcttgccgccgcgggttctatcaccaccaggagatgaacacctgtgtgaccctctgtcctgcaggattttatgctgatgaaagtcagaaaaattgccttaaatgccacccaagctgtaaaaagtgcgtggatgaacctgagaaatgtactgtctgtaaagaaggattcagccttgcacggggcagctgcattcctgactgtgagccaggcacctactttgactcagagctgatcagatgtggggaatgccatcacacctgcggaacctgcgtggggccaggcagagaagagtgcattcactgtgcgaaaaacttccacttccacgactggaagtgtgtgccagcctgtggtgagggcttctacccagaagagatgccgggcttgccccacaaagtgtgtcgaaggtgtgacgagaactgcttgagctgtgcaggctccagcaggaactgtagcaggtgtaagacgggcttcacacagctggggacctcctgcatcaccaaccacacgtgcagcaacgctgacgagacattctgcgagatggtgaagtccaaccggctgtgcgaacggaagctcttcattcagttctgctgccgcacgtgcctcctggccgggtaagggtgcctagctgcccacagagggcaggcactcccatccatccatccgtccaccttcctccagactgtcggccagagtctgtttcaggagcggcgccctgcacctgacagctttatctccccaggagcagcatctctgagcacccaagccaggtgggtggtggctcttaaggaggtgttcctaaaatggtgatatcctctcaaatgctgcttgttggctccagtcttccgacaaactaacaggaacaaaatgaattctgggaatccacagctctggctttggagcagcttctgggaccataagtttactgaatcttcaagaccaaagcagaaaagaaaggcgcttggcatcacacatcactcttctccccgtgcttttctgcggctgtgtagtaaatctccccggcccagctggcgaaccctgggccatcctcacatgtgacaaagggccagcagtctacctgctcgttgcctgccactgagcagtctggggacggtttggtcagactataaataagataggtttgagggcataaaatgtatgaccactggggccggagtatctatttctacatagtcagctacttctgaaactgcagcagtggcttagaaagtccaattccaaagccagaccagaagattctatcccccgcagcgctctcctttgagcaagccgagctctccttgttaccgtgttctgtctgtgtcttcaggagtctcatggcctgaacgaccacctcgacctgatgcagagccttctgaggagaggcaacaggaggcattctgtggccagccaaaaggtaccccgatggccaagcaattcctctgaacaaaatgtaaagccagccatgcattgttaatcatccatcacttcccattttatggaattgcttttaaaatacatttggcctctgcccttcagaagactcgtttttaaggtggaaactcctgtgtctgtgtatattacaagcctacatgacacagttggatttattctgccaaacctgtgtaggcattttataagctacatgttctaatttttaccgatgttaattattttgacaaatatttcatatattttcattgaaatgcacagatctgcttgatcaattcccttgaatagggaagtaacatttgccttaaattttttcgacctcgtctttctccatattgtcctgctcccctgtttgacgacagtgcatttgccttgtcacctgtgagctggagagaacccagatgttgtttattgaatctacaactctgaaagagaaatcaatgaagcaagtacaatgttaaccctaaattaataaaagagttaacatccc

SEQ ID NO: 788 - DNA, 2823 bp, Homo sapiens
  ref <308>: DATABASE ACCESSION NUMBER: NM_002579
  ref <309>: DATABASE ENTRY DATE: 2001-06-18
cccccgcgccgcgcagccccggccgccaggccttagcccgccccggcccccgccaggccgcgtccccctcccctcccctcccccgcgcgccacccgcgcccgcccccgcccggcaccgcggacccacccggacctcggcggggagatggaggtcctggcggcagagaccacgtcccagcaggagcggctgcaggccatcgcagagaagcggaagcggcaggcggagatcgagaacaagcgccggcagctggaggacgagcggaggcagctgcagcacctgaagtccaaggcactgcgggagcgctggctgctggaggggacgccgtcctcggcctcagagggggatgaggacctgaggaggcagatgcaggacgacgagcagaagacacggctgctggaggactcggtgtccaggttggagaaggaaattgaggtgctggagcgtggagactccgccccagccgctgccaaggagaacgcggcggccccgagcccagtccgggccccagccccgagtccagccaaggaggagcgcaagacagaggtggtgatgaattcacagcagacgccggtgggcacgcccaaagacaagcgagtctccaacacgcccctgaggacggttgacggctcccccatgatgaaggcagccatgtactcggttgagatcactgtggagaaggacaaggtgacaggggagaccagggtgctgtccagcaccacgctgctccctcggcagccgctccctctgggcatcaaagtctacgaggacgagaccaaagtggtccatgctgtggacggcaccgccgagaacgggatccaccccctgagctcctccgaggtggacgaactcatccacaaagcggacgaggtcacgctgagcgaggcagggtccacggccggggcggcagagacccggggggctgtggagggggcagcccggaccacgccctcccggcgggagatcaccggtgtgcaggcacagccaggcgaggccacgtccggcccgccggggatccagcccggccaggagcccccggtcacaatgatcttcatgggttaccagaacgtggaggatgaggccgagaccaagaaggtgctgggccttcaagataccatcacggcggagctggtggtcatcgaagacgcggctgagcccaaggagcctgcaccacccaacggcagtgctgccgagcctcccacggaggccgcctccagggaagagaatcaggcggggcccgaggccaccaccagcgacccccaggacctcgacatgaagaagcaccgttgtaaatgctgctccatcatgtgagccggcccccgagaccccggcccccaccccacaccacagacacccaccagcccggcccctcccggcgcctgcccaccctccacccacagcctcacgggtccaggacttggcgtgttgttacatgttccttccgagttttctttcgctggaaagagggacaggggcccccacccgtcaccacgccccaacactccccccgaaccagagccgtgcacttgtgcctggtaggagagagacaggacagacccgcttttcccgagacaaggaccccccatgtcacggcagcttcacagacgcggtcgcgcccaccggggtcctggcgggtgggacccgcagcctccacgcggcccaggccagcctgccaccctctgggcctcctacctgtgcctttctctgaggggacaccccgccagagagggccccgggagccgggggtgggtactgaggcctgctcaggccctggaagtgaggctctatggggttccctggccaaggcgctggccccccaatctcaggcagttggggtgaggccgtgcctctttgggggctaaaggtcttgggtggaggacaggcccctctgctgtgcccctatgccctgtgtgggcccaaccagtggacaatggagtctgggggagggggaaccccggggacatgcccccacccgggaggggccggtaacccctgggctatcttctagacggggcgaaccaggggtcattgacctgccccctgcacagggcagggaccgagtgagccactccttgtcccgagctcccgcccccactgggccctccttcctcctggtgctaatttggggaccccaggggccgcccccggcctcttctccatcctgcttggaccagggtcctgggtcttcccaaccataccccgagatcaggccccacctgccagctctactgggcttggagcacgtccgggcagtggagggagggacacagcctgggacaggaagcctcttgggttggagcaggagaccctcatttgccacccagaccaatgtgagcctgcccccaagccccctctcattggaagtggcaaggggcttccctcctgggggcagctacactcgtccccagaggcacattcgtgcacattctcacagacaccgtctcacacgttggctttggacaaccaggccccaacttggtccctgccctagggacctccagcctggtgcccagtgctcaggccacctcctggtccagtcaccacctgcagcctcggcagggcaggtacaggggccacctcggatgggagcctgggtccctgcctccgctctgcccctgggtggctgggaggagaggccctctcgggggtgacctgggcgtcagccgtggaaccccctcctcctccctggagtctgcctgagtccctcgagccgcgagccttcgctgaagtgcccttgctataaccccctctgcttctggtgtgtgacgaggcccccgatgttcttgattttcccagagaagcaaataaacagcgtgaacagcccc

SEQ ID NO: 789 - DNA, 4069 bp, Homo sapiens
  ref <308>: DATABASE ACCESSION NUMBER: NM_002587
  ref <309>: DATABASE ENTRY DATE: 2001-06-18
ctctattcgacattctctttggattgttttgctataacttgaaatttgggatgtcacaaacgaaactgtcatctgtttccgccaaactgtggttctgctaatctcccaggctggcagcattggagacttgctgacttctttcatcccccactcttttcacctgaaattcctttccttggttttgctctaagtcctatgcttcagtcaggggccaaccaaatctcactgcctcctttttatcatgaagcctttgatcactgatagttctttttatatcttgaaaaatcacccttcccagtacagttaatatttagtatctctactcatcttggcacttactcacagctccataattcagtgtttctcgtacctcttcatggtgatggggagccctttggaggtggtgactgtgctttatactcctcatgatgcttcacatgtggcaggcgtggagtgcccggaggcggccctcctgattctggggcctcccaggatggagcccctgaggcacagcccaggccctggggggcaacggctactgctgccctccatgctgctagcactgctgctcctgctggctccatccccaggccacgccactcgggtagtgtacaaggtgccggaggaacagccacccaacaccctcattgggagcctcgcagccgactatggttttccagatgtggggcacctgtacaagctagaggtgggtgccccgtaccttcgcgtggatggcaagacaggtgacattttcaccaccgagacctccatcgaccgtgaggggctccgtgaatgccagaaccagctccctggtgatccctgcatcctggagtttgaggtatctatcacagacctcgtgcagaatgcgagcccccggctgctagagggccagatagaagtacaagacatcaatgacaacacacccaacttcgcctcaccagtcatcactctggccatccctgagaacaccaacatcggctcactcttccccatcccgctggcttcagaccgtgatgctggtcccaacggtgtggcatcctatgagctgcaggtggcagaggaccaggaggagaagcaaccacagctcattgtgatgggcaacctggaccgtgagcgctgggactcctatgacctcaccatcaaggtgcaggatggcggcagccccccacgcgccacgagtgccctgctgcgtgtcaccgtgcttgacaccaatgacaacgcccccaagtttgagcggccctcctatgaggccgaactatctgagaatagccccataggccactcggtcatccaggtgaaggccaatgactcagaccaaggtgccaatgcagaaatcgaatacacattccaccaggcgcccgaagttgtgaggcgtcttcttcgactggacaggaacactggacttatcactgttcagggcccggtggaccgtgaggacctaagcaccctgcgcttctcagtgcttgctaaggaccgaggcaccaaccccaagagtgcccgtgcccaggtggttgtgaccgtgaaggacatgaatgacaatgcccccaccattgagatccggggcatagggctagtgactcatcaagatgggatggctaacatctcagaggatgtggcagaggagacagctgtggccctggtgcaggtgtctgaccgagatgagggagagaatgcagctgtcacctgtgtggtggcaggtgatgtgcccttccagctgcgccaggccagtgagacaggcagtgacagcaagaagaagtatttcctgcagactaccaccccgctagactacgagaaggtcaaagactacaccattgagattgtggctgtggactctggcaaccccccactctccagcactaactccctcaaggtgcaggtggtggacgtcaatgacaacgcacctgtcttcactcagagtgtcactgaggtcgccttcccggaaaacaacaagcctggtgaagtgattgctgagatcactgccagtgatgctgactctggctctaatgctgagctggtttactctctggagcctgagccggctgctaagggcctcttcaccatctcacccgagactggagagatccaggtgaagacatctctggatcgggaacagcgggagagctatgagttgaaggtggtggcagctgaccggggcagtcctagcctccagggcacagccactgtccttgtcaatgtgctggactgcaatgacaatgaccccaaatttatgctgagtggctacaacttctcagtgatggagaacatgccagcactgagtccagtgggcatggtgactgtcattgatggagacaagggggagaatgcccaggtgcagctctcagtggagcaggacaacggtgactttgttatccagaatggcacaggcaccatcctatccagcctgagctttgatcgagagcaacaaagcacctacaccttccagctgaaggcagtggatggtggcgtcccacctcgctcagcttacgttggtgtcaccatcaatgtgctggacgagaatgacaacgcaccctatatcactgccccttctaacacctctcacaagctgctgaccccccagacacgtcttggtgagacggtcagccaggtggcagccgaggactttgactctggtgtcaatgccgagctgatctacagcattgcaggtggcaacccttatggactcttccagattgggtcacattcaggtgccatcaccctggagaaggagattgagcggcgccaccatgggctacaccgcctggtggtgaaggtcagtgaccgcggcaagcccccacgctatggcacagccttggtccatctttatgtcaatgagactctggccaaccgcacgctgctggagaccctcctgggccacagcctggacacgccgctggatattgacattgctggggatccagaatatgagcgctccaagcagcgtggcaacattctctttggtgtggtggctggtgtggtggccgtggccttgctcatcgccctggcggttcttgtgcgctactgcagacagcgggaggccaaaagtggttaccaggctggtaagaaggagaccaaggacctgtatgcccccaagcccagtggcaaggcctccaagggaaacaaaagcaaaggcaagaagagcaagtccccaaagcccgtgaagccagtggaggacgaggatgaggccgggctgcagaagtccctcaagttcaacctgatgagcgatgcccctggggacagtccccgcatccacctgcccctcaactacccaccaggcagccctgacctgggccgccactatcgctctaactccccactgccttccatccagctgcagccccagtcaccctcagcctccaagaagcaccaggtggtacaggacctgccacctgcaaacacattcgtgggcaccggggacaccacgtccacgggctctgagcagtactccgactacagctaccgcaccaacccccccaaataccccagcaagcaggtaggccagccctttcagctcagcacaccccagcccctaccccacccctaccacggagccatctggaccgaggtgtgggagtgatggagcaggtttactgtgcctgcccgtgttgggggccagcctgagccagcagtgggaggtggggccttagtgcctcaccgggcacacggattaggctgagtgaagattaagggagggtgtgctctgtggtctcctccctgccctctccccactggggagagacctgtgatttgccaagtccctggaccctggaccagctactgggccttatgggttgggggtggtaggcaggtgagcgtaagtggggagggaaatgggtaagaagtctactccaaacctaggtctctatgtcagaccagacctaggtgcttctctaggagggaaacagggagacctggggtcctgtggataactgagtggggagtctgccaggggagggcaccttcccattgtgccttctgtgtgtattgtgcattaacctcttcctcaccactaggcttctggggctgggtcccacatgcccttgaccctgacaataaagttctctatttttgg

SEQ ID NO: 790 - DNA, 4076 bp, Homo sapiens
  ref <308>: DATABASE ACCESSION NUMBER: NM_002590
  ref <309>: DATABASE ENTRY DATE: 2001-06-18
gcttctgtaagagacggagaggcgcagagtgagggcgggtccgcgcgtcctcagagcccgctggaggctcggagctgctacccgcagacttctcccgcacagggctcgcaaagagcgtgattccgagagcctgagactgacgcccgacctggaaaccagagaagacttccttagcctttcggatcgcacttgaggctggaggcatgagtcctgtgaggcgttggggcagcccctgccttttccccttgcagctcttcagcctctgctgggtgctctcagtggcccagagcaaaacagtccgatacagcaccttcgaggaggatgcccccggcacggtcatcgggaccctggccgaggacctgcatatgaaagtatcgggtgacacaagcttccgcctgatgaagcaattcaacagctctctgctccgggtgcgcgaaggcgacgggcagctgaccgtcggggacgccggcctggaccgcgagcggctgtgtggccaggccccgcagtgcgtgctggccttcgatgtggtcagcttctcgcaggagcagttccggctggtgcacgtggaggtagaggtgagggacgtcaacgaccacgcgccgcgcttccccagggcccagatcccggtagaggtgtccgagggtgcggcagtgggcacgcgcatccccttggaggtgccggtggacgaggacgtgggcgccaacgggctgcagaccgtgcgcctggccgagccgcacagcccctttcgcgtggagctgcagacgcgagcggacggcgctcagtgcgcagacctggtgctgctgcaggagctggaccgcgagagccaggccgcctacagcctggagctggtggcccaggacggcggccgcccgccgcgctccgccacggctgccctcagcgtgcgcgtcctggatgcgaatgaccacagcccggccttcccgcagggcgccgtggccgaagtggagctggcggaagacgcgcccgtgggctccctgcttctcgacctggacgcagccgaccccgacgagggacctaacggcgacgtggtgttcgcatttggcgcccgcaccccgccggaggcgcgccgcctctttcggcttgacccgcgatcaggccgcctcaccctggccgggcccgtggactacgagcgtcaggacacctacgagctggacgtgcgggcgcaggaccgcggacccgggccccgcgctgccacctgcaaggtcatcgtgcgcatccgagacgtcaatgacaacgcacccgacatcgccatcaccccgctggccgccccaggcgcgccggcaacctcacccttcgccgctgccgccgccgccgctgcactcgggggagcggacgctagctcgccggcgggagccgggacgccggaggctggtgccacttcgctggtgccggagggggcggcgcgcgagagcctggtggccctggtcagcacctcggacagggactcgggcgccaacgggcaagtgcgctgcgccctctatgggcacgagcacttccggctgcagccggcctacgcgggcagctacctggtggtgaccgcggcgtcgctggaccgcgaacgcatcgccgagtacaacttgacgctggtggccgaggatcgcggcgcgcccccgctgcgcacagtgcggccctacacggtgcgtgtgggcgacgagaacgacaacgcgccgctcttcacgcggccggtctatgaggtgtcggtgcgcgagaacaacccgccaggcgcctacctggccacggtggccgcccgcgaccgggacctgggccgcaacggccaggtcacctaccggctgctggaggccgaggtgggccgcgccgggggcgccgtgtccacttatgtctcggtggacccagctaccggagccatctacgcgctgcgcagcttcgactatgagacgctgcgccaactcgacgttcgcatccaagctagcgacggcggctcccctcagctttccagcagcgccctagtgcaagtgcgcgtgctggaccagaacgaccatgcgccagtcctggtgcacccggcgccagccaatggctccctagaagtggcggtgcctgggcgcaccgcaaaggacacggttgtggcccgtgtgcaggcccgggatgcagacgagggagccaacggggagctggcgttcgagctgcagcagcaggagccgcgcgaagccttcgccatcggccgccgcacgggggagatactgctcaccggcgacctctcgcaggagccacccggtcgcgtgttcagggcgctcctggtcatatccgacggcggccgtcccccgctcaccaccaccgcaactgtcagcttcgtggtaacagcagggggcgggcgtgggccggctgcgcctgccagtgcaggaagcccggagcgttcccgcccgcctggctctcggctcggggtgtccgggtcggtgctgcaatgggacacgccgctgatcgtcatcatcgtgctggccgggagctgcacgctgctgctggccgccatcatcgccatcgccaccacctgcaaccgccgcaagaaggaggtgcgcaaagggggggccctccgggaagagcggcccggggcggcgggcggcggagcctcggctcccggctccccggaggaggccgcccggggagccgggcccaggcccaacatgttcgacgtgctcaccttccctggcaccggcaaagcgccctttggcagccccgcggcggacgcgcctccgcctgcggtcgccgcggccgaagtgccgggctcagagggcggcagcgccactggggaaagcgcctgtcacttcgaggggcagcagcggctccgcggcgcgcacgccgagccctacggtgcctccccgggttttggaaaggagccggcgccccctgtggcggtgtggaaaggacactccttcaacaccatttctggcagagaagcagagaagttcagcggcaaagacagcggtaaaggggacagtgatttcaacgacagcgattccgacatcagcggggacgctctgaaaaaggatctcatcaaccacatgcagagtggactgtgggcgtgcaccgctgagtgtaagatcctgggccactctgaccgctgctggagcccatcctgcagcgggcccaacgcacatccatcgcctcacccaccagcccagatgtcaaccttctgtaagagcacgtcactgcctcgggatcctctgcgcagggacaattactaccaggcccagctgcccaagacagtggggctgcagagcgtctatgagaaagtactgcacagagactatgacaggacagtcactctgctctcccctccccgtccagggaggctcccagacctgcaggagattggagtacccctctaccagtcccctcctggcaggtacctgtccccgaagaagggagccaatgaaaatgtgtaatcccatgctgcatgtcttcacacatatacaggtcactccgagaagcccctaagttattgaccggtttcagtgttgtatatataaatatgcaagatgtgccttacaatgaagttgttggaagctatttccaatcacattggtactgtttggtatttgcaaacaaaaatgtagttaatgtaatttttatgaaatgtgtgcagtatttaatttttcttatgctattgactttgatttcaattgcggcttgccattttcttagtgtttttaacctgtacattgtgtaatgtaatgtttgtatataatgaaattttgttatatttttatataataaaagctaaagtggaagttattgccaaaggaactgtctgtaagacaaaaaacaaaacatgttggaattacttaattgaaatttatctttcacctgaaacaacctagtgtttgagaaattttgccttgccaagtataacttgtatatcttgactctgtggtagatttcaagttcaatgttatttaattacatttggttttccgtaaaccgtgtcacttataagcacagtaataaaagatttgtcatgtgtttgaagaaaaaaaaaaaaaaaaaaaaaaaaaaaaaaaaaaaaaaaaaaaaaaaaaaaaaaaaaaaaaaaaaaaaaaaaaaaa

SEQ ID NO: 791 - DNA, 4068 bp, Homo sapiens
  ref <308>: DATABASE ACCESSION NUMBER: NM_002600
  ref <309>: DATABASE ENTRY DATE: 2001-06-18
gaattcctcctctcttcaccccgttagctgttttcaatgtaatgctgccgtccttctcttgcactgccttctgcgctaacacctccattcctgtttataaccgtgtatttattacttaatgtatataatgtaatgttttgtaagttattaatttatatatctaacattgcctgccaatggtggtgttaaatttgtgtagaaaactctgcctaagagttacgactttttcttgtaatgttttgtattgtgtattatataacccaaacgtcacttagtagagacatatggcccccttggcagagaggacaggggtgggcttttgttcaaagggtctgccctttccctgcctgagttgctacttctgcacaacccctttatgaaccagttttcacccgaattttgactgtttcatttagaagaaaagcaaaatgagaaaaagctttcctcatttctccttgagatggcaaagcactcagaaatgacatcacataccctaaagaaccctgggatgactaaggcagagagagtctgagaaaactctttggtgcttctgcctttagttttaggacacatttatgcagatgagcttataagagaccgttccctccgccttcttcctcagaggaagtttcttggtagatcaccgacacctcatccaggcggggggttggggggaaacttggcaccagccatcccaggcagagcaccactgtgatttgttctcctggtggagagagctggaaggaaggagccagcgtgcaaataatgaaggagcacgggggcaccttcagtagcaccggaatcagcggtggtagcggtgactctgctatggacagcctgcagccgctccagcctaactacatgcctgtgtgtttgtttgcagaagaatcttatcaaaaattagcaatggaaacgctggaggaattagactggtgtttagaccagctagagaccatacagacctaccggtctgtcagtgagatggcttctaacaagttcaaaagaatgctgaaccgggagctgacacacctctcagagatgagccgatcagggaaccaggtgtctgaatacatttcaaatactttcttagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggctggatattctcacaatagacccctaacatgcatcatgtatgctatattccaggaaagagacctcctaaagacattcagaatctcatctgacacatttataacctacatgatgactttagaagaccattaccattctgacgtggcatatcacaacagcctgcacgctgctgatgtagcccagtcgacccatgttctcctttctacaccagcattagacgctgtcttcacagatttggagatcctggctgccatttttgcagctgccatccatgacgttgatcatcctggagtctccaatcagtttctcatcaacacaaattcagaacttgctttgatgtataatgatgaatctgtgttggaaaatcatcaccttgctgtgggtttcaaactgctgcaagaagaacactgtgacatcttcatgaatctcaccaagaagcagcgtcagacactcaggaagatggttattgacatggtgttagcaactgatatgtctaaacatatgagcctgctggcagacctgaagacaatggtagaaacgaagaaagttacaagttcaggcgttcttctcctagacaactataccgatcgcattcaggtccttcgcaacatggtacactgtgcagacctgagcaaccccaccaagtccttggaattgtatcggcaatggacagaccgcatcatggaggaatttttccagcagggagacaaagagcgggagaggggaatggaaattagcccaatgtgtgataaacacacagcttctgtggaaaaatcccaggttggtttcatcgactacattgtccatccattgtgggagacatgggcagatttggtacagcctgatgctcaggacattctcgataccttagaagataacaggaactggtatcagagcatgatacctcaaagtccctcaccaccactggacgagcagaacagggactgccagggtctgatggagaagtttcagtttgaactgactctcgatgaggaagattctgaaggacctgagaaggagggagagggacacagctatttcagcagcacaaagacgctttgtgtgattgatccagaaaacagagattccctgggagagactgacatagacattgcaacagaagacaagtcccccgtggatacataatccccctctccctgtggagatgaacattctatccttgatgagcatgccagctatgtggtagggccagcccaccatgggggccaagacctgcacaggacaagggccacctggcctttcagttacttgagtttggagtcagaaagcaagaccaggaagcaaatagcagctcaggaaatcccacggttgacttgccttgatggcaagcttggtggagagggctgaagctgttgctgggggccgattctgatcaagacacatggcttgaaaatggaagacacaaaactgagagatcattctgcactaagtttcgggaacttatccccgacagtgactgaactcactgactaataacttcatttatgaatcttctcacttgtccctttgtctgccaacctgtgtgccttttttgtaaaacattttcatgtctttaaaatgcctgttgaatacctggagtttagtatcaacttctacacagataagctttcaaagttgacaaacttttttgactctttctggaaaagggaaagaaaatagtcttccttctttcttgggcaatatccttcactttactacagttacttttgcaaacagacagaaaggatacacttctaaccacattttacttccttcccctgttgtccagtccaactccacagtcactcttaaaacttctctctgtttgcctgcctccaacagtacttttaactttttgctgtaaacagaataaaattgaacaaattagggggtagaaaggagcagtggtgtcgttcaccgtgagagtctgcatagaactcagcagtgtgccctgctgtgtcttggaccctgccccccacaggagttgctacagtccctggccctgcttcccatcctcctctcttcaccccgttagctgttttcaatgtaatgctgccgtccttctcttgcactgccttctgcgctaacacctccattcctgtttataaccgtgtatttattacttaatgtatataatgtaatgttttgtaagttattaatttatatatctaacattgcctgccaatggtggtgttaaatttgtgtagaaaactctgcctaagagttacgactttttcttgtaatgttttgtattgtgtattatataacccaaacgtcacttagtagagacatatggcccccttggcagagaggacaggggtgggcttttgttcaaagggtctgccctttccctgcctgagttgctacttctgcacaacccctttatgaaccagttttggaaacaatattctcacattagatactaaatggtttatactgagtcttttacttttgtatagcttgataggggcaggggcaatgggatgtagtttttacccaggttctatccaaatctatgtgggcatgagttgggttataactggatcctactatcattgtggctttggttcaaaaggaaacactacatttgctcacagatgattcttctgattcttctgaatgctcccgaactactgactttgaagaggtagcctcctgcctgccattaagcaggaatgtcatgttccagttcattacaaaagaaaacaataaaacaatgtgaatttttataataaaaaaaaaaaaaaggaattc

SEQ ID NO: 792 - DNA, 2040 bp, Homo sapiens
  ref <308>: DATABASE ACCESSION NUMBER: NM_002614
  ref <309>: DATABASE ENTRY DATE: 2001-06-18
gaattccgggcagctcctcttccatctccagaaatgacctccaccttcaacccccgagaatgtaaactgtccaagcaagaagggcaaaactatggcttcttcctgcgaattgagaaggacaccgagggccacctggtccgggtggttgagaagtgtagcccagcagagaaggctggccttcaagatggagacagagttcttaggatcaatggtgtctttgtggacaaagaagaacatatgcaggttgtggatctggtcagaaagagtgggaattcagtgactttactagttctggatggggattcctatgagaaagcagtgaaaacacgggtggacttgaaagagttgggtcaaagtcagaaggagcaaggtttgagtgataatatactttcccctgtgatgaatggaggtgtgcaaacttggacccagccccggctctgctatctcgtgaaggaaggaggcagctatggcttctctctgaaaactgtccaaggtaaaaagggggtgtacatgactgatattacacctcaaggtgtggctatgagagctggagttctggctgatgatcacttgattgaagtgaatggagagaatgtagaggatgccagccatgagaaagtggttgaaaaggtgaagaagtcaggaagccgtgtcatgttcctgctggtggacaaagaaactgacaagcgtcatgttgagcagaagatacaattcaaaagagaaacagccagtttgaaactgttaccccaccagccccgaattgtggagatgaagaaaggaagcaatggctatggtttctatctgagggcaggctcagaacagaaaggtcaaatcatcaaggacatagattctggaagtccagcagaggaggctggcttgaagaacaatgatctggtagttgctgtcaacggcgagtctgtggaaaccctggatcatgacagtgtggtagaaatgattagaaagggtggagatcagacttcactgttggtggtagacaaagagacggacaacatgtacagactggctcatttttctccatttctctactatcaaagtcaagaactgcccaatggctctgtcaaggaggctccagctcctactcccacttctctggaagtctcaagtccaccagatactacagaggaagtagatcataagcctaaactctgcaggctggctaaaggtgaaaatggctatggctttcacttaaatgcgattcggggtctgccaggctcattcatcaaagaggtacagaagggcggtcctgctgacttggctgggctagaggatgaggatgtcatcattgaagtgaatggggtgaatgtgctagatgaaccctatgagaaggtggtggatagaatccagagcagtgggaagaatgtcacacttctagtctgtggaaagaaggcctatgattatttccaagctaagaaaatccctattgtttcctccctggctgatccacttgacacccctccagattctaaagaaggaatagtggtggagtcaaaccatgactcgcacatggcaaaagaacgggcccacagtacagcctcacattcttcttccaattctgaagatacagagatgtgatgaaaacaagtaatagctttggctgtttatttgatagctgtttctgggtatttaataggaatcctttctcaaggaatgagttgtgacctgtttactgtctctttagaagaaaaactccactggaaaccattcaccatgtgtgactgtcttctgttatcatttgtcttacaggcggctattgcagacggctaatttatgcttaacttaggaagagataaggcaagagctagatttttttcatgtgatcttttccaagcttcaacttaacttaactacatttctctgtatgatgatgtctcttacttctacaggttccttgagcaccaaagatgattcataactctgtataggtgacagctgcttataaaagcatcttagcagataagcctattaaaattgtgcttttgtaacaatgttgtggttgctagaataaataccatgaacccg

SEQ ID NO: 793 - DNA, 1199 bp, Homo sapiens
  ref <308>: DATABASE ACCESSION NUMBER: NM_002615
  ref <309>: DATABASE ENTRY DATE: 2001-06-18
ccaacttcggctatgacctgtaccgggtgcgatccagcatgagccccacgaccaacgtgctcctgtctcctctcagtgtggccacggccctctcggccctctcgctgggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccaactgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttacgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccct

SEQ ID NO: 794 - DNA, 1404 bp, Homo sapiens
  ref <308>: DATABASE ACCESSION NUMBER: NM_002618
  ref <309>: DATABASE ENTRY DATE: 2001-06-18
tcaggggtaggagcgggagccgagaggaggcggaggagatggcgtcccagccgccacctccccccaaaccctgggagacccgccgaattccgggagccggaccgggaccaggaccgggccccactttccaatctgctgatttgggtcctactttaatgacaagacctggacaaccagcacttaccagagtgcccccacctattcttccaaggccatcacagcagacaggaagtagcagtgtgaacacttttagacctgcttacagttcattttcttctggatatggtgcctatggaaattcattttatggaggctatagtccttatagttatggatataatgggctgggctacaaccgcctccgtgtagatgatcttccacccagtagatttgttcagcaagctgaagaaagcagcaggggtgcatttcagtccattgaaagtattgtgcatgcatttgcctctgtcagtatgatgatggatgctaccttttcagctgtctataacagtttcagggctgtattggatgtagcaaatcacttttcccgattgaaaatacactttacaaaagtgttttcagcttttgcattggttaggactatacggtatctttacagacggctacagcggatgttaggtttaagaagaggctctgagaatgaagacctctgggcagagagtgaaggaactgtggcatgccttggtgctgaggaccgagcagctacctcagcaaaatcttggccaatattcttgttctttgctgttatccttggtggtccttacctcatttggaaactattgtctactcacagtgatgaagtaacagacagcatcaactgggcaagtggtgaggatgaccatgtagttgccagagcagaatatgattttgctgccgtatctgaagaagaaatttctttccgggctggtgatatgctgaacttagctctcaaagaacaacaacccaaagtgcgtggttggcttctggctagccttgatggccaaacaacaggacttatacctgcgaattatgtcaaaattcttggcaaaagaaaaggtaggaaaacggtggaatcaagtaaagtttccaagcagcaacaatcttttaccaacccaacactaactaaaggagccacggttgctgattctttggatgaacaggaagctgcctttgaatctgtttttgttgaaactaataaggttccagttgcacctgattccattgggaaagatggagaaaagcaagatctttgatatctttcatgtttgcctgcagttgaacaatactttagagtactttttaaaattatttctcacaaagaaatgaatgtacaatccaatgaaaacatttgttattggctatttcaggtgttttgctgctagaaattattaaagttacacactagta

SEQ ID NO: 795 - DNA, 2914 bp, Homo sapiens
  ref <308>: DATABASE ACCESSION NUMBER: NM_002626
  ref <309>: DATABASE ENTRY DATE: 2001-06-18
gcgacgcggcgcaggcggcgggagtgcgagctgggcccgtgtttcggccgccgccatggccgcggtggacctggagaagctgcgggcgtcgggcgcgggcaaggccatcggcgtcctgaccagcggcggcgaccggcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctcgaaggcctttaccaccagggaggggcgccgggcagcggcctacaacctggtccagcacggcatcaccaacctgtgcgtcatcggcggggatggcagcctcacaggtgccaacatcttccgcagcgagtggggcagcctgctggaggagctggtggcggaaggtaagatctcagagactacagcctggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcacccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccgagctgcccctccccagcccccacccatgccagcgcacgcgccagggctcagatggggcctgggctgttgtgtctggagcctgcaggcaggtgggggctgcgtccctgctcagcccatcccctgcctctactccctggccacctgccaggcctccctccggctggtgtcttgagaccagcctgccaggcctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgccatcggtctccggaga

SEQ ID NO: 796 - DNA, 2320 bp, Homo sapiens
  ref <308>: DATABASE ACCESSION NUMBER: NM_002633
  ref <309>: DATABASE ENTRY DATE: 2001-06-18
gggccggccgcccctccgccagccaagtccgccgctctgacccccggcagcaagtcgccaccatggtgaagatcgtgacagttaagacccaggcgtaccaggaccagaagccgggcacgagcgggctgcggaagcgggtgaaggtgttccagagcagcgccaactacgcggagaacttcatccagagtatcatctccaccgtggagccggcgcagcggcaggaggccacgctggtggtgggcggggacggccggttctacatgaaggaggccatccagctcatcgctcgcatcgctgccgccaacgggatcggtcgcttggttatcggacagaatggaatcctctccacccctgctgtatcctgcatcattagaaaaatcaaagccattggtgggatcattctgacagccagtcacaacccagggggccccaatggagattttggaatcaaattcaatatttctaatggaggtcctgctccagaagcaataactgataaaattttccaaatcagcaagacaattgaagaatatgcagtttgccctgacctgaaagtagaccttggtgttctgggaaagcagcagtttgacttggaaaataagttcaaacccttcacagtggaaattgtggattcggtagaagcttatgctacaatgctgagaagcatctttgatttcagtgcactgaaagaactactttctgggccaaaccgactgaagatctgtattgatgctatgcatggagttgtgggaccgtatgtaaagaagatcctctgtgaagaactcggtgcccctgcgaactcggcagttaactgcgttcctctggaggactttggaggccaccaccctgaccccaacctcacctatgcagctgacctggtggagaccatgaagtcaggagagcatgattttggggctgcctttgatggagatggggatcgaaacatgattctgggcaagcatgggttctttgtgaacccttcagactctgtggctgtcattgctgccaacatcttcagcattccgtatttccagcagactggggtccgcggctttgcacggagcatgcccacgagtggtgctctggaccgggtggctagtgctacaaagattgctttgtatgagaccccaactggctggaagttttttgggaatttgatggacgcgagcaaactgtccctttgtggggaggagagcttcgggaccggttctgaccacatccgtgagaaagatggactgtgggctgtccttgcctggctctccatcctagccacccgcaagcagagtgtggaggacattctcaaagatcattggcaaaagcatggccggaatttcttcaccaggtatgattacgaggaggtggaagctgagggcgcaaacaaaatgatgaaggacttggaggccctgatgtttgatcgctcctttgtggggaagcagttctcagcaaatgacaaagtttacactgtggagaaggccgataactttgaatacagcgacccagtggatggaagcatttcaagaaatcagggcttgcgcctcattttcacagatggttctcgaatcgtcttccgactgagcggcactgggagtgccggggccaccattcggctgtacatcgatagctatgagaaggacgttgccaagattaaccaggacccccaggtcatgttggccccccttatttccattgctctgaaagtgtcccagctgcaggagaggacgggacgcactgcacccactgtcatcacctaagaagacaggcctgatgtggtacgtccctccacccccggacccatccaagtcatctgattgaagagcatgacagaaacaaaatgtattcaccaagcattttaggatttgactttttcactaaccagttgacgagcagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatgtaacccaacaaaatgcaatttctagtgccttctgtccaatcagttctttcctctgagtgagacgtacttggctacagatttctgccttgttttgcgacattgtcccattcacacagatattttgggataataaaggaaaataagctaca

SEQ ID NO: 797 - DNA, 2566 bp, Homo sapiens
  ref <308>: DATABASE ACCESSION NUMBER: NM_002639
  ref <309>: DATABASE ENTRY DATE: 2001-06-18
ggcacgagttgtgctcctcgcttgcctgttccttttccacgcattttccaggataactgtgactccaggcccgcaatggatgccctgcaactagcaaattcggcttttgccgttgatctgttcaaacaactatgtgaaaaggagccactgggcaatgtcctcttctctccaatctgtctctccacctctctgtcacttgctcaagtgggtgctaaaggtgacactgcaaatgaaattggacaggttcttcattttgaaaatgtcaaagatataccctttggatttcaaacagtaacatcggatgtaaacaaacttagttccttttactcactgaaactaatcaagcggctctacgtagacaaatctctgaatctttctacagagttcatcagctctacgaagagaccctatgcaaaggaattggaaactgttgacttcaaagataaattggaagaaacgaaaggtcagatcaacaactcaattaaggatctcacagatggccactttgagaacattttagctgacaacagtgtgaacgaccagaccaaaatccttgtggttaatgctgcctactttgttggcaagtggatgaagaaatttcctgaatcagaaacaaaagaatgtcctttcagactcaacaagacagacaccaaaccagtgcagatgatgaacatggaggccacgttctgtatgggaaacattgacagtatcaattgtaagatcatagagcttccttttcaaaataagcatctcagcatgttcatcctactacccaaggatgtggaggatgagtccacaggcttggagaagattgaaaaacaactcaactcagagtcactgtcacagtggactaatcccagcaccatggccaatgccaaggtcaaactctccattccaaaatttaaggtggaaaagatgattgatcccaaggcttgtctggaaaatctagggctgaaacatatcttcagtgaagacacatctgatttctctggaatgtcagagaccaagggagtggccctatcaaatgttatccacaaagtgtgcttagaaataactgaagatggtggggattccatagaggtgccaggagcacggatcctgcagcacaaggatgaattgaatgctgaccatccctttatttacatcatcaggcacaacaaaactcgaaacatcattttctttggcaaattctgttctccttaagtggcatagcccatgttaagtcctccctgacttttctgtggatgccgatttctgtaaactctgcatccagagattcattttctagatacaataaattgctaatgttgctggatcaggaagccgccagtacttgtcatatgtagccttcacacagatagacctttttttttttccaattctatcttttgtttccttttttcccataagacaatgacatacgcttttaatgaaaaggaatcacgttagaggaaaaatatttattcattatttgtcaaattgtccggggtagttggcagaaatacagtcttccacaaagaaaattcctataaggaagatttggaagctcttcttcccagcactatgctttccttctttgggatagagaatgttccagacattctcgcttccctgaaagactgaagaaagtgtagtgcatgggacccacgaaactgccctggctccagtgaaacttgggcacatgctcaggctactataggtccagaagtccttatgttaagccctggcaggcaggtgtttattaaaattctgaattttggggattttcaaaagataatattttacatacactgtatgttatagaacttcatggatcagatctggggcagcaacctataaatcaacaccttaatatgctgcaacaaaatgtagaatattcagacaaaatggatacataaagactaagtagcccataaggggtcaaaatttgctgccaaatgcgtatgccaccaacttacaaaaacacttcgttcgcagagcttttcagattgtggaatgttggataaggaattatagacctctagtagctgaaatgcaagaccccaagaggaagttcagatcttaatataaattcactttcatttttgatagctgtcccatctggtcatgtggttggcactagactggtggcaggggcttctagctgactcgcacagggattctcacaatagccgatatcagaatttgtgttgaaggaacttgtctcttcatctaatatgatagcgggaaaaggagaggaaactactgcctttagaaaatataagtaaagtgattaaagtgctcacgttaccttgacacatagtttttcagtctatgggtttagttactttagatggcaagcatgtaacttatattaatagtaatttgtaaagttgggtggataagctatccctgttgccggttcatggattacttctctataaaaaatatatatttaccaaaaaattttgtgacattccttctcccatctcttccttgacatgcattgtaaataggttcttcttgttctgagattcaatattgaatttctcctatgctattgacaataaaatattattgaactacc

SEQ ID NO: 798 - DNA, 2623 bp, Homo sapiens
  ref <308>: DATABASE ACCESSION NUMBER: NM_002648
  ref <309>: DATABASE ENTRY DATE: 2001-06-18
gaggaggcccgagaggagtcggtggcagcggcggcggcgggaccggcagcagcagcagcagcagcagcagcaaccactagcctcctgccccgcggcgttgcgacgagccccacgagccgctcaccccgccgttctcagcgctgcccgaccccgctggcgcgcctcccgccgcagtcccggcagcgcctcagttgtcctccgactcgccctcggccttcgcgcagcgcagcacagccgcacgcaccgcagcacagcacagcacagcccaggcatagcttcggcacagccccggctccggctcctgcggcagctcctctggcacgtccctgcgccgacattctggaggttggatgctcttgtccaaaatcaactcgcttgcccacctgcgcgccgcgccctgcaacgacctgcacgccaccaagctggcgcccggcaaggagaaggagcccctggagtcgcagtaccaggtgggcccgctactgggcagcggcggcttcggctcggtctactcaggcatccgcgtctccgacaacttgccggtggccatcaaacacgtggagaaggaccggatttccgactggggagagctgcctaatggcactcgagtgcccatggaagtggtcctgctgaagaaggtgagctcgggtttctccggcgtcattaggctcctggactggttcgagaggcccgacagtttcgtcctgatcctggagaggcccgagccggtgcaagatctcttcgacttcatcacggaaaggggagccctgcaagaggagctggcccgcagcttcttctggcaggtgctggaggccgtgcggcactgccacaactgcggggtgctacaccgcgacatcaaggacgaaaacatccttatcgacctcaatcgcggcgagctcaagctcatcgacttcgggtcgggggcgctgctcaaggacaccgtctacacggacttcgatgggacccgagtgtatagccctccagagtggatccgctaccatcgctaccatggcaggtcggcggcagtctggtccctggggatcctgctgtatgatatggtgtgtggagatattcctttcgagcatgacgaagagatcatcaggggccaggttttcttcaggcagagggtctcttcagaatgtcagcatctcattagatggtgcttggccctgagaccatcagataggccaaccttcgaagaaatccagaaccatccatggatgcaagatgttctcctgccccaggaaactgctgagatccacctccacagcctgtcgccggggcccagcaaatagcagcctttctggcaggtcctcccctctcttgtcagatgcccgagggaggggaagcttctgtctccagcttcccgagtaccagtgacacgtctcgccaagcaggacagtgcttgatacaggaacaacatttacaactcattccagatcccaggcccctggaggctgcctcccaacagtggggaagagtgactctccaggggtcctaggcctcaactcctcccatagatactctcttcttctcataggtgtccagcattgctggactctgaaatatcccgggggtggggggtgggggtgggcagaaccctgccaatggaactctttcttcatcatgagttctgctgaatgccgcgatgggtcaggtaggggggaaacaggttgggatgggataggactagcacattttaagtccctgtcacctcttccgactctttctgagtgccttctgtggggactccggctgtgctgggagaaatacttgaacttgcctcttttacctgctgcttctccaaaaatctgcctgggttttgttccctatttttctctcctgtcctccctcaccccctccttcatatgaaaggtgccatggaagaggctacagggccaaacgctgagccacctgcccttttttctgcctcctttagtaaaactccgagtgaactggtcttcctttttggtttttacttaactgtttcaaagccaagacctcacacacacaaaaaaatgcacaaaccaagcaatcaacagaaaagctgtaaatgtgtgtacagttggcatggtagtatacaaaaagattgtagtggatctaatttttaagaaattttgcctttaagttattttacctgtttttgtttcttgttttgaaagatgcgcattctaacctggaggtcaatgttatgtatttatttatttatttatttggttcccttcctattccaagcttccatagctgctgccctagttttctttcctcctttcctcctctgacttggggaccttttgggggagggctgcgacgcttgctctgtttgtggggtgacgggactcaggcgggacagtgctgcagctccctggcttctgtggggcccctcacctacttacccaggtgggtcccggctctgtgggtgatgggaggggccattgctgactgtgtatataggataattatgaaacacagttctggatggtgtgccttccagatcctctctggggctgtgttttgagcagcaggtagcctgctggttttatctgagtgaaatactgtacaggggaataaaagagatcttattttttttttatacttgcgtttggaataaaaaccctttggcttt

SEQ ID NO: 799 - DNA, 1743 bp, Homo sapiens
  ref <308>: DATABASE ACCESSION NUMBER: NM_002659
  ref <309>: DATABASE ENTRY DATE: 2001-06-18
cagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaaggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccagcctcttggggcctgcggtgcatgcagtgtaagaccaacggggattgccgtgtggaagagtgcgccctgggacaggacctctgcaggaccacgatcgtgcgcttgtgggaagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaagggcgtccaaaggatgaccgccacctccgtggctgtggctaccttcccggctgcccgggctccaatggtttccacaacaacgacaccttccacttcctgaaatgctgcaacaccaccaaatgcaacgagggcccaatcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacgaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggcaatgggagagctcttgttattattaatattgttgccgctgttgtgttgttgttattaattaatattcatattatttattttatacttacataaagattttgtaccagtgg

SEQ ID NO: 800 - DNA, 4242 bp, Homo sapiens
  ref <308>: DATABASE ACCESSION NUMBER: NM_002661
  ref <309>: DATABASE ENTRY DATE: 2001-06-18
gaattcggcgctgagtgacccgagtcgggacgcgggctgcgcgcgcgggaccccggagcccaaacccggggcaggcgggcagctgtgcccgggcggcacggccagcttcctgatttctcccgattccttccttctccctggagcggccgacaatgtccaccacggtcaatgtagattcccttgcggaatatgagaagagccagatcaagagagccctggagctggggacggtgatgactgtgttcagcttccgcaagtccacccccgagcggagaaccgtccaggtgatcatggagacgcggcaggtggcctggagcaagaccgccgacaagatcgagggcttcttggatatcatggaaataaaagaaatccgcccagggaagaactccaaagatttcgagcgagcaaaagcagttcgccagaaagaagactgctgcttcaccatcctatatggcactcagttcgtcctcagcacgctcagcttggcagctgactctaaagaggatgcagttaactggctctctggcttgaaaatcttacaccaggaagcgatgaatgcgtccacgcccaccattatcgagagttggctgagaaagcagatatattctgtggatcaaaccagaagaaacagcatcagtctccgagagttgaagaccatcttgcccctgatcaactttaaagtgagcagtgccaagttccttaaagataagtttgtggaaataggagcacacaaagatgagctcagctttgaacagttccatctcttctataaaaaacttatgtttgaacagcaaaaatcgattctcgatgaattcaaaaaggattcgtccgtgttcatcctggggaacactgacaggccggatgcctctgctgtttacctgcatgacttccagaggtttctcatacatgaacagcaggagcattgggctcaggatctgaacaaagtccgtgagcggatgacaaagttcattgatgacaccatgcgtgaaactgctgagcctttcttgtttgtggatgagttcctcacgtacctgttttcacgagaaaacagcatctgggatgagaagtatgacgcggtggacatgcaggacatgaacaaccccctgtctcattactggatctcctcgtcacataacacgtaccttacaggtgaccagctgcggagcgagtcgtccccagaagcttacatccgctgcctgcgcatgggctgtcgctgcattgaactggactgctgggacgggcccgatgggaagccggtcatctaccatggctggacgcggactaccaagatcaagtttgatgacgtcgtgcaggccatcaaagaccacgcctttgttacctcgagcttcccagtgatcctgtccatcgaggagcactgcagcgtggagcaacagcgtcacatggccaaggccttcaaggaagtatttggcgacctgctgttgacgaagcccacggaggccagtgctgaccagctgccctcgcccagccagctgcgggagaagatcatcatcaagcataagaagctgggcccccgaggcgatgtggatgtcaacatggaggacaagaaggacgaacacaagcaacagggggagctgtacatgtgggattccattgaccagaaatggactcggcactactgcgccattgctgatgccaagctgtccttcagtgatgacattgaacagactatggaggaggaagtgccccaggatataccccctacagaactacattttggggagaaatggttccacaagaaggtggagaagaggacgagtgccgagaagttgctgcaggaatactgcatggagacggggggcaaggatggcaccttcctggttcgggagagcgagaccttccccaatgactacaccctgtccttctggcggtcaggccgggtccagcactgccggatccgctccaccatggagggcgggaccctgaaatactacttgactgacaacctgaggttcaggaggatgtatgccctcatccagcactaccgcgagacgcacctgccgtgcgccgagttcgagctgcggctcacggaccctgtgcccaaccccaacccccacgagtccaagccgtggtactatgacagcctgagccgcggagaggcagaggacatgctgatgaggattccccgggacggggccttcctgatccggaagcgagaggggagcgactcctatgccatcaccttcagggctaggggcaaggtaaagcattgtcgcatcaaccgggacggccggcactttgtgctggggacctccgcctattttgagagtctggtggagctcgtcagttactacgagaagcattcactctaccgaaagatgagactgcgctaccccgtgacccccgagctcctggagcgctacaatacggaaagagatataaactccctctacgacgtcagcagaatgtatgtggatcccagtgaaatcaatccgtccatgcctcagagaaccgtgaaagctctgtatgactacaaagccaagcgaagcgatgagctgagcttctgccgtggtgccctcatccacaatgtctccaaggagcccgggggctggtggaaaggagactatggaaccaggatccagcagtacttcccatccaactacgtcgaggacatctcaactgcagacttcgaggagctagaaaagcagattattgaagacaatcccttagggtctctttgcagaggaatattggacctcaatacctataacgtcgtgaaagcccctcagggaaaaaaccagaagtcctttgtcttcatcctggagcccaaggagcagggcgatcctccggtggagtttgccacagacagggtggaggagctctttgagtggtttcagagcatccgagagatcacgtggaagattgacagcaaggagaacaacatgaagtactgggagaagaaccagtccatcgccatcgagctctctgacctggttgtctactgcaaaccaaccagcaaaaccaaggacaacttagaaaatcctgacttccgagaaatccgctcctttgtggagacgaaggctgacagcatcatcagacagaagcccgtcgacctcctgaagtacaatcaaaagggcctgacccgcgtctacccaaagggacaaagagttgactcttcaaactacgaccccttccgcctctggctgtgcggttctcagatggtggcactcaatttccagacggcagataagtacatgcagatgaatcacgcattgttttctctcaacgggcgcacgggctacgttctgcagcctgagagcatgaggacagagaaatatgacccgatgccacccgagtcccagaggaagatcctgatgacgctgacagtcaaggttctcggtgctcgccatctccccaaacttggacgaagtattgcctgtccctttgtagaagtggagatctgtggagccgagtatggcaacaacaagttcaagacgacggttgtgaatgataatggcctcagccctatctgggctccaacacaggagaaggtgacatttgaaatttatgacccaaacctggcatttctgcgctttgtggtttatgaagaagatatgttcagcgatcccaactttcttgctcatgccacttaccccattaaagcagtcaaatcaggattcaggtccgttcctctgaagaatgggtacagcgaggacatagagctggcttccctcctggttttctgtgagatgcggccagtcctggagagcgaagaggaactttactcctcctgtcgccagctgaggaggcggcaagaagaactgaacaaccagctctttctgtatgacacacaccagaacttgcgcaatgccaaccgggatgccctggttaaagagttcagtgttaatgagaaccactccagctgtaccaggagaaatgcaacaagaggttaagagagaagagagtcagcaacagcaagttttactcatagaagctggggtatgtgtgtaagggtattgtgtgtgtgcgcatgtgtgtttgcatgtaggagaacgtgccctattcacactctgggaagacgctaatctgtgacatcttttcttcaagcctgccatcaaggacatttcttaagacccaactggcatgagttggggtaatttcctattattttcatcttggacaacttctaacttatatctttatagaggattccccaaaatgtgctcctcatttttggcctctcatgttccaaacctcattgaataaaaagcaatgaaaaccttg

SEQ ID NO: 801 - DNA, 3609 bp, Homo sapiens
  ref <308>: DATABASE ACCESSION NUMBER: NM_002662
  ref <309>: DATABASE ENTRY DATE: 2001-06-18
ggcacgaggagccctgagagtccgccgccaacgcgcaggtgctagcggccccttcgccctgcagcccctttgcttttactctgtccaaagttaacatgtcactgaaaaacgagccacgggtaaatacctctgcactgcagaaaattgctgctgacatgagtaatatcatagaaaatctggacacgcgggaactccactttgagggagaggaggtagactacgacgtgtctcccagcgatcccaagatacaagaagtgtatatccctttctctgctatttataacactcaaggatttaaggagcctaatatacagacgtatctctccggctgtccaataaaagcacaagttctggaagtggaacgcttcacatctacaacaagggtaccaagtattaatctttacactattgaattaacacatggggaatttaaatggcaagttaagaggaaattcaagcattttcaagaatttcacagagagctgctcaagtacaaagcctttatccgcatccccattcccactagaagacacacgtttaggaggcaaaacgtcagagaggagcctcgagagatgcccagtttgccccgttcatctgaaaacatgataagagaagaacaattccttggtagaagaaaacaactggaagattacttgacaaagatactaaaaatgcccatgtatagaaactatcatgccacaacagagtttcttgatataagccagctgtctttcatccatgatttgggaccaaagggcatagaaggtatgataatgaaaagatctggaggacacagaataccaggcttgaattgctgtggtcagggaagagcctgctacagatggtcaaaaagatggttaatagtgaaagattcctttttattgtatatgaaaccagacagcggtgccattgccttcgtcctgctggtagacaaagaattcaaaattaaggtggggaagaaggagacagaaacgaaatatggaatccgaattgataatctttcaaggacacttattttaaaatgcaacagctatagacatgctcggtggtggggaggggctatagaagaattcatccagaaacatggcaccaactttctcaaagatcatcgatttgggtcatatgctgctatccaagagaatgctttagctaaatggtatgttaatgccaaaggatattttgaagatgtggcaaatgcaatggaagaggcaaatgaagagatttttatcacagactggtggctgagtccagaaatcttcctgaaacgcccagtggttgagggaaatcgttggaggttggactgcattcttaaacgaaaagcacaacaaggagtgaggatcttcataatgctctacaaagaggtggaactcgctcttggcatcaatagtgaatacaccaagaggactttgatgcgtctacatcccaacataaaggtgatgagacacccggatcatgtgtcatccaccgtctatttgtgggctcaccatgagaagcttgtcatcattgaccaatcggtggcctttgtgggagggattgacctggcctatggaaggtgggacgacaatgagcacagactcacagacgtgggcagtgtgaagcgggtcacttcaggaccgtctctgggttccctcccacctgccgcaatggagtctatggaatccttaagactcaaagataaaaatgagcctgttcaaaacctacccatccagaagagtattgatgatgtggattcaaaactgaaaggaataggaaagccaagaaagttctccaaatttagtctctacaagcagctccacaggcaccacctgcacgacgcagatagcatcagcagcattgacagcacctccagttattttaatcactatagaagtcatcacaatttaatccatggtttaaaaccccacttcaaactctttcacccgtccagtgagtctgagcaaggactcactagacctcatgctgataccgggtccatccgtagtttacagacaggtgtgggagagctgcatggggaaaccagattctggcatggaaaggactactgcaatttcgtcttcaaagactgggttcaacttgataaaccttttgctgatttcattgacaggtactccacgccccggatgccctggcatgacattgcctctgcagtccacgggaaggcggctcgtgatgtggcacgtcacttcatccagcgctggaacttcacaaaaattatgaaatcaaaatatcggtccctttcttatccttttctgcttccaaagtctcaaacaacagcccatgagttgagatatcaagtgcctgggtctgtccatgctaacgtacagttgctccgctctgctgctgattggtctgctggtataaagtaccatgaagagtccatccacgccgcttacgtccatgtgatagagaacagcaggcactatatctatatcgaaaaccagtttttcataagctgtgctgatgacaaagttgtgttcaacaagataggcgatgccattgcccagaggatcctgaaagctcacagggaaaaccagaaataccgggtatatgtcgtgataccacttctgccagggttcgaaggagacatttcaaccggcggaggaaatgctctacaggcaatcatgcacttcaactacagaaccatgtgcagaggagaaaattccatccttggacagttaaaagcagagcttggtaatcagtggataaattacatatcattctgtggtcttagaacacatgcagagctcgaaggaaacctagtaactgagcttatctatgtccacagcaagttgttaattgctgatgataacactgttattattggctctgccaacataaatgaccgcagcatgctgggaaagcgtgacagtgaaatggctgtcattgtgcaagatacagagactgttccttcagtaatggatggaaaagagtaccaagctggccggtttgcccgaggacttcggctacagtgctttagggttgtccttggctatcttgatgacccaagtgaggacattcaggatccagtgagtgacaaattcttcaaggaggtgtgggtttcaacagcagctcgaaatgctacaatttatgacaaggttttccggtgccttcccaatgatgaagtacacaatttaattcagctgagagactttataaacaagcccgtattagctaaggaagatcccattcgagctgaggaggaactgaagaagatccgtggatttttggtgcaattccccttttatttcttgtctgaagaaagcctactgccttctgttgggaccaaagaggccatagtgcccatggaggtttggacttaagagatattcattggcagctcaaagacttccaccctggagaccacactgcacacagtgacttcctggggatgtcatagccaaagccaggcctgacgcattctcgtatccaacccaaggaccttttggaatgactggggagggctgcagtcacattgatgtaaggactgtaaacatcagcaagactttataattccttctgcctaacttgtaaaaagggggctgcattcttgttggtagcatgtactctgttgagtaaaacacatattcaaattccgctcgtgccgaattc

SEQ ID NO: 802 - DNA, 2745 bp, Homo sapiens
  ref <308>: DATABASE ACCESSION NUMBER: NM_002664
  ref <309>: DATABASE ENTRY DATE: 2001-06-18
ggcccagctgctgagaggagttgcctgagagtgacctttgcatctgcctgtccagccagcatggaaccaaagcggatcagagagggctaccttgtgaagaaggggagcgtgttcaatacgtggaaacccatgtgggttgtattgttagaagatggaattgaattctataagaagaaaagtgacaacagccccaaaggaatgatcccgctgaaagggagcactctgactagcccttgtcaagactttggcaaaaggatgtttgtgtttaagatcactacgaccaaacagcaggaccacttcttccaggcagccttcctggaggagagagatgcctgggttcgggatatcaataaggccattaaatgcattgaaggaggccagaaatttgccaggaaatctaccaggaggtccattcgactgccagaaaccattgacttaggtgccttatatttgtccatgaaagacactgaaaaaggaataaaagaactgaatctagagaaggacaagaagatttttaatcactgcttcacaggtaactgcgtcattgattggctggtatccaaccagtctgttaggaatcgccaggaaggcctcatgattgcttcatcgctgctcaatgaggggtatctgcagcctgctggagacatgtccaagagtgcagtggatggaactgctgaaaaccctttcctggacaaccctgatgccttctactactttccagacagtgggttcttctgtgaagagaattccagtgatgatgatgtgattctgaaagaagaattcagaggggtcattatcaagcagggatgtttactgaagcaggggcatagaaggaaaaactggaaagtgaggaagttcatcttgagagaagaccctgcctacctgcactactatgaccctgctggggcagaagatcccctgggagcaattcacttgagaggctgtgtggtgacttcagtggagagcaactcaaatggcaggaagagtgaggaagagaacctttttgagatcatcacagcagatgaagtgcactatttcttgcaagcagccacccccaaggagcgcacagagtggatcaaagccatccagatggcctcccgaactgggaagtaaagagactcctgcattcctcctcccctcctgagggaagcccatggacaagctcagtccaggacctgtccacttctgtgacaaatcaacgggaaacagcccaggggtgggaagttttcatttgcaggggggtctgaatgtaactcaccatgtggtgtgcaaggttcccctgcattgtattgctcactgcagcccctctgcccctatccatgacccccaagcagatataacaagctgtgcagcctcagtaggctgcttgccctctccagcctcagggcctcttctggaaaatgaagaaattcaactagtagattcctgaggtccccctagcttaaaaaaaaaaaaatctgccccatgattctaacactcgcagtagtgatagtgtatctagttgttctgctggtgtccttccttggctaagtcttggccttcagttatcttcaaatgtaccagaacctgagccaacgcctccctgtgaaactgttgctgatctgtagtacagtaccaggaagaaacctcttttgttctctttagacatcttctacttgctcttggccttgagatcgtgtaacaaaatgaaggagggctctcttctttcttcctcatcctactcaaaaacttcccgagagcagtggtggttttgagggttttgacttctattacttttggcagcctggaaagttgtgtcttctgggaaagagacccggggaggccaggagtagctgagggtcctttctgtgcccttaaaccgcccagaggagccctattccactctggttttaggctgatctgagagggtctccctttgttcctttctggagcatttctctaacgtttattacaattaggagggggaccccacatctgtgagattctgtttcatttgaggtttacagaaaaaaaaaagtggccagatgtgttccccccatgggtgagaggcctgggcaactgcctggtgaatgtgtcttgcggcagctgcagcaagtggaggggctgaactactggccagctcactggatgatgggttaatacaacaactgcactgtaaggactcagagccacacagaacttctgagaggggctgttagcattgcgcagcatcttcagttctccagtaaatgatattgcgttcgtgcctcagctttaagcacaagtagcagcagctcctgcttgagttctgagggcatcatggccctatgattaaccagagtgatctaacctagactaaaattgggaacttatttgcaatttttgaccctgaccactaactagtgattcttctccaaaattgagaaagacagcacccattgaaacagatatgtgtgtgaaagtatatttttcaattccagatttttaattttaaggctccaggaaagaaaggagagtagaacatttttcctcattttatcaaatcctctcttgccctccctcaattcccctgtaacattcctgaagctgttcccactcccagatggttttatcaatagcctagaggtaaagaactgtctttttctctgattctttaataaattatctttatagaatatgcacaagtttttctacactcagtgttaaagtatttattaatgggaagtcaacttaatgttttgaaataaatatatgactctgtttaat

SEQ ID NO: 803 - DNA, 954 bp, Homo sapiens
  ref <308>: DATABASE ACCESSION NUMBER: NM_002686
  ref <309>: DATABASE ENTRY DATE: 2001-06-18
actgggcggaccgcggcggcagcatgagcggcgcagaccgtagccccaatgcgggcgcagcccctgactcggccccgggccaggcggcggtggcttcggcctaccagcgcttcgagccgcgcgcctacctccgcaacaactacgcgccccctcgcggggacctgtgcaacccgaacggcgtcgggccgtggaagctgcgctgcttggcgcagaccttcgccaccggtgaagtgtccggacgcaccctcatcgacattggttcaggccccaccgtgtaccagctgctcagtgcctgcagccactttgaggacatcaccatgacagatttcctggaggtcaaccgccaggagctggggcgctggctgcaggaggagccgggggccttcaactggagcatgtacagccaacatgcctgcctcattgagggcaagggggaatgctggcaggataaggagcgccagctgcgagccagggtgaaacgggtcctgcccatcgacgtgcaccagccccagcccctgggtgctgggagcccagctcccctgcctgctgacgccctggtctctgccttctgcttggaggctgtgagcccagatcttgccagctttcagcgggccctggaccacatcaccacgctgctgaggcctggggggcacctcctcctcatcggggccctggaggagtcgtggtacctggctggggaggccaggctgacggtggtgccagtgtctgaggaggaggtgagggaggccctggtgcgtagtggctacaaggtccgggacctccgcacctatatcatgcctgcccaccttcagacaggcgtagatgatgtcaagggcgtcttcttcgcctgggctcagaaggttgggctgtgagggctgtacctggtgccctgtggcccccacccacctggattccctgttctttgaagtggcacctaataaagaaataataccc

SEQ ID NO: 804 - DNA, 2187 bp, Homo sapiens
  ref <308>: DATABASE ACCESSION NUMBER: NM_002689
  ref <309>: DATABASE ENTRY DATE: 2001-06-18
gaattccggcttgggcgcaggtcggagctgggtgggccggctccccggcctggcttgggcgaccatgtccgcatccgcccagcagctggcggaggagctgcagatcttcggcctagactgcgaggaggctctaattgagaaattggtagagctttgtgttcagtatggacagaatgaggagggaatggtaggcgagcttatagccttctgcaccagcacacataaagttggccttacctcagagatcctgaactcttttgagcatgagtttctgagcaaaagattatcgaaagccaggcatagtacctgcaaggacagtggccatgcaggagctagagacattgtttccattcaagagctaattgaagtggaagaagaagaggaaatcctcttgaactcttacaccacaccttcaaagggttctcagaagcgagctatctctaccccagaaacccccctaacaaaaaggagtgtgtcaactcgtagcccccatcagctactctcaccgtcaagtttctctccaagtgctactccctcccagaaatacaactcacgaagtaaccgaggagaagtggttacctccttcggcttagcacagggagtatcttggtctgggagaggaggagctggaaacatcagcctgaaggtcttgggatgtccagaggcactaactgggagctacaaatccatgtttcagaagctcccagacattcgagaagttctgacctgtaagatagaagaacttggcagcgaactcaaggaacattacaagattgaagctttcactcctttgctagccccagcacaggagcctgtcactctgctgggccagattggctgtgatagcaacgggaagctgaacaacaagtcagtgattctcgagggagaccgggaacattcctcgggtgctcaaattccagtggatttatctgagcttaaggaatattctctgtttcctggacaggttgtaattatggaaggaatcaacaccactggtaggaaacttgttgccaccaaactctacgagggtgtgccacttccattttatcagcccactgaagaggatgcagactttgagcaaagcatggtcctggttgcctgtggaccatacaccacatctgacagcatcacgtatgaccccctgcttgacctgattgctgtcatcaaccatgaccggccagatgtctgcatcctgtttggccctttcctggagtctaagcatgaacaggtggagaattgtctactgacaagtccatttgaagacattttcaagcagtgtctacgaacaattattgaaggcacaagaagctccggctcccaccttgtctttgtcccgtcattgagagatgtgcaccatgagcctgtgtacccccagccgcctttcagctactccgatctgtctcgagaggacaaaaagcaagtacagtttgtgtccgagccctgcagcctctccataaacggagtgatcttcggcttgacatccacagatctgcttttccacctgggggccgaggagatcagtagttcttccggaacttcagacagattcagccgaatactcaagcacatcttgacccagaggagctactacccactctacccgccccaagaagacatggccattgactatgagtcgttctatgtttacgcacagctgcctgtcaccccagatgtcctcatcatcccgtcagagctgaggtacttcgtgaaggatgtcctcggctgtgtctgtgtgaaccctgggcgccttaccaaagggcaggtgggaggcaccttcgcccgactctaccttaggaggccggcagcggacggggcagagaggcagagcccatgcattgctgtgcaggtcgtcaggatctgaggcttctgtcctctgctgttctctgctgtgtgggcccttaaagtcttagccaagagccaagacatagccctgtgacaaggtgaacagttgggtgggaaaggagagaggagccagccagggaggggcagctgcagtgaccaggcccagcaggaggacttgtgcagccgggcctgcctgtgagtggtgcctctcctggaagaagctcttgcttctcagtccatgctccgtgtccagaagtaagccagctgtggatcccgcccactcagaaaaggcgagaaggctttgtgattttctacatgaatcaaacacagaaacaccggaattcc

SEQ ID NO: 805 - DNA, 1259 bp, Homo sapiens
  ref <308>: DATABASE ACCESSION NUMBER: NM_002690
  ref <309>: DATABASE ENTRY DATE: 2001-06-18
ccggagctgggttgctcctgctcccgtctccaagtcctggtacctccttcaagctgggagagggctctagtccctggttctgaacactctggggttctcgggtgcaggccgccatgagcaaacggaaggcgccgcaggagactctcaacgggggaatcaccgacatgctcacagaactcgcaaactttgagaagaacgtgagccaagctatccacaagtacaatgcttacagaaaagcagcatctgttatagcaaaatacccacacaaaataaagagtggagctgaagctaagaaattgcctggagtaggaacaaaaattgctgaaaagattgatgagtttttagcaactggaaaattacgtaaactggaaaagattcggcaggatgatacgagttcatccatcaatttcctgactcgagttagtggcattggtccatctgctgcaaggaagtttgtagatgaaggaattaaaacactagaagatctcagaaaaaatgaagataaattgaaccatcatcagcgaattgggctgaaatattttggggactttgaaaaaagaattcctcgtgaagagatgttacaaatgcaagatattgtactaaatgaagttaaaaaagtggattctgaatacattgctacagtctgtggcagtttcagaagaggtgcagagtccagtggtgacatggatgttctcctgacccatcccagcttcacttcagaatcaaccaaacagccaaaactgttacatcaggttgtggagcagttacaaaaggttcattttatcacagataccctgtcaaagggtgagacaaagttcatgggtgtttgccagcttcccagtaaaaatgatgaaaaagaatatccacacagaagaattgatatcaggttgatacccaaagatcagtattactgtggtgttctctatttcactgggagtgatattttcaataagaatatgagggctcatgccctagaaaagggtttcacaatcaatgagtacaccatccgtcccttgggagtcactggagttgcaggagaacccctgccagtggatagtgaaaaagacatctttgattacatccagtggaaataccgggaacccaaggaccggagcgaatgaggcctgtatcctccctggcagacacaacccaataggagtcttaatttatttcttaacctttgctatgtaagggtctttggtgtttttaaatgattgtttcttcttcatgcttttgcttgcaatgtagtcaataaaacc

SEQ ID NO: 806 - DNA, 3590 bp, Homo sapiens
  ref <308>: DATABASE ACCESSION NUMBER: NM_002709
  ref <309>: DATABASE ENTRY DATE: 2001-06-18
cctgggtctgacgcggccctgttcgagggggcctctcttgtttatttatttattttccgtgggtgcctccgagtgtgcgcgcgctctcgctacccggcggggagggggtggggggagggcccgggaaaagggggagttggagccggggtcgaaacgccgcgtgacttgtaggtgagagaacgccgagccgtcgccgcagcctccgccgccgagaagcccttgttcccgctgctgggaaggagagtctgtgccgacaagatggcggacggggagctgaacgtggacagcctcatcacccggctgctggaggtacgaggatgtcgtccaggaaagattgtgcagatgactgaagcagaagttcgaggcttatgtatcaagtctcgggagatctttctcagccagcctattcttttggaattggaagcaccgctgaaaatttgtggagatattcatggacaatatacagatttactgagattatttgaatatggaggtttcccaccagaagccaactatcttttcttaggagattatgtggacagaggaaagcagtctttggaaaccatttgtttgctattggcttataaaatcaaatatccagagaacttctttctcttaagaggaaaccatgagtgtgctagcatcaatcgcatttatggattctatgatgaatgcaaacgaagatttaatattaaattgtggaagaccttcactgattgttttaactgtctgcctatagcagccattgtggatgagaagatcttctgttgtcatggaggattgtcaccagacctgcaatctatggagcagattcggagaattatgagacctactgatgtccctgatacaggtttgctctgtgatttgctatggtctgatccagataaggatgtgcaaggctggggagaaaatgatcgtggtgtttcctttacttttggagctgatgtagtcagtaaatttctgaatcgtcatgatttagatttgatttgtcgagctcatcaggtggtggaagatggatatgaattttttgctaaacgacagttggtaaccttattttcagccccaaattactgtggcgagtttgataatgctggtggaatgatgagtgtggatgaaactttgatgtgttcatttcagatattgaaaccatctgaaaagaaagctaaataccagtatggtggactgaattctggacgtcctgtcactccacctcgaacagctaatccgccgaagaaaaggtgaagaaaggaattctgtaaagaaaccatcagatttgttaaggacatacttcataatatataagtgtgcactgtaaaaccatccagccatttgacaccctttatgatgtcacacctttaacttaaggagacgggtaaaggatcttaaatttttttctaatagaaagatgtgctacactgtattgtaataagtatactctgttatagtcaacaaagttaaatccaaattcaaaattatccattaaagttacatcttcatgtatcacaatttttaaagttgaaaagcatcccagttaaactagatgtgatagttaaaccagatgaaagcatgatgatccatctgtgtaatgtggttttagtgttgcttggttgtttaattattttgagcttgttttgtttttgtttgttttcactagaataatggcaaatacttctaatttttttccctaaacatttttaaaagtgaaatatgggaagagctttacagacattcaccaactattattttcccttgtttatctacttagatatctgtttaatcttactaagaaaactttcgcctcattacattaaaaaggaattttagagattgattgttttaaaaaaaaatacgcacattgtccaatccagtgattttaatcatacagtttgactgggcaaactttacagctgatagtgaatattttgctttatacaggaattgacactgatttggatttgtgcactctaatttttaacttattgatgctctattgtgcagtagcatttcatttaagataaggctcatatagtattacccaactagttggtaatgtgattatgtggtaccttggctttaggttttcattcgcacggaacaccttttggcatgcttaacttcctggtaacaccttcacctgcattggttttctttttcttttttctttctttttttttttttttttttttttgagttgttgtttgtttttagatccacagtacatgagaatccttttttgacaagccttggaaagctgacactgtctctttttcctccctctatacgaaggatgtatttaaatgaatgctggtcagtgggacattttgtcaactatgggtattgggtgcttaactgtctaatattgccatgtgaatgttgtatacgattgtaaggcttatgtcactaaagatttttattctgattttttcataatcaaaggtcatatgatactgtatagacaagctttgtagtgaagtatagtagcaataatttctgtacctgatcaagtttattgcagcctttcttttcctatttcttttttttaagggttagtattaacaaatggcaatgagtagaaaagttaacatgaagattttagaaggagagaacttacaggacacagatttgtgattctttgactgtgacactattggatgtgattctaaaagcttttattgagcattgtcaaatttgtaagcttcatagggatggacatcatatctataatgcccttctatatgtgctaccatagatgtgacatttttgaccttaatatcgtctttgaaaatgttaaattgagaaacctgttaacttacattttatgaattggcacattgtattacttactgcaagagatatttcattttcagcacagtgcaaaagttctttaaaatgcatatgtctttttttctaattccgttttgttttaaagcacattttaaatgtagttttctcatttagtaaaagttgtctaattgatatgaagcctgactgattttttttttccttacagtgagacatttaagcacacattttattcacatagatactatgtccttgacatattgaaatgattcttttctgaaagtattcatgatctgcatatgatgtattaggttaggtcacaaaggttttatctgaggtgatttaaataacttcctgattggagtgtgtaagctgagcgatttctaataaaattttagttgtacacttttagtagtcatagtgaagcaggtctagaaaataagcctttggcagggaaaaagggcaatgttgattaatctcagtattaaaccacattaatctgtatcccattgtctggcttttgtaaattcatccaggtcaagactaagtatgttggttaataggaatccttttttttttttaaagactaaatgtgaaaaaataatcactacttaagctaattaatattggtcattaaatttaaaggatggaaatttatcatgtttaaaaattattcaagcactcttaaaaccacttaaacagcctccagtcataaaaatgtgttctttacaaatatttgcttggcaacacgacttgaaataaataaaactttgtttcttaggagaaaa

SEQ ID NO: 807 - DNA, 1182 bp, Homo sapiens
  ref <308>: DATABASE ACCESSION NUMBER: NM_002727
  ref <309>: DATABASE ENTRY DATE: 2001-06-18
gaattccgctagactaagttggtcatgatgcagaagctactcaaatgcagtcggcttgtcctggctcttgccctcatcctggttctggaatcctcagttcaaggttatcctacgcagagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatccttttttttctcatgaattcttaaaggattatgctttaatgctgttatctatcttattgttcttgaaaatacctgcattttttggtatcatgttcaaccaacatcattatgaaattaattagattcccatggccataaaatggctttaaagaatatatatatatttttaaagtagcttgagaagcaaattggcaggtaatatttcatacctaaattaagactctgacttggattgtgaattataatgatatgccccttttcttataaaaacaaaaaaaaaataatgaaacacagtgaatttgtagagtgggggtatttgacatattttacagggtggagtgtactatatactattacctttgaatgtgtttgcagagctagtggatgtgtttgtctacaagtatgattgctgttacataacaccccaaattaactcccaaattaaaacacagttgtgctgtcaatacctcatactgctttacctttttttcctggatatctgtgtattttcaaatgttactatatattaaagcagaaatataacc

SEQ ID NO: 808 - DNA, 1704 bp, Homo sapiens
  ref <308>: DATABASE ACCESSION NUMBER: NM_002729
  ref <309>: DATABASE ENTRY DATE: 2001-06-18
cggagccatgcagtacccgcaccccgggccggcggcgggcgccgtgggggtgccgctgtacgcgcccacgccgctgctgcaacccgcacacccgacgcccttttacatcgaggacatcctgggccgcgggcccgccgcgcccacgcccgcccccacgctgccgtcccccaactcctccttcaccagcctcgtgtccccctaccggaccccggtgtacgagcccacgccgatccatccagccttctcgcaccactccgccgccgcgctggccgctgcctacggacccggcggcttcgggggccctctgtaccccttcccgcggacggtgaacgactacacgcacgccctgctccgccacgaccccctgggcaaacctctactctggagccccttcttgcagaggcctctgcataaaaggaaaggcggccaggtgagattctccaacgaccagaccatcgagctggagaagaaattcgagacgcagaaatatctctctccgcccgagaggaagcgtctggccaagatgctgcagctcagcgagagacaggtcaaaacctggtttcagaatcgacgcgctaaatggaggagactaaaacaggagaaccctcaaagcaataaaaaagaagaactggaaagtttggacagttcctgtgatcagaggcaagatttgcccagtgaacagaataaaggtgcttctttggatagctctcaatgttcgccctcccctgcctcccaggaagaccttgaatcagagatttcagaggattctgatcaggaagtggacattgagggcgataaaagctattttaatgctggatgatgaccactggcattggcatgttcagaaaactggatttaggaataatgttttgctacagaaaatcttcatagaagaactggaaggctatataagaaagggaatcaattctctggtattctggaaacctaaaaatatttggtgcactgctcaattaacaaacctacatggagaccttaattttgacttaacaaatagtttatgtactgctcttaggttgttttgataaagtgacattatagtgattaaattcttccccctttaaaaaaacagttagtggttttcactatttataaaaaattaattttgaactttttgttaaatttttaagttatagctttaaaggttttaataggaccttcttgaacgacttttctgtaatctgtttatctcccacttaatggaaaggcaaaggggtaccccaaatccagagctgcctacatttcaggcagccttggagtattttaaaaggaaaacattctttacttttatatgacattcttatactgctgtctcaaatccaaaaacatttcagagctcttgtctcagagatgtgtgttctttttgtcagagatatggttgatgagaatcttaaatgcttgttttgcactatcacttagtacctgtttgaccaaggtgttaaggggatagtacctcccaattcaagcagagaaactgacctgactaaagttaatcgcagatgaactagaagtcacaggttaattaaatgtaagtagattgtagatactgttttatatcaaacaatgtttataatgtgtatatagaattgttcactgtaaaaaaaatggccaaaatgtgttttttttttaataagtaacttgactataaaataaagccgtccgtgggacgactgacaaaaaaaaaaa

SEQ ID NO: 809 - DNA, 3036 bp, Homo sapiens
  ref <308>: DATABASE ACCESSION NUMBER: NM_002734
  ref <309>: DATABASE ENTRY DATE: 2001-06-18
gctgggagcaaagcgctgagggagctcggtacgccgccgcctcgcacccgcagcctcgcgcccgccgccgcccgtccccagagaaccatggagtctggcagtaccgccgccagtgaggaggcacgcagccttcgagaatgtgagctctacgtccagaagcataacattcaagcgctgctcaaagattctattgtgcagttgtgcactgctcgacctgagagacccatggcattcctcagggaatactttgagaggttggagaaggaggaggcaaaacagattcagaatctgcagaaagcaggcactcgtacagactcaagggaggatgagatttctcctcctccacccaacccagtggttaaaggtaggaggcgacgaggtgctatcagcgctgaggtctacacggaggaagatgcggcatcctatgttagaaaggttataccaaaagattacaagacaatggccgctttagccaaagccattgaaaagaatgtgctgttttcacatcttgatgataatgagagaagtgatatttttgatgccatgttttcggtctcctttatcgcaggagagactgtgattcagcaaggtgatgaaggggataacttctatgtgattgatcaaggagagacggatgtctatgttaacaatgaatgggcaaccagtgttggggaaggagggagctttggagaacttgctttgatttatggaacaccgagagcagccactgtcaaagcaaagacaaatgtgaaattgtggggcatcgaccgagacagctatagaagaatcctcatgggaagcacactgagaaagcggaagatgtatgaggaattccttagtaaagtctctattttagagtctctggacaagtgggaacgtcttacggtagctgatgcattggaaccagtgcagtttgaagatgggcagaagattgtggtgcagggagaaccaggggatgagttcttcattattttagaggggtcagctgctgtgctacaacgtcggtcagaaaatgaagagtttgttgaagtgggaagattggggccttctgattattttggtgaaattgcactactgatgaatcgtcctcgtgctgccacagttgttgctcgtggccccttgaagtgcgttaagctggaccgacctagatttgaacgtgttcttggcccatgctcagacatcctcaaacgaaacatccagcagtacaacagttttgtgtcactgtctgtctgaaatctgcctcctgtgcctcccttttctcctctccccaatccatgcttcactcatgcaaactgctttattttccctacttgcagcgccaagtggccactggcatcgcagcttcctgtctgtttatatattgaaagttgcttttattgcaccattttcaatttggagcattaactaaatgctcatacacagttaaataaatagaaagagttctatggagactttgctgttactgcttctctttgtgcagtgttagtattcaccctgggcagtgagtgccatgctttttggtgagggcagatccagcacctattgaattaccatagagtaatgatgtaacagtgcaagatttttttttttaagtgacataattgtccagttataagcgtatttagactgtggccatatatgctgtatttctttgtagaataaatggtttctcattaaactctaaagattagggaaatggatatagaaaatcttagtatagtagaaagacatctgcctgtaattaaactagtttaagggtggaaaaatgaaaatttttgctaattatcaatgggatatgattggttcagttttttttttccagagttgttgtttgccaagctaatctgcctggtttatttatatcttgttattaatgtttcttctccaattctgaaatacttttgagtatggctatctatacctgccttttaagtttgaaactaactcatagatgcaaatattggttagtatttaactacatctgcctcggctcacaaattccgattagacctttatccagctagtgccaaataattgatcagatgctgaattgagaataagaatttgaggtctacattcttggttgttaatttagagcgtttggttaaagtatgtccttcagctgactccagtataatctcctctgctcattaaactgattccaggagattggatttgctgtgactagatacagatggagcaaatgtcctaacagagaaatagaggtgatgctgctaaagggagaaatgccaggcggacaaagttcagtgtcgggaattttccccgtgacattcactggggcatgagattttggaagaagttttttactttggtttagtctttttttcctcctttttattcagctagaatttctggtgggttgatggtagggtataatgtgtctgtgttgcttcaaattggtctgaaaggctatcctgctgaaagtcctgctttcctatctagcatttattcctctggcaaacttttctttcttttcttttttaaagtaaacttgtgtattgagtcttaactgtatttcagtattttccagccttatgtgttacattattccaatgatacccaacagtttatttttattatttttttaaacaaaatttcacagttctgtaatgtaggcacttttattttcattgtgatttatatataaggtaatgtagggttatatttgggagtgactgcaagcatttttccatctgtgtgcaactaactgactctgttattgatcccttctcctgccctttcccaggtaatttaaattggtcatggtagatttttttcatagatttgaaaaacttttaggttgttaccaagtatgaagtataaatctggggaagaggttttatttacattttagggtgggtaagaaagccaccttgttacaaattttttaatttccaaaataatctatattaaatgagggtttctgatctgtactttgtgtttagctacctttttatatttaaaaaattaaaaatgaaaattatgttcttacaagcttaaagcttgatttgatct

SEQ ID NO: 810 - DNA, 3259 bp, Homo sapiens
  ref <308>: DATABASE ACCESSION NUMBER: NM_002736
  ref <309>: DATABASE ENTRY DATE: 2001-06-18
gacgcgcgccgggagccggcggccgggccagccggcgccggggcccagtgcgccgcgctcgcagccggtagcgcgccagccgtaggcgtcgctcggcagccgcggggccctaggcgtgccggggagggggcgagggcggccaggcgcctgccgccccggaggcaggatgagcatcgagatcccggcgggactgacggagctgctgcagggcttcacggtggaggtgctgaggcaccagcccgcggacctgctggagttcgcgctgcagcacttcacccgcctgcagcaggagaacgagcgcaaaggcaccgcgcgcttcggccatgagggcaggacctggggggacctgggcgccgctgccgggggcggcacccccagcaagggggtcaacttcgccgaggagcccatgcagtccgactccgaggacggggaggaggaggaggcggcgcccgcggacgcaggggcgttcaatgctccagtaataaaccgattcacaaggcgtgcctcagtatgtgcagaagcttataatcctgatgaagaagaagatgatgcagagtccaggattatacatccaaaaactgatgatcaaagaaataggttgcaagaggcttgcaaagacatcctgctgtttaagaatctggatccggagcagatgtctcaagtattagatgccatgtttgaaaaattggtcaaagatggggagcatgtaattgatcaaggtgacgatggtgacaacttttatgtaattgatagaggcacatttgatatttatgtgaaatgtgatggtgttggaagatgtgttggtaactatgataatcgtgggagtttcggcgaactggccttaatgtacaatacacccagagcagctacaatcactgctacctctcctggtgctctgtggggtttggacagggtaaccttcaggagaataattgtgaaaaacaatgccaaaaagagaaaaatgtatgaaagctttattgagtcactgccattccttaaatctttggagttttctgaacgcctgaaagtagtagatgtgataggcaccaaagtatacaacgatggagaacaaatcattgctcagggagattcggctgattcttttttcattgtagaatctggagaagtgaaaattactatgaaaagaaagggtaaatcagaagtggaagagaatggtgcagtagaaatgcctcgatgctcgcggggacagtactttggagagcttgccctggtaactaacaaacctcgagcagcttctgcccacgccattgggactgtcaaatgtttagcaatggatgtgcaagcatttgaaaggcttctgggaccttgcatggaaattatgaaaaggaacatcgctacctatgaagaacagttagttgccctgtttggaacgaacatggatattgttgaacccactgcatgaagcaaaagtatggagcaagacctgtagtgacaaaattacacagtagtggttagtccactgagaatgtgtttgtgtagatgccaagcattttctgtgatttcaggttttttcctttttttacatttacaacgtatcaataaacagtagtgatttaatagtcaataggctttaacatcactttctaaagagtagttcataaaaaaatcaacatactgataaaatgactttgtactccacaaaattatgactgaaaggtttattaaaatgattgtaatatatagaaagtatctgtgtttaagaagataattaaaggatgttatcataggctatatgtgttttacttattcagactgataatcatattagtgactatccccatgtaagagggcacttggcaattaaacatgctacacagcatggcatcacttttttttataactcattaaacacagtaaaattttaatcatttttgttttaaagttttctagcttgataagttatgtgctgccttggcctattggtgaaatggtataaaatatcatatgcagttttaaaactttttatatttttgcaataaagtacattttgactttgttggcataatgtcagtaacatacatattccagtggttttatggacaggcaatttagtcattatgataataaggaaaacagtgttttagatgagagatcattaatgcatttttccctcatcaagcatatatctgcttttttttattttgcaattctctgtattctatgtctttaaaaatttgatcttgacatttaatgtcacaaagttttgtttttttaaaaagtgatttaaacttaagatccgacattttttgtattctttaagattttacacctaaaaaatctctcctatcccaaaaataatgtgggatccttatcagcatgcccacagtttatttctttgttcttcactaggcctgcataatacagtcctatgtagacatctgttcccttgggtttccgttctttcttaggatggttgccaacccacaatctcattgatcagcagccaatatgggtttgtttggtttttttaattcttaaaaacatcctctagaggaatagaaacaaatttttatgagcataaccctatataaagacaaaatgaatttctgaccttaccatatataccattaggccttgccattgctttaatgtagactcatagttgaaattagtgcagaaagaactcagatgtactagattttcattgttcattgatatgctcagtatgctgccacataagatgaatttaattatattcaaccaaagcaatatactcttacatgatttctaggccccatgacccagtgtctagagacattaattctaaccagttgtttgcttttaaatgagtgatttcattttgggaaacaggtttcaaatgaatatatatacatgggtaaaattactctgtgctagtgtagtcttactagagaatgtttatggtcccacttgtatatgaaaatgtggttagaatgttaattggataatgtatatataagaagttaaagtatgtaaagtataacttcagccacatttttagaacactgtttaacatttttgcaaaaccttcttgtaggaaaagagagctctctacatgaagatgacttgttttatatttcagattttattttaaaagccatgtctgttaaacaagaaaaaacacaaaagaactccagattcctggttcatcattctgtattcttactcactttttcaagttatctattttgttgcataaactaattgttaactattcatggaacagcaaacgcctgtttaataaagaactttgaccaag

SEQ ID NO: 811 - DNA, 2261 bp, Homo sapiens
  ref <308>: DATABASE ACCESSION NUMBER: NM_002740
  ref <309>: DATABASE ENTRY DATE: 2001-06-18
ccgcggttccggctgctccggcgaggcgacccttgggtcggcgctgcgggcgaggtgggcaggtaggtgggcggacggccgcggttctccggcaagcgcaggcggcggagtcccccacggcgcccgaagcgccccccgcacccccggcctccagcgttgaggcgggggagtgaggagatgccgacccagagggacagcagcaccatgtcccacacggtcgcaggcggcggcagcggggaccattcccaccaggtccgggtgaaagcctactaccgcggggatatcatgataacacattttgaaccttccatctcctttgagggcctttgcaatgaggttcgagacatgtgttcttttgacaacgaacagctcttcaccatgaaatggatagatgaggaaggagacccgtgtacagtatcatctcagttggagttagaagaagcctttagactttatgagctaaacaaggattctgaactcttgattcatgtgttcccttgtgtaccagaacgtcctgggatgccttgtccaggagaagataaatccatctaccgtagaggtgcacgccgctggagaaagctttattgtgccaatggccacactttccaagccaagcgtttcaacaggcgtgctcactgtgccatctgcacagaccgaatatggggacttggacgccaaggatataagtgcatcaactgcaaactcttggttcataagaagtgccataaactcgtcacaattgaatgtgggcggcattctttgccacaggaaccagtgatgcccatggatcagtcatccatgcattctgaccatgcacagacagtaattccatataatccttcaagtcatgagagtttggatcaagttggtgaagaaaaagaggcaatgaacaccagggaaagtggcaaagcttcatccagtctaggtcttcaggattttgatttgctccgggtaataggaagaggaagttatgccaaagtactgttggttcgattaaaaaaaacagatcgtatttatgcaatgaaagttgtgaaaaaagagcttgttaatgatgatgaggatattgattgggtacagacagagaagcatgtgtttgagcaggcatccaatcatcctttccttgttgggctgcattcttgctttcagacagaaagcagattgttctttgttatagagtatgtaaatggaggagacctaatgtttcatatgcagcgacaaagaaaacttcctgaagaacatgccagattttactctgcagaaatcagtctagcattaaattatcttcatgagcgagggataatttatagagatttgaaactggacaatgtattactggactctgaaggccacattaaactcactgactacggcatgtgtaaggaaggattacggccaggagatacaaccagcactttctgtggtactcctaattacattgctcctgaaattttaagaggagaagattatggtttcagtgttgactggtgggctcttggagtgctcatgtttgagatgatggcaggaaggtctccatttgatattgttgggagctccgataaccctgaccagaacacagaggattatctcttccaagttattttggaaaaacaaattcgcataccacgttctctgtctgtaaaagctgcaagtgttctgaagagttttcttaataaggaccctaaggaacgattgggttgtcatcctcaaacaggatttgctgatattcagggacacccgttcttccgaaatgttgattgggatatgatggagcaaaaacaggtggtacctccctttaaaccaaatatttctggggaatttggtttggacaactttgattctcagtttactaatgaacctgtccagctcactccagatgacgatgacattgtgaggaagattgatcagtctgaatttgaaggttttgagtatatcaatcctcttttgatgtctgcagaagaatgtgtctgatcctcatttttcaaccatgtattctactcatgttgccatttaatgcatggataaacttgctgcaagcctggatacaattaaccattttatatttgccacctacaaaaaaacacccaatatcttctcttgtagactatatgaatcaattattacatctgttttactatgaaaaaaaaattaatactactagcttccagacaatcatgtcaaaatttagttgaactggtttttcagtttttaaaaggcctacagatgagtaatgaagttaccttttttgtttaaaaaaaaaaaag

SEQ ID NO: 812 - DNA, 3742 bp, Homo sapiens
  ref <308>: DATABASE ACCESSION NUMBER: NM_002742
  ref <309>: DATABASE ENTRY DATE: 2001-06-18
gaattccttctctcctcctcctcgcccttctcctcgccctcctcctcctcctcgccctcccctcccgatcctcatccccttgccctcccccagcccagggacttttccggaaagtttttattttccgtctgggctctcggagaaagaagctcctggctcagcggctgcaaaactttcctgctgccgcgccgccagcccccgccctccgctgcccggccctgcgccccgccgagcgatgagcgcccctccggtcctgcggccgcccagtccgctgctgcccgtggcggcggcagctgccgcagcggccgccgcactggtcccagggtccgggcccgggcccgcgccgttcttggctcctgtcgcggccccggtcgggggcatctcgttccatctgcagatcggcctgagccgtgagccggtgctgctgctgcaggactcgtccggggactacagcctggcgcacgtccgcgagatggcttgctccattgtcgaccagaagttccctgaatgtggtttctacggaatgtatgataagatcctgctttttcgccatgaccctacctctgaaaacatccttcagctggtgaaagcggccagtgatatccaggaaggcgatcttattgaagtggtcttgtcacgttccgccacctttgaagactttcagattcgtccccacgctctctttgttcattcatacagagctccagctttctgtgatcactgtggagaaatgctgtgggggctggtacgtcaaggtcttaaatgtgaagggtgtggtctgaattaccataagagatgtgcatttaaaatacccaacaattgcagcggtgtgaggcggagaaggctctcaaacgtttccctcactggggtcagcaccatccgcacatcatctgctgaactctctacaagtgcccctgatgagccccttctgcaaaaatcaccatcagagtcgtttattggtcgagagaagaggtcaaattctcaatcatacattggacgaccaattcaccttgacaagattttgatgtctaaagttaaagtgccgcacacatttgtcatccactcctacacccggcccacagtgtgccagtactgcaagaagcttctgaaggggcttttcaggcagggcttgcagtgcaaagattgcagattcaactgccataaacgttgtgcaccgaaagtaccaaacaactgccttggcgaagtgaccattaatggagatttgcttagccctggggcagagtctgatgtggtcatggaagaagggagtgatgacaatgatagtgaaaggaacagtgggctcatggatgatatggaagaagcaatggtccaagatgcagagatggcaatggcagagtgccagaacgacagtggcgagatgcaagatccagacccagaccacgaggacgccaacagaaccatcagtccatcaacaagcaacaatatcccactcatgagggtagtgcagtctgtcaaacacacgaagaggaaaagcagcacagtcatgaaagaaggatggatggtccactacaccagcaaggacacgctgcggaaacggcactattggagattggatagcaaatgtattaccctctttcagaatgacacaggaagcaggtactacaaggaaattcctttatctgaaattttgtctctggaaccagtaaaaacttcagctttaattcctaatggggccaatcctcattgtttcgaaatcactacggcaaatgtagtgtattatgtgggagaaaatgtggtcaatccttccagcccatcaccaaataacagtgttctcaccagtggcgttggtgcagatgtggccaggatgtgggagatagccatccagcatgcccttatgcccgtcattcccaagggctcctccgtgggtacaggaaccaacttgcacagagatatctctgtgagtatttcagtatcaaattgccagattcaagaaaatgtggacatcagcacagtatatcagatttttcctgatgaagtactgggttctggacagtttggaattgtttatggaggaaaacatcgtaaaacaggaagagatgtagctattaaaatcattgacaaattacgatttccaacaaaacaagaaagccagcttcgtaatgaggttgcaattctacagaaccttcatcaccctggtgttgtaaatttggagtgtatgtttgagacgcctgaaagagtgtttgttgttatggaaaaactccatggagacatgctggaaatgatcttgtcaagtgaaaagggcaggttgccagagcacataacgaagtttttaattactcagatactcgtggctttgcggcaccttcattttaaaaatatcgttcactgtgacctcaaaccagaaaatgtgttgctagcctcagctgatccttttcctcaggtgaaactttgtgattttggttttgcccggatcattggagagaagtctttccggaggtcagtggtgggtacccccgcttacctggctcctgaggtcctaaggaacaagggctacaatcgctctctagacatgtggtctgttggggtcatcatctatgtaagcctaagcggcacattcccatttaatgaagatgaagacatacacgaccaaattcagaatgcagctttcatgtatccaccaaatccctggaaggaaatatctcatgaagccattgatcttatcaacaatttgctgcaagtaaaaatgagaaagcgctacagtgtggataagaccttgagccacccttggctacaggactatcagacctggttagatttgcgagagctggaatgcaaaatcggggagcgctacatcacccatgaaagtgatgacctgaggtgggagaagtatgcaggcgagcagcggctgcagtaccccacacacctgatcaatccaagtgctagccacagtgacactcctgagactgaagaaacagaaatgaaagccctcggtgagcgtgtcagcatcctctgagttccatctcctataatctgtcaaaacactgtggaactaataaatacatacggtcaggtttaacatttgccttgcagaactgccattattttctgtcagatgagaacaaagctgttaaactgttagcactgttgatgtatctgagttgccaagacaaatcaacagaagcatttgtattttgtgtgaccaactgtgttgtattaacaaaagttccctgaaacacgaaacttgttattgtgaatgattcatgttatatttaatgcattaaacctgtctccactgtgcctttgcaaatcagtgtttttcttactggagcttcattttggtaagagacagaatgtatctgtgaagtagttctgtttggtgtgtcccattggtgttgtcattgtaaacaaactcttgaagagtcgattatttccagtgttctatgaacaactccaaaacccatgtgggaaaaaaatgaatgaggagggtagggaataaaatcctaagacacaaatgcatgaacaagttttaatgtatagttttgaatcctttgcctgcctggtgtgcctcagtatatttaaactcaagacaatgcacctagctgtgcaagacctagtgctcttaagcctaaatgccttagaaatgtaaactgccatatataacagatacatttccctctttcttataatactctgttgtactatggaaaatcagctgctcagcaacctttcacctttgtgtatttttcaataataaaaaatattcttgtcaaaaaaaaaaaaa

SEQ ID NO: 813 - DNA, 3920 bp, Homo sapiens
  ref <308>: DATABASE ACCESSION NUMBER: NM_002748
  ref <309>: DATABASE ENTRY DATE: 2001-06-18
caacggaaatagtgcttaccagcaccttagaatgatgctgctcaggaccagtccaacactgaatgtatctgcactgtgaggagaatgttcatagaagcctgttgtgtgcatatttattcactttttgttaaatgttaaatcgtttagcacggtaatctgagtgcacagtatgtcatttcattccgttggagtttcttgttttcgttaaatgtctgcagagttgctgcccctttcttgaactatgagtactgcaatctttttaattctcaatatgaatagagctttttgagctttaaatctaaggggaactcgacaggcctgtttggcatatgcaatgaacatcaagaaaccatcttgctgtggaagcataattatttttcttctccctttttgaaagatctttccttttgatgccagttttcttccttgtttacacaagttcaatttgaaaggaaaaggcaatagtaagggtttcaaaatggcagagaaatttgaaagtctcatgaacattcatggttttgatctgggttctaggtatatggacttaaaaccattgggttgtggaggcaatggcttggttttttctgctgtagacaatgactgtgacaaaagagtagccatcaagaaaattgtccttactgatccccagagtgtcaaacatgctctacgtgaaatcaaaattattagaagacttgaccatgataacattgtgaaagtgtttgagattcttggtcccagtggaagccaattaacagacgatgtgggctctcttacggaactgaacagtgtttacattgttcaggagtacatggagacagacttggctaatgtgctggagcagggccctttactggaagagcatgccaggcttttcatgtatcagctgctacgggggctcaagtatattcactctgcaaatgtactgcacagagatctcaaaccagctaatcttttcattaatacggaagacttggtgctgaagataggtgactttggtcttgcacggatcatggatcctcattattcccataagggtcatctttctgaaggattggttactaaatggtacagatctccacgtcttttactttctcctaataattatactaaagccattgacatgtgggctgcaggctgcatctttgctgaaatgctgactggtaaaaccctttttgcaggtgcacatgaacttgaacagatgcagctgattttagaatctattcctgttgtacatgaggaagatcgtcaggagcttctcagcgtaattccagtttacattagaaatgacatgactgagccacacaaacctttaactcagctgcttccaggaattagtcgagaagcactggatttcctggaacaaattttgacatttagccccatggatcggttaacagcagaagaagcactctcccatccttacatgagcatatattcttttccaatggatgagccaatttcaagccatccttttcatattgaagatgaagttgatgatattttgcttatggatgaaactcacagtcacatttataactgggaaaggtatcatgattgtcagttttcagagcatgattggcctgtacataacaactttgatattgatgaagttcagcttgatccaagagctctgtccgatgtcactgatgaagaagaagtacaagttgatccccgaaaatatttggatggagatcgggaaaagtatctggaggatcctgcttttgataccaattactctactgagccttgttggcaatactcagatcatcatgaaaacaaatattgtgatctggagtgtagccatacttgtaactacaaaacgaggtcatcatcatatttagataacttagtttggagagagagtgaagttaaccattactatgaacccaagcttattatagatctttccaattggaaagaacaaagcaaagaaaaatctgataagaaaggcaaatcaaaatgtgaaaggaatggattggttaaagcccagatagcgctagaggaagcatcacagcaactggctggaaaagaaagggaaaagaatcagggatttgattttgattcctttattgcaggaactattcagcttagttcccagcatgagcctactgatgttgttgataaattaaatgacttgaatagctcagtgtcccaactagaattgaaaagtttgatatcaaagtcagtaagccaagaaaaacaggaaaaaggaatggcaaatctggctcaattagaagccttgtaccagtcttcttgggacagccagtttgtgagtggtggggaggactgttttttcataaatcagttttgtgaggtaaggaaggatgaacaagttgagaaggaaaacacttacactagttacttggacaagttctttagcaggaaagaagatactgaaatgctagaaactgagccagtagaggatgggaagcttggggagagaggacatgaggaaggatttctgaacaacagtggggagttcctctttaacaagcagctcgagtccataggcatcccacagtttcacagtccagttgggtcaccacttaagtcaatacaggccacattaacaccttctgctatgaaatcttcccctcaaattcctcatcaaacatacagcagcattctgaaacatctgaactaaaacactcagcagacatttatctttgtattcttcatgaaatgtgttttgtcttttttttttattactagtgtttaagtcattttttacttgaatcagatggtgtcatttagtaaggattttatgagttcttgttttttaaaatccagactttctttttctacatgtgagatagttttcattttaactggcatgtcatttgcacacaaaaataaagactagagcaaaataatgcaacgcaggaggagaaaagaaatgcactaagacaagaacattctctcatagaacattgatctgttttacaggaaacaaaccttgccttgaaatttacacagtgagactgtacataattgcatgaaaatagctatttttttcctaagacatttttcattcatgaatattttcaagtttttcatactgtacacatttcttaaaacacatgataccagcagcaactgaaaatgaatgccgaatttggtacacatgtgttatctacctcaaggtaacaagagtatgtggcaaaacatataccacccatagtgcttcacaaaatgcacttctatttagccagcgtttattgtagtaaactattcttaataaaactcactcactgtttataaatgttctggtatgcattctttatagtgaagtgttaatacatcacatcttatttattttagcaaatcagtatattttctgtatttaattataaaaaattaacttagtttttaaaatttatttgcaaatatactttttccatttggcactatggtttgttgcctacctagctgcatctataatgtcagcttatcctaaggctgtccacgtacttaatttacttaagtgttcattttaagtaacgtgctcactgtgtataggaatttgtattttggaggtgcttgatctatctacaaaagaaaaaattaattaggaattactttattataaaatgctcctagaagtcttaattgtgtttattttttaaaaaaacaaatgttagacttgtgtgcatggaagtaattaaggtacatcattattgtagtttgaaagttgtacatgataagacattttgtttttactgtatgtttttactgaatgatctattccccatcccaaggcaagcatgaataaaattaggttaaacgtagcatgtggcatcgcagtctcttagaatttgtttcatctattttattttattgaatactgtctgtatctttggttatcctgtttgaagaaaaaggacaaataaaacatggccagcaaatacaaaaaaaaaaaa

SEQ ID NO: 814 - DNA, 1506 bp, Homo sapiens
  ref <308>: DATABASE ACCESSION NUMBER: NM_002774
  ref <309>: DATABASE ENTRY DATE: 2001-06-18
aggcggacaaagcccgattgttcctgggccctttccccatcgcgcctgggcctgctccccagcccggggcaggggcgggggccagtgtggtgacacacgctgtagctgtctccccggctggctggctcgctctctcctggggacacagaggtcggcaggcagcacacagagggacctacgggcagctgttccttcccccgactcaagaatccccggaggcccggaggcctgcagcaggagcggccatgaagaagctgatggtggtgctgagtctgattgctgcagcctgggcagaggagcagaataagttggtgcatggcggaccctgcgacaagacatctcacccctaccaagctgccctctacacctcgggccacttgctctgtggtggggtccttatccatccactgtgggtcctcacagctgcccactgcaaaaaaccgaatcttcaggtcttcctggggaagcataaccttcggcaaagggagagttcccaggagcagagttctgttgtccgggctgtgatccaccctgactatgatgccgccagccatgaccaggacatcatgctgttgcgcctggcacgcccagccaaactctctgaactcatccagccccttcccctggagagggactgctcagccaacaccaccagctgccacatcctgggctggggcaagacagcagatggtgatttccctgacaccatccagtgtgcatacatccacctggtgtcccgtgaggagtgtgagcatgcctaccctggccagatcacccagaacatgttgtgtgctggggatgagaagtacgggaaggattcctgccagggtgattctgggggtccgctggtatgtggagaccacctccgaggccttgtgtcatggggtaacatcccctgtggatcaaaggagaagccaggagtctacaccaacgtctgcagatacacgaactggatccaaaaaaccattcaggccaagtgaccctgacatgtgacatctacctcccgacctaccaccccactggctggttccagaacgtctctcacctagaccttgcctcccctcctctcctgcccagctctgaccctgatgcttaataaacgcagcgacgtgagggtcctgattctccctggttttaccccagctccatccttgcatcactggggaggacgtgatgagtgaggacttgggtcctcggtcttacccccaccactaagagaatacaggaaaatcccttctaggcatctcctctccccaacccttccacacgtttgatttcttcctgcagaggcccagccacgtgtctggaatcccagctccgctgcttactgtcggtgtccccttgggatgtacctttcttcactgcagatttctcacctgtaagatgaagataaggatgatacagtctccatcaggcagtggctgttggaaagatttaagatttcacacctatgacatacatgggatagcacctgggccgccatgcactcaataaagaatgtatttt

SEQ ID NO: 815 - DNA, 2036 bp, Homo sapiens
  ref <308>: DATABASE ACCESSION NUMBER: NM_002775
  ref <309>: DATABASE ENTRY DATE: 2001-06-18
ccggccctcgccctgtccgccgccaccgccgccgccgccagagtcgccatgcagatcccgcgcgccgctcttctcccgctgctgctgctgctgctggcggcgcccgcctcggcgcagctgtcccgggccggccgctcggcgcctttggccgccgggtgcccagaccgctgcgagccggcgcgctgcccgccgcagccggagcactgcgagggcggccgggcccgggacgcgtgcggctgctgcgaggtgtgcggcgcgcccgagggcgccgcgtgcggcctgcaggagggcccgtgcggcgaggggctgcagtgcgtggtgcccttcggggtgccagcctcggccacggtgcggcggcgcgcgcaggccggcctctgtgtgtgcgccagcagcgagccggtgtgcggcagcgacgccaacacctacgccaacctgtgccagctgcgcgccgccagccgccgctccgagaggctgcaccggccgccggtcatcgtcctgcagcgcggagcctgcggccaagggcaggaagatcccaacagtttgcgccataaatataactttatcgcggacgtggtggagaagatcgcccctgccgtggttcatatcgaattgtttcgcaagcttccgttttctaaacgagaggtgccggtggctagtgggtctgggtttattgtgtcggaagatggactgatcgtgacaaatgcccacgtggtgaccaacaagcaccgggtcaaagttgagctgaagaacggtgccacttacgaagccaaaatcaaggatgtggatgagaaagcagacatcgcactcatcaaaattgaccaccagggcaagctgcctgtcctgctgcttggccgctcctcagagctgcggccgggagagttcgtggtcgccatcggaagcccgttttcccttcaaaacacagtcaccaccgggatcgtgagcaccacccagcgaggcggcaaagagctggggctccgcaactcagacatggactacatccagaccgacgccatcatcaactatggaaactcgggaggcccgttagtaaacctggacggtgaagtgattggaattaacactttgaaagtgacagctggaatctcctttgcaatcccatctgataagattaaaaagttcctcacggagtcccatgaccgacaggccaaaggaaaagccatcaccaagaagaagtatattggtatccgaatgatgtcactcacgtccagcaaagccaaagagctgaaggaccggcaccgggacttcccagacgtgatctcaggagcgtatataattgaagtaattcctgataccccagcagaagctggtggtctcaaggaaaacgacgtcataatcagcatcaatggacagtccgtggtctccgccaatgatgtcagcgacgtcattaaaagggaaagcaccctgaacatggtggtccgcaggggtaatgaagatatcatgatcacagtgattcccgaagaaattgacccataggcagaggcatgagctggacttcatgtttccctcaaagactctcccgtggatgacggatgaggactctgggctgctggaataggacactcaagacttttgactgccattttgtttgttcagtggagactccctggccaacagaatccttcttgatagtttgcaggcaaaacaaatgtaatgttgcagatccgcaggcagaagctctgcccttctgtatcctatgtatgcagtgtgctttttcttgccagcttgggccattcttgcttagacagtcagcatttgtctcctcctttaactgagtcatcatcttagtccaactaatgcagtcgatacaatgcgtagatagaagaagccccacgggagccaggatgggactggtcgtgtttgtgcttttctccaagtcagcacccaaaggtcaatgcacagagaccccgggtgggtgagcgctggcttctcaaacggccgaagttgcctcttttaggaatctctttggaattgggagcacgatgactctgagtttgagctattaaagtacttcttacaaa

SEQ ID NO: 816 - DNA, 1454 bp, Homo sapiens
  ref <308>: DATABASE ACCESSION NUMBER: NM_002776
  ref <309>: DATABASE ENTRY DATE: 2001-06-18
accagcggcagaccacaggcagggcagaggcacgtctgggtcccctccctccttcctatcggcgactcccagatcctggccatgagagctccgcacctccacctctccgccgcctctggcgcccgggctctggcgaagctgctgccgctgctgatggcgcaactctgggccgcagaggcggcgctgctcccccaaaacgacacgcgcttggaccccgaagcctatggcgccccgtgcgcgcgcggctcgcagccctggcaggtctcgctcttcaacggcctctcgttccactgcgcgggtgtcctggtggaccagagttgggtgctgacggccgcgcactgcggaaacaagccactgtgggctcgagtaggggatgatcacctgctgcttcttcagggcgagcagctccgccggacgactcgctctgttgtccatcccaagtaccaccagggctcaggccccatcctgccaaggcgaacggatgagcacgatctcatgttgctaaagctggccaggcccgtagtgccggggccccgcgtccgggccctgcagcttccctaccgctgtgctcagcccggagaccagtgccaggttgctggctggggcaccacggccgcccggagagtgaagtacaacaagggcctgacctgctccagcatcactatcctgagccctaaagagtgtgaggtcttctaccctggcgtggtcaccaacaacatgatatgtgctggactggaccggggccaggacccttgccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttactggggtcacccaacctgacttcctctgccactccccgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatgtgattgtcatgtaaggcttaacacagtgggtggtgagttctgactaaaggttacctgttgtcgtgaaaaaaaaaaaaaa

SEQ ID NO: 817 - DNA, 1078 bp, Homo sapiens
  ref <308>: DATABASE ACCESSION NUMBER: NM_002789
  ref <309>: DATABASE ENTRY DATE: 2001-06-18
ccgtggacatctcaggtcttcagggtcttccatctggaactatataaagttcagaaaacatgtctcgaagatatgactccaggaccactatattttctccagaaggtcgcttataccaagttgaatatgccatggaagctattggacatgcaggcacctgtttgggaattttagcaaatgatggtgttttgcttgcagcagagagacgcaacatccacaagcttcttgatgaagtctttttttctgaaaaaatttataaactcaatgaggacatggcttgcagtgtggcaggcataacttctgatgctaatgttctgactaatgaactaaggctcattgctcaaaggtatttattacagtatcaggagccaataccttgtgagcagttggttacagcactgtgtgatatcaaacaagcttatacacaatttggaggaaaacgtccctttggtgtttcattgctgtacattggctgggataagcactatggctttcagctctatcagagtgaccctagtggaaattacgggggatggaaggccacatgcattggaaataatagcgctgcagctgtgtcaatgttgaaacaagactataaagaaggagaaatgaccttgaagtcagcacttgctttagctatcaaagtactaaataagaccatggatgttagtaaactctctgctgaaaaagtggaaattgcaacactaacaagagagaatggaaagacagtaatcagagttctcaaacaaaaagaagtggagcagttgatcaaaaaacatgaggaagaagaagccaaagctgagcgtgagaagaaagaaaaagaacagaaagaaaaggataaatagaatcagagattttattactcatttggggcaccatttcagtgtaaaagcagtcctactcttccacactaggaaggctttactttttttaactggtgcagtgggaaaataggacattacatactgaattgggtccttgtcatttctgtccaattgaatactttattgtaacgatgatggttacccttcatggacgtcttaatcttccacacacatcccctttttttggaataaaa

SEQ ID NO: 818 - DNA, 762 bp, Homo sapiens
  ref <308>: DATABASE ACCESSION NUMBER: NM_002794
  ref <309>: DATABASE ENTRY DATE: 2001-06-18
cggacctgcagccctggccttccgccaccatggagtacctcatcggtatccaaggccccgactatgttcttgtcgcctccgaccgggtggccgccagcaatattgtccagatgaaggacgatcatgacaagatgtttaagatgagtgaaaagatattactcctgtgtgttggagaggctggagacactgtacagtttgcagaatatattcagaaaaacgtgcaactttataagatgcgaaatggatatgaattgtctcccacggcagcagctaacttcacacgccgaaacctggctgactgtcttcggagtcggaccccatatcatgtgaacctcctcctggctggctatgatgagcatgaagggccagcgctgtattacatggactacctggcagccttggccaaggccccttttgcagcccacggctatggtgccttcctgactctcagtatcctcgaccgatactacacaccgactatctcacgtgagagggcagtggaactccttaggaaatgtctggaggagctccagaaacgcttcatcctgaatctgccaaccttcagtgttcgaatcattgacaaaaatggcatccatgacctggataacatttccttccccaaacagggctcctaacatcatgtcctccctcccacttgccagggaacttttttttgatgggctcctttatttttttctactcttttcaggcgcactcttgataaatggttaattcagaataaaggtgactatggatataatt

SEQ ID NO: 819 - DNA, 925 bp, Homo sapiens
  ref <308>: DATABASE ACCESSION NUMBER: NM_002796
  ref <309>: DATABASE ENTRY DATE: 2001-06-18
ttttttctgctaccgtgactaagatggaagcgtttttggggtcgcggtccggactttgggcggggggtccggccccaggacagttttaccgcattccgtccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaaccgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatg

SEQ ID NO: 820 - DNA, 724 bp, Homo sapiens
  ref <308>: DATABASE ACCESSION NUMBER: NM_002800
  ref <309>: DATABASE ENTRY DATE: 2001-06-18
ggaaaccagtgccccaggcggcgaaggagagcggtgccttgcagggatgctgcgggcgggagcaccaaccggggacttaccccgggcgggagaagtccacaccgggaccaccatcatggcagtggagtttgacgggggcgttgtgatgggttctgattcccgagtgtctgcaggcgaggcggtggtgaaccgagtgtttgacaagctgtccccgctgcacgagcgcatctactgtgcactctctggttcagctgctgatgcccaagccgtggccgacatggccgcctaccagctggagctccatgggatagaactggaggaacctccacttgttttggctgctgcaaatgtggtgagaaatatcagctataaatatcgagaggacttgtctgcacatctcatggtagctggctgggaccaacgtgaaggaggtcaggtatatggaaccctgggaggaatgctgactcgacagccttttgccattggtggctccggcagcacctttatctatggttatgtggatgcagcatataagccaggcatgtctcccgaggagtgcaggcgcttcaccacagacgctattgctctggccatgagccgggatggctcaagcgggggtgtcatctacctggtcactattacagctgccggtgtggaccatcgagtcatcttgggcaatgaactgccaaaattctatgatgagtgaaccttccccagacttctc

SEQ ID NO: 821 - DNA, 996 bp, Homo sapiens
  ref <308>: DATABASE ACCESSION NUMBER: NM_002801
  ref <309>: DATABASE ENTRY DATE: 2001-06-18
agcagaggactttttagctgctcactggccccgcttgtctgaccgactcatccgcccgcgacccctaatcccctctgcctgccccaagatgctgaagccagccctggagccccgagggggcttctccttcgagaactgccaaagaaatgcatcattggaacgcgtcctcccggggctcaaggtccctcacgcacgcaagaccgggaccaccatcgcgggcctggtgttccaagacggggtcattctgggcgccgatacgcgagccactaacgattcggtcgtggcggacaagagctgcgagaagatccacttcatcgcccccaaaatctactgctgtggggctggagtagccgcggacgccgagatgaccacacggatggtggcgtccaagatggagctacacgcgttatctacgggccgcgagccccgcgtggccacggtcactcgcatcctgcgccagacgctcttcaggtaccagggccacgtgggtgcatcgctgatcgtgggcggcgtagacctgactggaccgcagctctacggcgtgcatccccatggctcctacagccgtctgcccttcacagccctgggctctggtcaggacgcggccctggcggtgctagaagaccggttccagccgaacatgacgctggaggctgctcaggggctgctggtggaagccgtcaccgccgggatcttgggtgacctgggctccgggggcaatgtggacgcatgtgtgatcacaaagactggcgccaagctgctgcggacactgagctcacccacagagcccgtgaagaggtctggccgctaccactttgtgcctggaaccacagctgtcctgacccagacagtgaagccactaaccctggagctagtggaggaaactgtgcaggctatggaggtggagtaagctgaggcttagagcttggaacaagggggaataaacccagaaaatacagttaaaaaaaaaaaaaacaaaaaaaaaaaaaaaaaaaa

SEQ ID NO: 822 - DNA, 2828 bp, Homo sapiens
  ref <308>: DATABASE ACCESSION NUMBER: NM_002808
  ref <309>: DATABASE ENTRY DATE: 2001-06-18
ttccggcggcacggacgagaagccgagcggcaaggggcggcgggatgccggggacaaggacaaagaactggagctgtctgaagaggataaacagcttcaagatgaactggtgatgctcgtggaacgactaggggagaaggatacatccctgtatcgaccagcgctggaggaattgcgaaggcagattcgttcttctacaacttccatgacttcagtgcccaagcctctcaaatttctgcgtccacactatggcaaactgaaggaaatctatgagaacatggcccctggggagaataagcgttttgctgctgacatcatctccgttttggccatgaccatgagtggggagcgtgagtgcctcaagtatcggctagtgggctcccaggaggaattggcatcatggggtcatgagtatgtcaggcatctggcaggagaagtggctaaggagtggcaggagctggatgacgcagagaaggtccagcgggagcctctgctcactctggtgaaggaaatcgtcccctataacatggcccacaatgcagagcatgaggcttgcgacctgcttatggaaattgagcaggtggacatgctggagaaggacattgatgaaaatgcatctgcaaaggtctgcctttatctcaccagttgtgtaaattacgtgcctgagcctgagaactcagccctactgcgttgtgccctgggtgtgttccgaaagtttagccgcttccctgaagctctgagattggcattgatgctcaatgacatggagttggtagaagactcttcctcctgcaaggatgtggtagtacagaaacagatggcattcatgctaggccggcatggggtgttcctggagctgagtgaagatgtcgaggagtatgaggacctgacagagatcatgtccaatgtacagctcaacagcaacttcttggccttagctcgggagctggacatcatggagcccaaggtgcctgatgacatctacaaaacccacctagagaacaacaggtttgggggcagtggctctcaggtggactctgcccgcatgaacctggcctcctcttttgtgaatggctttgtgaatgcagcttttggccaagacaagctgctaacagatgatggcaacaaatggctttacaagaacaaggaccacggaatgttgagtgcagctgcatctcttgggatgattctgctgtgggatgtggatggtggcctcacccagattgacaagtacctgtactcctctgaggactacattaagtcaggagctcttcttgcctgtggcatagtgaactctggggtccggaatgagtgtgaccctgctctggcactgctctcagactatgttctccacaacagcaacaccatgagacttggttccatctttgggctaggcttggcttatgctggctcaaatcgtgaagatgtcctaacactgctgctgcctgtgatgggagattcaaagtccagcatggaggtggcaggtgtcacagctttagcctgtggaatgatagcagtagggtcctgcaatggagatgtaacttccactatccttcagaccatcatggagaagtcagagactgagctcaaggatacttatgctcgttggcttcctcttggactgggtctcaaccacctggggaagggtgaggccatcgaggcaatcctggctgcactggaggttgtgtcagagccattccgcagttttgccaacacactggtggatgtgtgtgcatatgcaggctctgggaatgtgctgaaggtgcagcagctgctccacatttgtagcgaacactttgactccaaagagaaggaggaagacaaagacaagaaggaaaagaaagacaaggacaagaaggaagcccctgctgacatgggagcacatcagggagtggctgttctggggattgcccttattgctatgggggaggagattggtgcagagatggcattacgaacctttggccacttgctgagatatggggagcctacactccggagggctgtacctttagcactggccctcatctctgtttcaaatccacgactcaacatcctggataccctaagcaaattctctcatgatgctgatccagaagtttcctataactccatttttgccatgggcatgggcatggtgggcagtggtaccaataatgcccgtctggctgcaatgctgcgccagttagctcaatatcatgccaaggacccaaacaacctcttcatggtgcgcttggcacagggcctgacacatttagggaagggcacccttaccctctgcccctaccacagcgaccggcagcttatgagccaggtggccgtggctggactgctcactgtgcttgtctctttcctggatgttcgaaacattattctaggcaaatcacactatgtattgtatgggctggtggctgccatgcagccccgaatgctggttacgtttgatgaggagctgcggccattgccagtgtctgtccgtgtgggccaggcagtggatgtggtgggccaggctggcaagccgaagactatcacagggttccagacgcatacaaccccagtgttgttggcccacggggaacgggcagaattggccactgaggagtttcttcctgttacccccattctggaaggttttgttatcttcggaagaaccccaattatgatctctaagtgaccaccaggggctctgaactgtagctgatgttatcagcaggccatgcatcctgctgccaagggtggacacggctgcagacttctgggggaattgtcgcctcctgctcttttgttactgagtgagataaggttgttcaataaagacttttatcccc

SEQ ID NO: 823 - DNA, 1602 bp, Homo sapiens
  ref <308>: DATABASE ACCESSION NUMBER: NM_002811
  ref <309>: DATABASE ENTRY DATE: 2001-06-18
ggaaaaagggtaccggtgaccgctactgctgccggtgtttgcgtgtggcagggagccagtcctggcgagcggggtgtgtcgcgatgccggagctggcagtgcagaaggtggtggtccaccccctggtgctgctcagtgtggtggatcatttcaaccgaatcgtcaaggttggaaaccagaagcgtgtagttggtgtgcttttggggtcatggcaaaagaaagtacttgatgtatcgaacagttttgcagttccttttgatgaagatgacaaagacgattctgtatggtttttagaccatgattatttggaaaacatgtatggaatgtttaagaaagtcaatgccagggaaagaatagttggctggtaccacacaggccctaaactacacaagaatgacattgccatcaacgaactcatgaaaagatactgtcctaattccgtattggtcatcattgatgtgaagccgaaggacctagggctgcctacagaagcgtacatttcagtggaagaagaccaagatgatggaactccaacctcgaaaacatttgaacacgtgaccagtgaaattggagcagaggaagctgaggaagttggagttgaacacttgttacgagatatcaaagacacgacggtgggcactctgtcccagcggatcacaaaccaggtccatggtttgaagggactgaactccaagcttctggatatcaggagctacctggaaaaagtcggcacaggcaagctgcccatcaaccaccagatcatctaccagctgcaggacgtcttcaacctgctgccagatgtcagcctgcaggagttcgtcaaggccttttacctgaagaccaatgaccagatggtggtagtgtacttggcctcgctgatccgttccgtggtcgccctgcacaacctcatcaacaacaagattgccaaccgggatgcagagaagaaagaagggcaggagaaagaagagagcaaaaaggataggaaagaggacaaggagaaagataaagataaggaaaagagtgatgtaaagaaagaggagaaaaaggagaaaaagtaaaacatgtattaaatagcttttttactttgtaaattaaaatcttacaaactaaatcagtgtgctgctagagggttctttttcacttgacatgcttattagaaagctgacccaacaagagctctctgcctccggtcactcttgctgtggtgctacgtggaagtgaatggagactgatctcaaatctgaactgcagctttccctcctgtgagttggggaaatgatagtcaactcagccttcagattgtatgagaaaaatgaagagaagccaccaaatattttggtactcttcattcatttatctctaaaaccaggagttgaattttcctcatcttgaaagactcttggggtctgtttctggtattttacaaaattgctaagtggaatgcatgaattgcattatgttctctggtaacacgtagagttcagacccttctgaactctgttgataataccacaccatgttctggacccatagctctggcatcctcaggggttgtgatccagctccatatattgtttaccttcaaagatacaattaaataac

SEQ ID NO: 824 - DNA, 4187 bp, Homo sapiens
  ref <308>: DATABASE ACCESSION NUMBER: NM_002821
  ref <309>: DATABASE ENTRY DATE: 2001-06-18
aactcccgcctcgggacgcctcggggtcgggctccggctgcggctgctgctgcggcgcccgcgctccggtgcgtccgcctcctgtgcccgccgcggagcagtctgcggcccgccgtgcgccctcagctccttttcctgagcccgccgcgatgggagctgcgcggggatccccggccagaccccgccggttgcctctgctcagcgtcctgctgctgccgctgctgggcggtacccagacagccattgtcttcatcaagcagccgtcctcccaggatgcactgcaggggcgccgggcgctgcttcgctgtgaggttgaggctccgggcccggtacatgtgtactggctgctcgatggggcccctgtccaggacacggagcggcgtttcgcccagggcagcagcctgagctttgcagctgtggaccggctgcaggactctggcaccttccagtgtgtggctcgggatgatgtcactggagaagaagcccgcagtgccaacgcctccttcaacatcaaatggattgaggcaggtcctgtggtcctgaagcatccagcctcggaagctgagatccagccacagacccaggtcacacttcgttgccacattgatgggcaccctcggcccacctaccaatggttccgagatgggacccccctttctgatggtcagagcaaccacacagtcagcagcaaggagcggaacctgacgctccggccagctggtcctgagcatagtgggctgtattcctgctgcgcccacagtgcttttggccaggcttgcagcagccagaacttcaccttgagcattgctgatgaaagctttgccagggtggtgctggcaccccaggacgtggtagtagcgaggtatgaggaggccatgttccattgccagttctcagcccagccacccccgagcctgcagtggctctttgaggatgagactcccatcactaaccgcagtcgccccccacacctccgcagagccacagtgtttgccaacgggtctctgctgctgacccaggtccggccacgcaatgcagggatctaccgctgcattggccaggggcagaggggcccacccatcatcctggaagccacacttcacctagcagagattgaagacatgccgctatttgagccacgggtgtttacagctggcagcgaggagcgtgtgacctgccttccccccaagggtctgccagagcccagcgtgtggtgggagcacgcgggagtccggctgcccacccatggcagggtctaccagaagggccacgagctggtgttggccaatattgctgaaagtgatgctggtgtctacacctgccacgcggccaacctggctggtcagcggagacaggatgtcaacatcactgtggccactgtgccctcctggctgaagaagccccaagacagccagctggaggagggcaaacccggctacttggattgcctgacccaggccacaccaaaacctacagttgtctggtacagaaaccagatgctcatctcagaggactcacggttcgaggtcttcaagaatgggaccttgcgcatcaacagcgtggaggtgtatgatgggacatggtaccgttgtatgagcagcaccccagccggcagcatcgaggcgcaagcccgtgtccaagtgctggaaaagctcaagttcacaccaccaccccagccacagcagtgcatggagtttgacaaggaggccacggtgccctgttcagccacaggccgagagaagcccactattaagtgggaacgggcagatgggagcagcctcccagagtgggtgacagacaacgctgggaccctgcattttgcccgggtgactcgagatgacgctggcaactacacttgcattgcctccaacgggccgcagggccagattcgtgcccatgtccagctcactgtggcagtttttatcaccttcaaagtggaaccagagcgtacgactgtgtaccagggccacacagccctactgcagtgcgaggcccagggggaccccaagccgctgattcagtggaaaggcaaggaccgcatcctggaccccaccaagctgggacccaggatgcacatcttccagaatggctccctggtgatccatgacgtggcccctgaggactcaggccgctacacctgcattgcaggcaacagctgcaacatcaagcacacggaggcccccctctatgtcgtggacaagcctgtgccggaggagtcggagggccctggcagccctcccccctacaagatgatccagaccattgggttgtcggtgggtgccgctgtggcctacatcattgccgtgctgggcctcatgttctactgcaagaagcgctgcaaagccaagcggctgcagaagcagcccgagggcgaggagccagagatggaatgcctcaacggagggcctttgcagaacgggcagccctcagcagagatccaagaagaagtggccttgaccagcttgggctccggccccgcggccaccaacaaacgccacagcacaagtgataagatgcacttcccacggtctagcctgcagcccatcaccacgctggggaagagtgagtttggggaggtgttcctggcaaaggctcagggcttggaggagggagtggcagagaccctggtacttgtgaagagcctgcagacgaaggatgagcagcagcagctggacttccggagggagttggagatgtttgggaagctgaaccacgccaacgtggtgcggctcctggggctgtgccgggaggctgagccccactacatggtgctggaatatgtggatctgggagacctcaagcagttcctgaggatttccaagagcaaggatgaaaaattgaagtcacagcccctcagcaccaagcagaaggtggccctatgcacccaggtagccctgggcatggagcacctgtccaacaaccgctttgtgcataaggacttggctgcgcgtaactgcctggtcagtgcccagagacaagtgaaggtgtctgccctgggcctcagcaaggatgtgtacaacagtgagtactaccacttccgccaggcctgggtgccgctgcgctggatgtcccccgaggccatcctggagggtgacttctctaccaagtctgatgtctgggccttcggtgtgctgatgtgggaagtgtttacacatggagagatgccccatggtgggcaggcagatgatgaagtactggcagatttgcaggctgggaaggctagacttcctcagcccgagggctgcccttccaaactctatcggctgatgcagcgctgctgggccctcagccccaaggaccggccctccttcagtgagattgccagcgccctgggagacagcaccgtggacagcaagccgtgaggagggagcccgctcaggatggcctgggcaggggaggacatctctagagggaagctcacagcatgatgggcaagatccctgtcctcctgggccctgaggtgccctagtgcaacaggcattgctgaggtctgagcagggcctggcctttcctcctcttcctcaccctcatcctttgggaggctgacttggacccaaactgggcgactagggctttgagctgggcagtttcccctgccacctcttcctctatcagggacagtgtgggtgccacaggtaaccccaatttctggccttcaacttctccccttgaccgggtccaactctgccactcatctgccaactttgcctggggagggctaggcttgggatgagctgggtttgtggggagttccttaatattctcaagttctgggcacacagggttaatgagtctcttgcccactggtccacttgggggtctagaccaggattatagaggacacagcaagtgagtcctccccactctgggcttgtgcacactgacccagacccacgtcttccccacccttctctcctttcctcatcctaagtgcctggcagatgaaggagttttcaggagcttttgacactatataaaccgccctttttgtatgcaccacgggcggcttttatatgtaattgcagcgtggggtgggtgggcatgggaggtaggggtgggccctggagatgaggagggtgggccatccttaccccacacttttattgttgtcgttttttgtttgttttgtttttttgtttttgtttttgtttttacactcgctgctctcaataaataagcctttttta

SEQ ID NO: 825 - DNA, 3314 bp, Homo sapiens
  ref <308>: DATABASE ACCESSION NUMBER: NM_002826
  ref <309>: DATABASE ENTRY DATE: 2001-06-18
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcggcgctctattcgccttccgacccgctgacgctgctgcaggcggacacggtgcgcggcgcggtgctgggctcccgcagcgcctgggccgtggagttcttcgcctcctggtgcggccactgcatcgccttcgccccgacgtggaaggcgctggccgaagacgtcaaagcctggaggccggccctgtatctcgccgccctggactgtgctgaggagaccaacagtgcagtctgcagagacttcaacatccctggcttcccgactgtgaggttcttcaaggcctttaccaagaacggctcgggagcagtatttccagtggctggtgctgacgtgcagacgctgcgggagaggctcattgacgccctggagtcccatcatgacacgtggcccccagcctgtcccccactggagcctgccaagctggaggagattgatggattctttgcgagaaataacgaagagtacctggctctgatctttgaaaagggaggctcctacctgggtagagaggtggctctggacctgtcccagcacaaaggcgtggcggtgcgcagggtgctgaacacagaggccaatgtggtgagaaagtttggtgtcaccgacttcccctcttgctacctgctgttccggaatggctctgtctcccgagtccccgtgctcatggaatccaggtccttctataccgcttacctgcagagactctctgggctcaccagggaggctgcccagaccacagttgcaccaaccactgctaacaagatagctcccactgtttggaaattggcagatcgctccaagatctacatggctgacctggaatctgcactgcactacatcctgcggatagaagtgggcaggttcccggtcctggaagggcagcgcctggtggccctgaaaaagtttgtggcagtgctggccaagtatttccctggccggcccttagtccagaacttcctgcactccgtgaatgaatggctcaagaggcagaagagaaataaaattccctacagtttctttaaaactgccctggacgacaggaaagagggtgccgttcttgccaagaaggtgaactggattggctgccaggggagtgagccgcatttccggggctttccctgctccctgtgggtcctcttccacttcttgactgtgcaggcagctcggcaaaatgtagaccactcacaggaagcagccaaggccaaggaggtcctcccagccatccgaggctacgtgcactacttcttcggctgccgagactgcgctagccacttcgagcagatggctgctgcctccatgcaccgggtggggagtcccaacgccgctgtcctctggctctggtctagccacaacagggtcaatgctcgccttgcaggtgcccccagcgaggacccccagttccccaaggtgcagtggccaccccgtgaactttgttctgcctgccacaatgaacgcctggatgtgcccgtgtgggacgtggaagccaccctcaacttcctcaaggcccacttctccccaagcaacatcatcctggacttccctgcagctgggtcagctgcccggagggatgtgcagaatgtggcagccgccccagagctggcgatgggagccctggagctggaaagccggaattcaactctggaccctgggaagcctgagatgatgaagtcccccacaaacaccaccccacatgtgccggctgagggacctgaggcaagtcgacccccgaagctgcaccctggcctcagagctgcaccaggccaggagcctcctgagcacatggcagagcttcagaggaatgagcaggagcagccgcttgggcagtggcacttgagcaagcgagacacaggggctgcattgctggctgagtccagggctgagaagaaccgcctctggggccctttggaggtcaggcgcgtgggccgcagctccaagcagctggtcgacatccctgagggccagctggaggcccgagctggacggggccgaggccagtggctgcaggtgctgggagggggcttctcttacctggacatcagcctctgtgtggggctctattccctgtccttcatgggcctgctggccatgtacacctacttccaggccaagataagggccctgaagggccatgctggccaccctgcagcctgaaccacctggggaggaggcgggagagggagctgccatctctaggcacctcaagccccctgaccccattccctcccctcccaccccttgctccttgtctggcctagaagtgtgggaaattcaggaaaacgagttgctccagtgaagcttcttggggttgctaggacagagagctcctttgacacaaaagacaggagcagggtccaggttcccctgctgtgcagggagggcagccccgggcagtgggcatagggcagctcagtccctggcctcttagcaccacattcctgtttttcagcttatttgaagtcctgcctcattctcactggagcctcagtctctcctgcttggtcttggccctcaactggggcaagtgaagccagaggagggtcccccagctgggtgggctggaatggaactcctcactagctgctggggctccgcccaccctgctcccttccggacaatgaagaagcctttgcaccctgggaggaaggaccaccccgggccctctatgcctggccagcctccagctcctcagacctcctgggtggggtttggcttcagggtggggtttggaagcttctggaagtcgtgctggtctcccaggtgaggcaagccatggttgctgggctgtagggtgagtggcttgcttggtgggacctgacgagttggtggcatgggaaggatgtgggtctctagtgccttgccctggcttagctgcaggagaagatggctgctttcacttccccccattgagctctgctccctctgagcctggtcttttgtccttttttattttggtctccaagatgaatgctcatctttggagggtgccaggtagaagctagggaggggagtgtcttctctctccaggtttcaccttccagtgtgcagaagttagaagggtctggcgggggcagtgccttacacatgcttgattcccacgctaccccctgccttgggaggtgtgtggaataaattatttttgttaaggc

SEQ ID NO: 826 - DNA, 3215 bp, Homo sapiens
  ref <308>: DATABASE ACCESSION NUMBER: NM_002827
  ref <309>: DATABASE ENTRY DATE: 2001-06-18
gcgcgacgcggcctagagcggcagacggcgcagtgggccgagaaggaggcgcagcagccgccctggcccgtcatggagatggaaaaggagttcgagcagatcgacaagtccgggagctgggcggccatttaccaggatatccgacatgaagccagtgacttcccatgtagagtggccaagcttcctaagaacaaaaaccgaaataggtacagagacgtcagtccctttgaccatagtcggattaaactacatcaagaagataatgactatatcaacgctagtttgataaaaatggaagaagcccaaaggagttacattcttacccagggccctttgcctaacacatgcggtcacttttgggagatggtgtgggagcagaaaagcaggggtgtcgtcatgctcaacagagtgatggagaaaggttcgttaaaatgcgcacaatactggccacaaaaagaagaaaaagagatgatctttgaagacacaaatttgaaattaacattgatctctgaagatatcaagtcatattatacagtgcgacagctagaattggaaaaccttacaacccaagaaactcgagagatcttacatttccactataccacatggcctgactttggagtccctgaatcaccagcctcattcttgaactttcttttcaaagtccgagagtcagggtcactcagcccggagcacgggcccgttgtggtgcactgcagtgcaggcatcggcaggtctggaaccttctgtctggctgatacctgcctcttgctgatggacaagaggaaagacccttcttccgttgatatcaagaaagtgctgttagaaatgaggaagtttcggatggggctgatccagacagccgaccagctgcgcttctcctacctggctgtgatcgaaggtgccaaattcatcatgggggactcttccgtgcaggatcagtggaaggagctttcccacgaggacctggagcccccacccgagcatatccccccacctccccggccacccaaacgaatcctggagccacacaatgggaaatgcagggagttcttcccaaatcaccagtgggtgaaggaagagacccaggaggataaagactgccccatcaaggaagaaaaaggaagccccttaaatgccgcaccctacggcatcgaaagcatgagtcaagacactgaagttagaagtcgggtcgtggggggaagtcttcgaggtgcccaggctgcctccccagccaaaggggagccgtcactgcccgagaaggacgaggaccatgcactgagttactggaagcccttcctggtcaacatgtgcgtggctacggtcctcacggccggcgcttacctctgctacaggttcctgttcaacagcaacacatagcctgaccctcctccactccacctccacccactgtccgcctctgcccgcagagcccacgcccgactagcaggcatgccgcggtaggtaagggccgccggaccgcgtagagagccgggccccggacggacgttggttctgcactaaaacccatcttccccggatgtgtgtctcacccctcatccttttactttttgccccttccactttgagtaccaaatccacaagccattttttgaggagagtgaaagagagtaccatgctggcggcgcagagggaaggggcctacacccgtcttggggctcgccccacccagggctccctcctggagcatcccaggcgggcggcacgccagacagccccccccttgaatctgcagggagcaactctccactccatatttatttaaacaattttttccccaaaggcatccatagtgcactagcattttcttgaaccaataatgtattaaaattttttgatgtcagccttgcatcaagggctttatcaaaaagtacaataataaatcctcaggtagtactgggaatggaaggctttgccatgggcctgctgcgtcagaccagtactgggaaggaggacggttgtaagcagttgttatttagtgatattgtgggtaacgtgagaagatagaacaatgctataatatataatgaacacgtgggtatttaataagaaacatgatgtgagattactttgtcccgcttattctgctccctgttatctgctagatctagttctcaatcactgctcccccgtgtgtattagaatgcatgtaaggtcttcttgtgtcctgatgaaaaatatgtgcttgaaatgagaaactttgatctctgcttactaatgtgccccatgtccaagtccaacctgcctgtgcatgacctgatcattacatggctgtggttcctaagcctgttgctgaagtcattgtcgctcagcaatagggtgcagttttccaggaataggcatttgcctaattcctggcatgacactctagtgacttcctggtgaggcccagcctgtcctggtacagcagggtcttgctgtaactcagacattccaagggtatgggaagccatattcacacctcacgctctggacatgatttagggaagcagggacaccccccgccccccacctttgggatcagcctccgccattccaagtcgacactcttcttgagcagaccgtgatttggaagagaggcacctgctggaaaccacacttcttgaaacagcctgggtgacggtcctttaggcagcctgccgccgtctctgtcccggttcaccttgccgagagaggcgcgtctgccccaccctcaaaccctgtggggcctgatggtgctcacgactcttcctgcaaagggaactgaagacctccacattaagtggctttttaacatgaaaaacacggcagctgtagctcccgagctactctcttgccagcattttcacattttgcctttctcgtggtagaagccagtacagagaaattctgtggtgggaacattcgaggtgtcaccctgcagagctatggtgaggtgtggataaggcttaggtgccaggctgtaagcattctgagctggcttgttgtttttaagtcctgtatatgtatgtagtagtttgggtgtgtatatatagtagcatttcaaaatggacgtactggtttaacctcctatccttggagagcagctggctctccaccttgttacacattatgttagagaggtagcgagctgctctgctatgtccttaagccaatatttactcatcaggtcattattttttacaatggccatggaataaaccatttttacaaaa

SEQ ID NO: 827 - DNA, 4315 bp, Homo sapiens
  ref <308>: DATABASE ACCESSION NUMBER: NM_002838
  ref <309>: DATABASE ENTRY DATE: 2001-06-18
ggaaattgttcctcgtctgataagacaacagtggagaaaggacgcatgctgtttcttagggacacggctggcttccagatatgaccatgtatttgtggcttaaactcttggcatttggctttgcctttctggacacagaagtatttgtgacagggcaaagcccaacaccttcccccactggattgactacagcaaagatgcccagtgttccactttcaagtgaccccttacctactcacaccactgcattctcacccgcaagcacctttgaaagagaaaatgacttctcagagaccacaacttctcttagtccagacaatacttccacccaagtatccccggactctttggataatgctagtgcttttaataccacaggtgtttcatcagtacagacgcctcaccttcccacgcacgcagactcgcagacgccctctgctggaactgacacgcagacattcagcggctccgccgccaatgcaaaactcaaccctaccccaggcagcaatgctatctcagatgtcccaggagagaggagtacagccagcacctttcctacagacccagtttccccattgacaaccaccctcagccttgcacaccacagctctgctgccttacctgcacgcacctccaacaccaccatcacagcgaacacctcagatgcctaccttaatgcctctgaaacaaccactctgagcccttctggaagcgctgtcatttcaaccacaacaatagctactactccatctaagccaacatgtgatgaaaaatatgcaaacatcactgtggattacttatataacaaggaaactaaattatttacagcaaagctaaatgttaatgagaatgtggaatgtggaaacaatacttgcacaaacaatgaggtgcataaccttacagaatgtaaaaatgcgtctgtttccatatctcataattcatgtactgctcctgataagacattaatattagatgtgccaccaggggttgaaaagtttcagttacatgattgtacacaagttgaaaaagcagatactactatttgtttaaaatggaaaaatattgaaacctttacttgtgatacacagaatattacctacagatttcagtgtggtaatatgatatttgataataaagaaattaaattagaaaaccttgaacccgaacatgagtataagtgtgactcagaaatactctataataaccacaagtttactaacgcaagtaaaattattaaaacagattttgggagtccaggagagcctcagattattttttgtagaagtgaagctgcacatcaaggagtaattacctggaatccccctcaaagatcatttcataattttaccctctgttatataaaagagacagaaaaagattgcctcaatctggataaaaacctgatcaaatatgatttgcaaaatttaaaaccttatacgaaatatgttttatcattacatgcctacatcattgcaaaagtgcaacgtaatggaagtgctgcaatgtgtcatttcacaactaaaagtgctcctccaagccaggtctggaacatgactgtctccatgacatcagataatagtatgcatgtcaagtgtaggcctcccagggaccgtaatggcccccatgaacgttaccatttggaagttgaagctggaaatactctggttagaaatgagtcgcataagaattgcgatttccgtgtaaaagatcttcaatattcaacagactacacttttaaggcctattttcacaatggagactatcctggagaaccctttattttacatcattcaacatcttataattctaaggcactgatagcatttctggcatttctgattattgtgacatcaatagccctgcttgttgttctctacaaaatctatgatctacataagaaaagatcctgcaatttagatgaacagcaggagcttgttgaaagggatgatgaaaaacaactgatgaatgtggagccaatccatgcagatattttgttggaaacttataagaggaagattgctgatgaaggaagaccttttctggctgaatttcagagcatcccgcgggtgttcagcaagtttcctataaaggaagctcgaaagccctttaaccagaataaaaaccgttatgttgacattcttccttatgattataaccgtgttgaactctctgagataaacggagatgcagggtcaaactacataaatgccagctatattgatggtttcaaagaacccaggaaatacattgctgcacaaggtcccagggatgaaactgttgatgatttctggaggatgatttgggaacagaaagccacagttattgtcatggtcactcgatgtgaagaaggaaacaggaacaagtgtgcagaatactggccgtcaatggaagagggcactcgggcttttggagatgttgttgtaaagatcaaccagcacaaaagatgtccagattacatcattcagaaattgaacattgtaaataaaaaagaaaaagcaactggaagagaggtgactcacattcagttcaccagctggccagaccacggggtgcctgaggatcctcacttgctcctcaaactgagaaggagagtgaatgccttcagcaatttcttcagtggtcccattgtggtgcactgcagtgctggtgttgggcgcacaggaacctatatcggaattgatgccatgctagaaggcttggaagccgagaacaaagtggatgtttatggttatgttgtcaagctaaggcgacagagatgcctgatggttcaagtagaggcccagtacatcttgatccatcaggctttggtggaatacaatcagtttggagaaacagaagtgaatttgtctgaattacatccatatctacataacatgaagaaaagggatccacccagtgagccgtctccactagaggctgaattccagagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcagggaccactgaaggagaccattggtgacttttggcagatgatcttccaaagaaaagtcaaagttattgttatgctgacagaactgaaacatggagaccaggaaatctgtgctcagtactggggagaaggaaagcaaacatatggagatattgaagttgacctgaaagacacagacaaatcttcaacttatacccttcgtgtctttgaactgagacattccaagaggaaagactctcgaactgtgtaccagtaccaatatacaaactggagtgtggagcagcttcctgcagaacccaaggaattaatctctatgattcaggtcgtcaaacaaaaacttccccagaagaattcctctgaagggaacaagcatcacaagagtacacctctactcattcactgcagggatggatctcagcaaacgggaatattttgtgctttgttaaatctcttagaaagtgcggaaacagaagaggtagtggatatttttcaagtggtaaaagctctacgcaaagctaggctaggcatggtttccacattcgagcaatatcaattcctatatgacgtcattgccagcacctaccctgctcagaatggacaagtaaagaaaaacaaccatcaagaagataaaattgaatttgataatgaagtggacaaagtaaagcaggatgctaattgtgttaatccacttggtgccccagaaaagctccctgaagcaaaggaacaggctgaaggttctgaacccacgagtggcactgaggggccagaacattctgtcaatggtcctgcaagtccagctttaaatcaaggttcataggaaaagacataaatgaggaaactccaaacctcctgttagctgttatttctatttttgtagaagtaggaagtgaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgagtgtatatgtatgtgtgtatgggtgtgtgtttgtgtgagagacagagaaagagagagaattc

SEQ ID NO: 828 - DNA, 1837 bp, Homo sapiens
  ref <308>: DATABASE ACCESSION NUMBER: NM_002852
  ref <309>: DATABASE ENTRY DATE: 2001-06-18
ctcaaactcagctcacttgagagtctcctcccgccagctgtggaaagaactttgcgtctctccagcaatgcatctccttgcgattctgttttgtgctctctggtctgcagtgttggccgagaactcggatgattatgatctcatgtatgtgaatttggacaacgaaatagacaatggactccatcccactgaggaccccacgccgtgcgactgcggtcaggagcactcggaatgggacaagctcttcatcatgctggagaactcgcagatgagagagcgcatgctgctgcaagccacggacgacgtcctgcggggcgagctgcagaggctgcgggaggagctgggccggctcgcggaaagcctggcgaggccgtgcgcgccgggggctcccgcagaggccaggctgaccagtgctctggacgagctgctgcaggcgacccgcgacgcgggccgcaggctggcgcgtatggagggcgcggaggcgcagcgcccagaggaggcggggcgcgccctggccgcggtgctagaggagctgcggcagacgcgagccgacctgcacgcggtgcagggctgggctgcccggagctggctgccggcaggttgtgaaacagctattttattcccaatgcgttccaagaagatttttggaagcgtgcatccagtgagaccaatgaggcttgagtcttttagtgcctgcatttgggtcaaagccacagatgtattaaacaaaaccatcctgttttcctatggcacaaagaggaatccatatgaaatccagctgtatctcagctaccaatccatagtgtttgtggtgggtggagaggagaacaaactggttgctgaagccatggtttccctgggaaggtggacccacctgtgcggcacctggaattcagaggaagggctcacatccttgtgggtaaatggtgaactggcggctaccactgttgagatggccacaggtcacattgttcctgagggaggaatcctgcagattggccaagaaaagaatggctgctgtgtgggtggtggctttgatgaaacattagccttctctgggagactcacaggcttcaatatctgggatagtgttcttagcaatgaagagataagagagaccggaggagcagagtcttgtcacatccgggggaatattgttgggtggggagtcacagagatccagccacatggaggagctcagtatgtttcataaatgttgtgaaactccacttgaagccaaagaaagaaactcacacttaaaacacatgccagttgggaaggtctgaaaactcagtgcataataggaacacttgagactaatgaaagagagagttgagaccaatctttatttgtactggccaaatactgaataaacagttgaaggaaagacattggaaaaagcttttgaggataatgttactagactttatgccatggtgctttcagtttaatgctgtgtctctgtcagataaactctcaaataattaaaaaggactgtattgttgaacagagggacaattgttttacttttctttggttaattttgttttggccagagatgaattttacattggaagaataacaaaataagatttgttgtccattgttcattgttattggtatgtaccttattacaaaaaaaatgatgaaaacatatttatactacaaggtgacttaacaactataaatgtagtttatgtgttataatcgaatgtcacgtttttgagaagatagtcatataagttatattgcaaaagggatttgtattaatttaagactatttttgtaaagctctactgtaaataaaatattttataaaactaaaaaaaaaaaaaaa

SEQ ID NO: 829 - DNA, 424 bp, Homo sapiens
  ref <308>: DATABASE ACCESSION NUMBER: NM_002854
  ref <309>: DATABASE ENTRY DATE: 2001-06-18
accagcccagcctttcagtgcaggctccagccctccacccccacccgagttgcaggatgtcgatgacagacttgctgaacgctgaggacatcaagaaggcggtgggagcctttagcgctaccgactccttcgaccacaaaaagttcttccaaatggtcggcctgaagaaaaagagtgcggatgatgtgaagaaggtgtttcacatgctggacaaggacaaaagtggcttcatcgaggaggatgagctgggattcatcctaaaaggcttctccccagatgccagagacctgtctgctaaagaaaccaagatgctgatggctgctggagacaaagatggggacggcaaaattggggttgacgaattctccactctggtggctgaaagctaagaagcactgactgcccctggtcttccacctctctg

SEQ ID NO: 830 - DNA, 1928 bp, Homo sapiens
  ref <308>: DATABASE ACCESSION NUMBER: NM_002856
  ref <309>: DATABASE ENTRY DATE: 2001-06-18
gagcagaacagggaggctagagcgcagcgggaaccggcccggagccggagccggagccccacaggcacctactaaaccgcccagccgatcggcccccacagagtggcccgcgggcctccggccgggcccagtcccctcccgggccctccatggcccgggccgctgccctcctgccgtcgagatcgccgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagaaacccccagggcctcgccccgagatgtgggcccgctggtgtggggggccgtgggggggacactgctggtgctgctgcttctggctggggggtccttggccttcatcctgctgagggtgaggaggaggaggaagagccctggaggagcaggaggaggagccagtggcgacgggggattctacgatccgaaagctcaggtgttgggaaatggggaccccgtcttctggacaccagtagtccctggtcccatggaaccagatggcaaggatgaggaggaggaggaggaggaagagaaggcagagaaaggcctcatgttgcctccacccccagcactcgaggatgacatggagtcccagctggacggctccctcatctcacggcgggcagtttatgtgtgacctggacacagacagagacagagccaggcccggccctcccgcccccgacctgaccacgccggcctagggttccagactggttggacttgttcgtctggacgacactggagtggaacactgcctcccactttcttgggacttggagggaggtggaacagcacactggacttctcccgtctctagggctgcatggggagcccggggagctgagtagtggggatccagagaggacccccgcccccagagacttggttttggctccagccttcccctggccccgtgacactcaggagttaataaatgccttggaggaaaacaaaaaaaaaaaaaaaaaaaaaa

SEQ ID NO: 831 - DNA, 3662 bp, Homo sapiens
  ref <308>: DATABASE ACCESSION NUMBER: NM_002857
  ref <309>: DATABASE ENTRY DATE: 2001-06-18
aggtagcaagatggccgccgctgaggaaggctgtagtgtcggggccgaagcggacagggaattggaggagcttctggaaagtgctcttgatgatttcgataaagccaaaccctccccagcacccccttctaccaccacggcccctgatgcttcggggccccagaagagatcgccaggagacactgccaaagatgccctcttcgcttcccaagagaagtttttccaggaactattcgacagtgaactggcttcccaagccactgcggagttcgagaaggcaatgaaggagttggctgaggaagaaccccacctggtggagcagttccaaaagctctcagaggctgcagggagagtgggcagtgatatgacctcccaacaagaattcacttcttgcctaaaggaaacactaagtggattagccaaaaatgccactgaccttcagaactccagcatgtcggaagaagagctgaccaaggccatggaggggctaggcatggacgaaggggatggggaagggaacatcctccccatcatgcagagtattatgcagaacctactctccaaggatgtgctgtacccatcactgaaggagatcacagaaaagtatccagaatggttgcagagtcatcgggaatctctacctccagagcagtttgaaaaatatcaggagcagcacagcgtcatgtgcaaaatatgtgagcagtttgaggcagagacccccacagacagtgaaaccactcaaaaggctcgttttgagatggtgctggatcttatgcagcagctacaagatttaggccatcctccaaaagagctggctggagagatgcctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttttcctctgtctctctaggaatagggtctgtttcacaggccatttctgtgaaccctactccattgtggtttctgccactatcaaagttccagctacctgcaaggtgaaggaaggcatcccttttggggcatgcactttctttcctttctcaaaataatgttatatgtggccacactgatgttcacctttacgtccagggtctttgtgccttgtctctactccctctcttggatctggggaggaggggcagagacctgggactctgtatttctatagttctcctggcagagcctttgagaatggggagaaacagcctgggctggggctacaggtctgtcactatgctctcttgccttcagacagaccattctgaattctctaaagggaaagggcttttgcatctaatcacaatagagttgaaagagaggccttaggattctcctctctctaggtgctgagccctcacctccctgttccaggctgagaactcaaatggttaccctgcttcttcctacaatgctgtgtgatatgggtgaacccagcccctgaccttcctctatcccctgcccatcctcccttttacctcctctcttttttaaacacctgtttatcccaacctttttgagctcaagctgtgataaagaagggcccatcctatttcccctcatctagtccatttacgattctcactgactccccgtcttcctggcagacacaaataaacccagtgtcaggtctaggaaattaatggctattcttccccagatacattctggcttatttgagatacatgattctcttagaatcctgtcccttggttcaggaaagtagcttggaaaaggagtaggggtatagcttgggtcccttttcctgcaaggccccatggggcagaatataataaatattctgagtgaggagtgtggtctttttctgatcttcctcagcttccgtaagttgcagagtgaggtatattaggagactagttctacacaatattgtaatgctgggttccatcaacacccaccttccacaactcagtctgcacctcagttggcaaaggagactggatggccatctttcctcatgttcccttgagtatttcaatgtagaaagcccttcaagtggtattatattttaaccttttacattattgttattaatgttagtaatatattgttatgttttctaaattatttttctttaagctgacgtggctttttttctgtggctcccagtgggtctacggaccttggctgacatatgttggtaggtactctggtcagctcagctggctgtcctggttcactcagaagataagtctctccaaagcaaattcacatgcattatgagtcgctttgagcttctgacatgtcacttgccccgaggttaaaacttttcaccccttgaagaccttacatgttttatggtattggtgaggaaggaaatgttctcaaggtctcaggctatttgggaaattccaactcctataccttaccagagcatggaagagcccagatctgaatgtaaaacgtctctgttctgccagagatggaaaaaatacaggtatacttgtgatatagtcatggggcttcagtgtcactattttctccttaaagctccagccaaaaactggacaaggatagagaggaggagggaagaacaaaagagcccttctctatgaaccttgtgccttctgtcctaccagttttcttttacagattctcacttctgctagcctagccagggcttactccaggaatctaaatagatgccctagtccactttatctttgttcccaaggcactcatttttattttgattttgattgaatgtgagcaggttgacctcaggtcacactttgttccaaaaacttttggaattattccaggacttgtggtggagttatggtactctagggcagtctttctcaaactatgtatggtaaaggaccaggttttttgttttccagtccttcacttatcaatatgcattcctattgccgatgacaggtatggagttcacactgtgtgctgccgacccggcaagtttgacagcacccaaactggccagactgttctgtaggttaagtccattgatcatgtacttggatatcacagcaacattgaaatgctaaaaagtttttaaacactctcaatttctaattcaccatgtcacagactggtgaaaaaaaaaaaaaggtgttcactgaccagcacaagtctgcagatcatctttgagtagcactgttttggggccctcggtctctctgaagaccctagcagaactgatacctacctgtatctcttgttctctcctatttgagtttcacttccagagaacttgttcttcagcaagaatgtgtcactagtaaggacatctctagcatttctctagccttccttttctgctgctcaaaaataatcgttacaaagcttaggtttaagctgtatatgaaatatttatgcgactctcaaactttaaaggagttgctcctttgttccaaaattaaatgtgttagataaatttgtgattgtatgggtggcttcatgaattaagaattgaattaatacagactttttgataataaaaaaaaaaaaa

SEQ ID NO: 832 - DNA, 3423 bp, Homo sapiens
  ref <308>: DATABASE ACCESSION NUMBER: NM_002858
  ref <309>: DATABASE ENTRY DATE: 2001-06-18
cggctcgctggtaccggcagtgccatggcggccttcagcaagtacttgacggcgcggaactcctcgctggctggtgccgcgttcctgctgctctgcctgctccacaagcggcgccgcgccctcggcctgcacggtaagaaaagtggaaaaccaccattacagaacaatgagaaagaggggaaaaaagagcgagctgtggtggacaaggtgtttttctcaaggctcatacagattctgaaaatcatggtccctagaacattttgtaaagagacaggttacttggtacttattgctgttatgctggtgtctcgaacatattgtgatgtttggatgattcaaaatgggacactaattgaaagtggtatcattggtcgtagcaggaaagatttcaagagatacttactcaacttcatcgctgccatgcctcttatctctctggttaataacttcttgaagtatgggttaaatgagcttaaactgtgcttccgagtaaggctcactaaatacctctatgaggagtatcttcaagctttcacatattataaaatggggaatctggacaacagaatagctaatccagaccagctgcttacacaagatgtagaaaaattttgtaacagtgtagtcgatctgtattcaaatcttagtaagccatttttagacatagttttgtatatctttaagttaacgagtgcaattggagctcagggcccagcgagcatgatggcctacttggttgtttctgggctattcctaactcgacttcgaagacccattggtaagatgacaataactgagcaaaagtatgaaggagaatatagatatgttaattctcggctcatcacaaacagtgaagaaattgccttttacaatgggaataaaagagaaaagcagacagtccactcagtcttccgaaaactggtggaacacctacataatttcattttgtttcggttttcaatgggcttcattgatagtattattgccaaataccttgccactgttgttggttacctagttgtcagtcgccctttcttagatttgtctcatcctcgacatctcaagagtacacattcggaacttctagaggattactaccaaagtggaagaatgcttttgcgaatgtctcaagctctgggtcgaatagttttggctgggcgtgaaatgactagattggccggttttactgctcggattacagaattaatgcaagtactgaaggatttaaatcatggcaaatatgagcgcacaatggtctcacaacaggaaaagggtattgaaggagtacaagtcattcccttgatacctggtgctggagaaatcattattgcagataacattataaagtttgatcatgttcctttagcaacgccaaatggagatgttttgatccgagaccttaattttgaagttcgatctggggctaatgttctaatttgtggtccaaatggctgcggaaagagttcacttttccgtgttcttggtgaattatggcctctttttggaggacgtctaactaaacctgaaagaggaaaattattttatgttcctcagagaccttacatgacccttggaacacttcgagatcaagtgatatatccagatggacgagaagatcagaaaaggaagggaatttctgacctagtactgaaggaatacttagacaatgtccagttgggtcatatccttgaacgtgaaggaggctgggacagtgttcaggattggatggacgtactcagtggtggagaaaagcaaagaatggcgatggcaagattattttatcataaaccccagtttgccattttggatgaatgcacaagtgcagttagtgtcgacgtggaaggctacatttatagtcattgtcgaaaggttggcatcactctcttcactgtgtctcataggaaatctctttggaaacatcatgagtactacctgcatatggatggcagaggcaactatgaattcaaacagataacagaagatacagttgagtttggctcttagagaaatctggagaactatacctgcttcagtgaaataattacagaatatacttagaaaggcaaagtacattgtaaaataaagttgagcttagttttttttaaaaaaaaaaaacaaagcaacaaattaactagatacagaataatggagaacaagttgttaaaacatttaatattatataggatattgctaattgtgtatatgttggtttaattaataatatgtactaagaatgtccttattcttgtggttaaaaacctgcctaaattaaattgggcttcaatcactgtaacctgattcatcctgggatgtaaaccattcgaagtcagctaattggacttttatggctctatcttttccttcagtgaagaaccctatttaaaactgggtcatcatttgtcctgttctagcaagatagtcttcagtttcattttcctgtgccctgtggtagttggaaacaaatcataatgtattatttaaatgtttaacatcattgcataacagcgtttattatacagtggcagatttctttagctgccacagtaatactcattccttgtgtgtgtcttggagtgcatttgactccaggaaaagccattttggttttccttaactaaatgataaatgtacccctctcagtctgcagtattgagttgtttaaagtatatgtgcagtcttgcttacaaggaggggttaccatgtatcacacctaatcttcccaatgtttgggatattaaaacacaaagtccttaacatgccaggctcaaggtcttataagagttctagatttttaagagaattagacaaatttgtgtgtgttagaagcccattcattagaagtgtggtggttatttggtattaaactccaaatgagccataggaaggcactacatgaaataatgcactgagtatgcaatgctatcactgtctttgactgtgattttatgtttaaaaagtatgttctaaaattattatatatacatgggtgaattatgtttccgaggcactgttttatctctgtgaatcttgaataacttttttatatttgggttatgatgtcaaacgatcctaagcgaagatgatttcagttcatcaaatcatcattaatgactttatgtattatttgcacagggagaattgaaactgagtataatcaataagctagatacgaaatcagtttctcaaactgagcttcagaaaggggcattttgtactcttgtttttgcataactggttttgtttttttgcagaattaactataacaatcactggctaccgaagtaaactgatgtactgaattccataatacataacattcaatttttaccacttctgtttagcgaacttgtatacttattttctgttcagattaaaaaaaaaaaaaaaaaaaactcagatatcctataaaaaaaaaaggaattc

SEQ ID NO: 833 - DNA, 846 bp, Homo sapiens
  ref <308>: DATABASE ACCESSION NUMBER: NM_002888
  ref <309>: DATABASE ENTRY DATE: 2001-06-18
ccacgtccggggtgccgagccaactttcctgcgtccatgcagccccgccggcaacggctgcccgctccctggtccgggcccaggggcccgcgccccaccgccccgctgctcgcgctgctgctgttgctcgccccggtggcggcgcccgcggggtccgggggccccgacgaccctgggcagcctcaggatgctggggtcccgcgcaggctcctgcagcagaaggcgcgcgcggcgcttcacttcttcaacttccggtccggctcgcccagcgcgctgcgagtgctggccgaggtgcaggagggccgcgcgtggattaatccaaaagagggatgtaaagttcacgtggtcttcagcacagagcgctacaacccagagtctttacttcaggaaggtgagggacgtttggggaaatgttctgctcgagtgtttttcaagaatcagaaacccagaccaaccatcaatgtaacttgtacacggctcatcgagaaaaagaaaagacaacaagaggattacctgctttacaagcaaatgaagcaactgaaaaaccccttggaaatagtcagcatacctgataatcatggacatattgatccctctctgagactcatctgggatttggctttccttggaagctcttacgtgatgtgggaaatgacaacacaggtgtcacactactacttggcacagctcactagtgtgaggcagtgggtaagaaaaacctgaaaattaacttgtgccacaagagttacaatcaaagtggtctccttagactgaattcatgtgaacttctaatttcatatcaagagttgtaatcacatttatttcaataaatatgtgagttcctgc

SEQ ID NO: 834 - DNA, 4307 bp, Homo sapiens
  ref <308>: DATABASE ACCESSION NUMBER: NM_002890
  ref <309>: DATABASE ENTRY DATE: 2001-06-18
cctcagcctggggagctgaaggggagacgcgtctgggtggggctgctcggagcccgggcctggtggcccctggggctcccgggcgggcagggtagggcagagtagagcgggcttcaacatgatggcggccgaggccggcagtgaggagggcggcccggtaacagccggagctggaggaggcggcgcggcagcgggctccagtgcctatcccgcagtgtgtcgggtgaagatacccgcggccctgcctgtggcagccgccccctatcctgggctggtggagaccggagtggctggaactctgggtggcggagccgctttggggtcagagttcctaggagccgggtctgtggcaggggcactggggggagctggactgacagggggaggtactgctgctggcgtagctggtgctgctgctggcgtggccggtgctgctgttgctggacctagtggagacatggctctcaccaaactgcccacttcgttgcttgctgagactctcgggccaggcggcggttttccccctctgccccctcccccttacctgccccctttgggggcgggcctcgggacagtggacgaaggtgactctctggatggaccagaatacgaggaggaagaggtggccataccgttgaccgctcctccaactaaccagtggtatcacggaaaacttgacagaacgatagcagaagaacgcctcaggcaggcagggaagtctggcagttatcttataagagagagtgatcggaggccagggtcctttgtactttcatttcttagccagatgaatgttgtcaaccattttaggattattgctatgtgtggagattactacattggtggaagacgtttttcttcactgtcagacctaataggttattacagtcatgtttcttgtttgcttaaaggagaaaaattactttacccagttgcaccaccagagccagtagaagatagaaggcgtgtacgagctattctaccttacacaaaagtaccagacactgatgaaataagtttcttaaaaggagatatgttcattgttcataatgaattagaagatggatggatgtgggttacaaatttaagaacagatgaacaaggccttattgttgaagacctagtagaagaggtgggccgggaagaagatccacatgaaggaaaaatatggttccatgggaagatttccaaacaggaagcttataatttactaatgacagttggtcaagtctgcagttttcttgtgaggccctcagataatactcctggcgattattcactttatttccggaccaatgaaaatattcagcgatttaaaatatgtccaacgccaaacaatcagtttatgatgggaggccggtattataacagcattggggacatcatagatcactatcgaaaagaacagattgttgaaggatattatcttaaggaacctgtaccaatgcaggatcaagaacaagtactcaatgacacagtggatggcaaggaaatctataataccatccgtcgtaaaacaaaggatgccttttataaaaacattgttaagaaaggttatcttctgaaaaagggcaaaggaaaacgttggaaaaatttatattttatcttagagggtagtgatgcccaacttatttattttgaaagcgaaaaacgagctaccaaaccaaaaggattaatagatctcagtgtatgttctgtctatgtcgttcatgatagtctctttggcaggccaaactgttttcagatagtagttcagcactttagtgaagaacattacatcttttactttgcaggagaaactccagaacaagcagaggattggatgaaaggtctgcaggcattttgcaatttacggaaaagtagtccagggacatccaataaacgccttcgtcaggtcagcagccttgttttacatattgaagaagcccataaactcccagtaaaacattttactaatccatattgtaacatctacctgaatagtgtccaagtagcaaaaactcatgcaagggaagggcaaaacccagtatggtcagaagagtttgtctttgatgatcttcctcctgacatcaatagatttgaaataactcttagtaataaaacaaagaaaagcaaagatcctgatatcttatttatgcgctgccagttgagccgattacagaaagggcatgccacagatgaatggtttctgctcagctcccatataccattaaaaggtattgaaccagggtccctgcgtgttcgagcacgatactctatggaaaaaatcatgccagaagaagagtacagtgaatttaaagagcttatactgcaaaaggaacttcatgtagtctatgctttatcacatgtatgtggacaagaccgaacactactggccagcatcctactgaggatttttcttcacgaaaagcttgaatcgttgttgttatgcacactaaatgacagagaaataagcatggaagatgaagccactaccctatttcgagccacaacacttgcaagcaccttgatggagcagtatatgaaagccactgctacacagtttgttcatcatgctttgaaagactctattttaaagataatggaaagcaagcagtcttgtgagttaagtccatcaaagttagaaaaaaatgaagatgtgaacactaatttaacacacctattgaacatactttcagagcttgtggagaaaatattcatggcttcagaaatacttccaccgacattgagatatatttatgggtgtttacagaaatctgttcagcataagtggcctacaaataccaccatgagaacaagagttgttagtggttttgtttttcttcgactcatctgtcctgccatcctgaatccacggatgttcaatatcatctcagattctccatctcctattgctgcaagaacactgatattagtggctaaatctgtgcagaacttagcaaatcttgtggaatttggagctaaggagccctacatggaaggtgtcaatccattcatcaaaagcaacaaacatcgtatgatcatgtttttagatgaacttgggaatgtacctgaacttccggacactacagagcattctagaacggacctgtcccgtgatttagcagcattgcatgagatttgcgtggctcattcagatgaacttcgaacgctcagtaatgagcgtggtgcacagcagcacgtattgaaaaagcttctggctataacagaactgcttcaacaaaaacaaaaccagtatacaaaaaccaatgatgtcaggtagcagccttcgccccagtgttctgcatggattcagcatgtccaacatggtaattcacttcagtttaatgtctcctttgctcttgccaaaaaatagcacacttttccacattccagtgatgtgtgagctatgcaaacaaaatccaagattctgctggtgaataactatgccagcaaccttgtaagctatctgtgcaggatatttgcactatttccacatggaatcaatctttaacaacctctgagccttggtgtacagaccacctttcacaaaacgaaatgctatgactgtatcttgatatctcgaactttcaaaatatattttcagtacacccagttgccaaagttttgctgtctcttagagaaagaactatgaaatcaactgacaagaaacacattcttattgacaattgtgtataactggattgcagactgttcttactgtaactacttcctgattaggaatatgaccatttgactgttcaatgattatttgtatttacagtttccagagtttgtcattataataggaacaatctttgctgtatacttttaaaaaatactctgctatttctcttgctggaactgttgaaagaaaatatatagaatgatctattgctcatcagctttattttttaaacatacgacttattttgttgaaattgtcaaagactgtatttagatctcataatgctttgttaaatgtttacaagtaaatagtttgaattcagtaaatattattggttgttgtattgatcaatgcatgttacccattcaaccattttatagactaccaatttcttttatgttaactagaatgcttttgttaaaagttatttgttcattatttgtgctacccctttgattatgcagacaacctcatcagctgcctaacttatccatctttgaacttctgactacttgttgtatctgctggatatttagttcaactgtatagttttatttacttctgtatgtgtatttttgtgaagtattcacaaaggttaagttaaaataaaaccaagggatatcttgcaaaaaaaaaaaaa

SEQ ID NO: 835 - DNA, 4290 bp, Homo sapiens
  ref <308>: DATABASE ACCESSION NUMBER: NM_002900
  ref <309>: DATABASE ENTRY DATE: 2001-06-18
agaccttctgtccaccagctgagaaggacaagggcggaaggcagctgcacagagcagggccacggccttgcacacagtccagggagcttttgtgcaggagccaggcctccccctgggtccccatgatgagagaatgggttctgctcatgtccgtgctgctctgtggcctggctggccccacacacctgttccagccaagcctggtgctggacatggccaaggtcctcttggataactactgcttcccggagaacctgctgggcatgcaggaagccatccagcaggccatcaagagccatgagattctgagcatctcagacccgcagacgctggccagtgtgctgacagccggggtgcagagctccctgaacgatcctcgcctggtcatctcctatgagcccagcacccccgagcctcccccacaagtcccagcactcaccagcctctcagaagaggaactgcttgcctggctgcaaaggggcctccgccatgaggttctggagggtaatgtgggctacctgcgggtggacagcgtcccgggccaggaggtgctgagcatgatgggggagttcctggtggcccacgtgtgggggaatctcatgggcacctccgccttagtgctggatctccggcactgcacaggaggccaggtctctggcattccctacatcatctcctacctgcacccagggaacaccatcctgcacgtggacactatctacaaccgcccctccaacaccaccacggagatctggaccttgccccaggtcctgggagaaaggtacggtgccgacaaggatgtggtggtcctcaccagcagccagaccaggggcgtggccgaggacatcgcgcacatccttaagcagatgcgcagggccatcgtggtgggcgagcggactgggggaggggccctggacctccggaagctgaggataggcgagtctgacttcttcttcacggtgcccgtgtccaggtccctggggccccttggtggaggcagccagacgtgggagggcagcggggtgctgccctgtgtggggactccggccgagcaggccctggagaaagccctggccatcctcactctgcgcagcgcccttccaggggtagtccactgcctccaggaggtcctgaaggactactacacgctggtggaccgtgtgcccaccctgctgcagcacttggccagcatggacttctccacggtggtctccgaggaagatctggtcaccaagctcaatgccggcctgcaggctgcgtctgaggatcccaggctcctggtgcgagccatcgggcccacagaaactccttcttggcccgcgcccgacgctgcagccgaagactcaccaggggtggccccagagttgcctgaggacgaggctatccggcaagcactggtggactctgtgttccaggtgtcggtgctgccaggcaatgtgggctacctgcgcttcgatagttttgctgacgcctccgtcctgggtgtgttggccccatatgtcctgcgccaggtgtgggagccgctacaggacacggagcacctcatcatggacctgcgccacaaccctggagggccatcctctgctgtgcccctgctcctgtcctacttccagggccctgaggccggccccgtgcacctcttcaccacctatgatcgccgcaccaacatcacgcaggagcacttcagccacatggagctcccgggcccacgctacagcacccaacgtggggtgtatctgctcaccagccaccgcaccgccacggccgcggaggagttcgccttccttatgcagtcgctgggctgggccacactggtaggtgagatcaccgcgggcaacctgctgcacacccgcacggtgccgctgctggacacacccgaaggcagcctcgcgctcaccgtgccggtcctcaccttcatcgacaatcacggcgaggcctggctgggtggtggagtggtgcccgatgccatcgtgctggccgaggaggccctggacaaagcccaggaagtgctggagttccaccaaagcctgggggccttggtggagggcacagggcacctgctggaggcccactatgctcggccagaggtcgtggggcagaccagtgccctcctgcgggccaagctggcccagggcgcctaccgcacagctgtggacttggagtctctggcctctcagctcacagcagacctccaggaggtgtctggggaccaccgcttgctagtgttccacagccctggcgagctggtggtagaggaagcacccccaccaccccctgctgtcccctctccagaggagctcacctaccttattgaggccctgttcaagacagaggtgctgcccggccagctgggctacctgcgttttgacgccatggctgaactggagacagtgaaggccgtggggccacagctggtgcggctggtatggcaacagctggtggacacggctgcgctggtgatcgacctgcgctacaaccctggcagctactccacggccatcccgctgctctgctcctacttctttgaggcagagccccgccagcacctgtattctgtctttgacagggccacctcaaaagtcacggaggtgtggaccttgccccaggtcgccggccagcgctacggctcacacaaggacctctacatcctgatgagccacaccagtggctctgcggccgaggcctttgcacacaccatgcaggacctgcagcgggccacggtcattggggagcccacggccggaggcgcactctctgtgggcatctaccaggtgggcagcagccccttatatgcatccatgcccacccagatggccatgagtgccaccacaggcaaggcctgggacctggctggtgtggagcccgacatcactgtgcccatgagcgaagccctttccatagcccaggacatagtggctctgcgtgccaaggtgcccacggtgctgcagacggccgggaagctggtggctgataactatgcctctgccgagctgggggccaagatggccaccaaactgagcggtctgcagagccgctactccagggtgacctcagaagtggccctagccgagatcctgggggctgacctgcagatgctctccggagacccacacctgaaggcagcccatatccctgagaatgccaaggaccgcattcctggaattgtgcccatgcagatcccttcccctgaagtatttgaagagctgatcaagttttccttccacactaacgtgcttgaggacaacattggctacttgaggtttgacatgtttggggacggtgagctgctcacccaggtctccaggctgctggtggagcacatctggaagaagatcatgcacacggatgccatgatcatcgacatgaggttcaacatcggtggccccacatcctccattcccatcttgtgctcctacttctttgatgaaggccctccagttctgctggacaagatctacagccggcctgatgactctgtcagtgaactctggacacacgcccaggttgtaggtgaacgctatggctccaagaagagcatggtcattctgaccagcagtgtgacggccggcaccgcggaggagttcacctatatcatgaagaggctgggccgggccctggtcattggggaggtgaccagtgggggctgccagccaccacagacctaccacgtggatgacaccaacctctacctcactatccccacggcccgttctgtgggggcctcggatggcagctcctgggaaggggtgggggtgacaccccatgtggttgtccctgcagaagaggctctcgccagggccaaggagatgctccagcacaaccagctgagggtgaagcggagcccaggcctgcaggaccacctgtagggaagggccccataggcagagccccagggcagacagaacctctgggacacacaccaagggcactcctgcaggtggcccggcctgaggttcccaggagcagcaaaggggcctgctgagctctggttaggttacagctggaggtgtgtatatatacacacacacacgtgtatatacacatatatatgtgtatgtatatatatgtatatatatatggctttccaataaccacctaaattttaacaaaggttccttctaagtggtagaacttggggtggtatttttaccttccttcttcatactttgctctttttcttaaatactcattaatgtgcatatatcattattttcagatgcagctatcattattccaaaatacaaaataaagaagataaaataaattatatacccgagccattaaccacaa

SEQ ID NO: 836 - DNA, 2104 bp, Homo sapiens
  ref <308>: DATABASE ACCESSION NUMBER: NM_002901
  ref <309>: DATABASE ENTRY DATE: 2001-06-18
gctgttgtcgctcgctcagcgtctccctctcggccgccctctcctcgggacgatggcgcgcggtggccgcggccgccgcctggggttagccctggggctgctgctggcgctggtgctggcgccgcgggttctgcgggccaagcccacggtgcgcaaagagcgcgtggtgcggcccgactcggagctgggcgagcggccccctgaggacaaccagagcttccagtacgaccacgaggccttcctgggcaaggaggactccaagaccttcgaccagctcaccccggacgagagcaaggagaggctagggaagattgttgatcgaatcgacaatgatggggatggctttgtcactactgaggagctgaaaacctggatcaaacgggtgcagaaaagatacatctttgataatgtcgccaaagtctggaaggattatgatagggacaaggatgataaaatttcctgggaagaatacaaacaagccacctatggttactacctaggaaaccccgcagagtttcatgattcttcagatcatcacacctttaaaaagatgctgccacgtgatgagagaagattcaaagctgcagacctcaatggtgacctgacagctactcgggaggagttcactgcctttctgcatcctgaagagtttgaacatatgaaggaaattgtggttttggaaaccctggaggacatcgacaagaacggggatgggtttgtggatcaggatgagtatattgcggatatgttttcccatgaggagaatggccctgagccagactgggttttatcagaacgggagcagtttaacgaattccgggatctgaacaaggacgggaagttagacaaagatgagattcgccactggatcctccctcaagattatgatcacgcacaggctgaggccaggcatctggtatatgaatcagacaaaaacaaggatgagaagctaactaaagaggaaatattggagaactggaacatgtttgttggaagccaagctaccaattacggggaagatctcacaaaaaatcatgatgagctttgatagacactcaccagaatatggcagactgtcataggcattctgttattgtcttggattgttgctacaattgtctaattacagcagttgtgatcccacaaaaagcaagtttatacctcagattggggtataaaaattgtttttcgctcagtatttactggaaaatggacatcactagtctttcagtaagatttctctcaaaacacgtgaaaaccttggtaaattgcaattctttctggggatatattggtacaacatgacttaaaacttttttttttctattaaaacttaaaggggaacaaaacttgaaaaagccctgttcttcagaaggtgagtgggttgagggaggcagtaatatgaagtgactgctgtgtattttaactaccagatttttatatttgccactgttagatagttggaaaggggaaattctgtttaagcgaaagtggtatcatcctaggtaagcttatttcagaacaagtctaatatatcagattctttcttttcgactttatactctgagttattacttactgtaagtggtgtatatgaaacctccatgcattttccagtatggatctgctaatatgcacagtaaatccatgtctttgtttgtttttctattaagaagcaatcaagaaagataatgtgaaaaagaaaggaatttagaggtagggaaaagatgaatgtcagacatgtgaagaactatagtaaaaatgataaaccacctaaatatccttgaacctaccttaaaatgccaatgaggtaggcctgatctttgaatagtggctaggatacaatgcatttcctcagtgatcactgattagaatgagttggtgggatccttgggaagccaaacggagcggggttctggatcatgtcccatccagtccagtgaatccccgacccgcagacctgccccccccgcaacagcttataccatggaatgaggacaaggtgatactctgagctgtggactgaactggcagacacaacctgtacagattgaaatttcaccttgtaaggaggaagtgaatgaaataaaggatccccctaagg

SEQ ID NO: 837 - DNA, 2022 bp, Homo sapiens
  ref <308>: DATABASE ACCESSION NUMBER: NM_002906
  ref <309>: DATABASE ENTRY DATE: 2001-06-18
aattcggcacgagacaaaaagagaaagaaaatgccgaaaccaatcaacgtaagagtaactacaatggatgctgagctggaatttgccattcagcccaatacaactggcaaacaactttttgaccaggtggtgaaaacagttggtttgcgtgaggtctggttttttgggctgcagtatgtagacagcaaaggttattctacatggcttaaactaaataaaaaggtaacacagcaggatgttaaaaaagagaatcctttacagttcaagtttagagctaaattctttcctgaagatgtttctgaggaattaattcaagaaataacccagagactcttcttcttgcaagttaaagaagccatcttaaatgatgagatatattgcccgccagaaactgcagttcttttggcttcctatgctgtccaagccaagtatggagattacaataaagagattcataagccaggctacctggctaatgatagactcctaccccagcgtgtattggaacaacacaaactaacaaaagaacagtgggaagaaagaatacagaactggcatgaagaacatagaggaatgttaagggaggattctatgatggaatacctgaagattgcacaagatctagaaatgtatggagtcaactattttgaaataaaaaataaaaaaggaactgaattgtggctaggtgttgatgctttgggtctgaatatttatgagcatgacgacaagttaacacctaaaattggttttccctggagtgaaatcagaaatatttcatttaatgacaaaaaatttgttataaagccaatcgacaaaaaggcacctgattttgtgttttatgcacctcgtctgagaatcaataagcggattttggccttatgtatgggaaaccatgaactatacatgcgaagaaggaagcctgatactattgaagtacaacagatgaaggctcaggctagggaggagaaacatcagaagcagttggaaagggcacaattagagaatgaaaagaagaaaagagaaatagcagaaaaggaaaaggaaagaatagaacgtgaaaaggaagagctaatggaacgtctaaaacaaattgaagagcagacaattaaagctcagaaagaactagaagaacagactcgaaaagctctagaactggatcaagaacgaaaacgagcaaaagaagaagcagaacgacttgaaaaggagcgtcgagctgctgaagaggcaaagtctgccatagcaaaacaagctgccgaccagatgaagaatcaggagcagctagcagcagaacttgctgaattcactgccaagattgcacttctagaggaagccaagaagaaaaaggaagaggaagcaactgagtggcaacacaaagcttttgcagcccaggaagacttggaaaagaccaaagaagagttaaaaactgtgatgtctgccccccctccacctccaccaccaccagtcattcctccaacagaaaacgaacatgatgaacacgatgagaataatgctgaagctagtgctgaattatcaaatgaaggggtaatgaaccatagaagcgaggaagaacgtgtaaccgaaacacagaaaaatgagcgtgttaagaagcaacttcaggcattaagttcagaattagcccaagccagagatgaaaccaagaaaacacaaaatgatgttcttcatgctgagaatgttaaagcaggccgtgataagtacaagactctgcgacagattcgacaaggcaatacaaagcagcgtatcgatgagtttgaagcaatgtgagagctgttattttgcatatatgttcttcataagctgaaccaccaacagagaaaagcaggcctttgcagatatgatggaatgcatcccaccttgccaaagcacttacaccagtttgactgtgctagctaaaagacaaatttaaggggagctcttcaacattaaggcagtatgatatcatgcttggttttcttttttcttttggtccagggaatggagaatggtgttccattgcctcttttt

SEQ ID NO: 838 - DNA, 1446 bp, Homo sapiens
  ref <308>: DATABASE ACCESSION NUMBER: NM_002916
  ref <309>: DATABASE ENTRY DATE: 2001-06-18
ctgccatttaggacaagctggatgatgatggtttgatagctccaggggttcgtgtataggagatgatgaatctgcttcatccagaatcacaatcttaaaaggcgggaactgaggcgactgtggggacatcagtgatcgtaagtctcctgggcccgttattctcagattaggtgacggagctaagacttcgagaccatctcgtcctttttgtatcgcggaaacctgaggaacgagccggcggcggtgacctgcacgagaagccaggctaactgggtgaagtaccatgcaagcatttcttaaaggtacatccatcagtactaaacccccgctgaccaaggatcgaggagtagctgccagtgcgggaagtagcggagagaacaagaaagccaaacccgttccctgggtggaaaaatatcgcccaaaatgtgtggatgaagttgctttccaggaagaagtggttgcagtgctgaaaaaatctttagaaggagcagatcttcctaatctcttgttttacggaccacctggaactggaaaaacatccactattttggcagcagctagagaactctttgggcctgaacttttccgattaagagttcttgagttaaatgcatctgatgaacgtggaatacaagtagttcgagagaaagtgaaaaattttgctcaattaactgtgtcaggaagtcgctcagatgggaagccgtgtccgccttttaagattgtgattctggatgaagcagattctatgacctcagctgctcaggcagctttaagacgtaccatggagaaggagtcgaaaaccacccgattctgtcttatctgtaactatgtcagtcgaataattgaacccctgacctctagatgttcaaaattccgcttcaagcctctgtcagataaaattcaacagcagcgattactagacattgccaagaaggaaaatgtcaaaattagtgatgagggaatagcttatcttgttaaagtgtcagaaggagacttaagaaaagccattacatttcttcaaagcgctactcgattaacaggtggaaaggagatcacagagaaagtgattacagacattgctggggtaataccagctgagaaaattgatggagtatttgctgcctgtcagagtggctcttttgacaaactagaagctgtggtcaaggatttaatagatgagggtcatgcagcaactcagctcgtcaatcaactccatgatgtggttgtagaaaataacttatctgataaacagaagtctattatcacagaaaaacttgccgaagttgacaaatgcctagcagatggtgctgatgaacatttgcaactcatcagcctttgtgcaactgtgatgcagcagttatctcagaattgttaacgtgatatatctggatggggggttttgtaaataatgaagttgtaataaaaataaaatgaccaaaagcaccg

SEQ ID NO: 839 - DNA, 1345 bp, Homo sapiens
  ref <308>: DATABASE ACCESSION NUMBER: NM_002923
  ref <309>: DATABASE ENTRY DATE: 2001-06-18
aaaacagccggggctccagcgggagaacgataatgcaaagtgctatgttcttggctgttcaacacgactgcagacccatggacaagagcgcaggcagtggccacaagagcgaggagaagcgagaaaagatgaaacggacccttttaaaagattggaagacccgtttgagctacttcttacaaaattcctctactcctgggaagcccaaaaccggcaaaaaaagcaaacagcaagctttcatcaagccttctcctgaggaagcacagctgtggtcagaagcatttgacgagctgctagccagcaaatatggtcttgctgcattcagggcttttttaaagtcggaattctgtgaagaaaatattgaattctggctggcctgtgaagacttcaaaaaaaccaaatcaccccaaaagctgtcctcaaaagcaaggaaaatatatactgacttcatagaaaaggaagctccaaaagagataaacatagattttcaaaccaaaactctgattgcccagaatatacaagaagctacaagtggctgctttacaactgcccagaaaagggtatacagcttgatggagaacaactcttatcctcgtttcttggagtcagaattctaccaggacttgtgtaaaaagccacaaatcaccacagagcctcatgctacatgaaatgtaaaagggagcccagaaatggaggacatttcattctttttcctgaggggaaggactgtgacctgccataaagactgaccttgaattcagcctgggtgttcaggaaacatcactcagaactattgattcaaagttgggtagtgaatcaggaagccagtaactgactaggagaagctggtatcagaacagcttccctcactgtgtacagaacgcaagaagggaataggtggtctgaacgtggtgtctcactctgaaaagcaggaatgtaagatgatgaaagagacaatgtaatactgttggtccaaaagcatttaaaatcaatagatctgggattatgtggccttaggtagctggttgtacatctttccctaaatcgatccatgttaccacatagtagttttagtttaggattcagtaacagtgaagtgtttactatgtgcaagggtattgaagttcttatgaccacagatcatcagtactgttgtctcatgtaatgctaaaactgaaatggtccgtgtttgcattgttaaaaatgatgtgtgaaatagaatgagtgctatggtgttgaaaactgcagtgtccgttatgagtgccaaaaatctgtcttgaaggcagctacactttgaagtggtctttgaatacttttaataaatttattttgataaataatattg

SEQ ID NO: 840 - DNA, 1620 bp, Homo sapiens
  ref <308>: DATABASE ACCESSION NUMBER: NM_002933
  ref <309>: DATABASE ENTRY DATE: 2001-06-18
gaattccgggtttgaaaaggagttctagggaagaagagagttagttagcacatcaatgggagcagggctcttaccccacgtggtgttacatatatattattttcatacatggtttctggctcataagttccttagcccttgctatagtcttttgtgttcggtcttaagggcaggactgtactcttccctcacctttctaattgtgcatcttaagaccttccccagagagggtggtgccctgtagttgtgggaaggaatgctggcatcatgaagcttccataaaaacccgagaaacgagcttctggatagctggacacatggaggtcctggagggtggagcccagggaggcatggaagctccacagcccttcccccataccttaccctatttcctctgtatcctttgtaatatcctttatgataaaccagcaaatgtgtgtaaatgtttccctaaggtctgtggccactccagcaaattaattgaacctaaagagggggtcgtgggaaccccaacttgaagccagtcagtcagaagttctggatgtccagacttcagactggtgtctgaaagggtggaggcagtcttggggaccgagcccccaatctatgggatctgacactatctccagtagtgttggaattgagtcaccagcgtgtccactggttagtgtgtgagaaactccctaccattggtcacagaagtcttcttctgtgttgatagttgtagtgtgacagcagaggaaaaacaaagtcagaaagagttttcccgaacacacccaatttctccattttactatccatttccacaaacactgactacaatagaagtataaaaattactccactgcatcattcagctttccatctctctcagacaccaagctgcagatccaggtcactttgtaggtcaccacctagaggggaggaagacctcgctttggagagtgggaataaaacgctcgtggaaaagggtacacgcttttctgggaaagtgaggccaccatggctctggagaagtctcttgtccggctccttctgcttgtcctgatactgctggtgctgggctgggtccagccttccctgggcaaggaatcccgggccaagaaattccagcggcagcatatggactcagacagttcccccagcagcagctccacctactgtaaccaaatgatgaggcgccggaatatgacacaggggcggtgcaaaccagtgaacacctttgtgcacgagcccctggtagatgtccagaatgtctgtttccaggaaaaggtcacctgcaagaacgggcagggcaactgctacaagagcaactccagcatgcacatcacagactgccgcctgacaaacggctccaggtaccccaactgtgcataccggaccagcccgaaggagagacacatcattgtggcctgtgaagggagcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacacacatgcttccctttcctgagccggaattc

SEQ ID NO: 841 - DNA, 1147 bp, Homo sapiens
  ref <308>: DATABASE ACCESSION NUMBER: NM_002936
  ref <309>: DATABASE ENTRY DATE: 2001-06-18
ggcacgagcgcgcccacgctgggccgggagtcgaaatgcttcccggtgccgggagtgagcgatgagctggtttctgttcctggcccacagagtcgccttggccgccttgccctgccgccgcggctctcgcgggttcgggatgttctatgccgtgaggaggggccgcaagaccggggtctttctgacctggaatgagtgcagagcacaggtggaccggtttcctgctgccagatttaagaagtttgccacagaggatgaggcctgggcctttgtcaggaaatctgcaagcccggaagtttcagaagggcatgaaaatcaacatggacaagaatcggaggcgaaagccagcaagcgactccgtgagccactggatggagatggacatgaaagcgcagagccgtatgcaaagcacatgaagccgagcgtggagccggcgcctccagttagcagagacacgttttcctacatgggagacttcgtcgtcgtctacactgatggctgctgctccagtaatgggcgtagaaggccgcgagcaggaatcggcgtttactgggggccaggccatcctttaaatgtaggcattagacttcctgggcggcagacaaaccaaagagcggaaattcatgcagcctgcaaagccattgaacaagcaaagactcaaaacatcaataaactggttctgtatacagacagtatgtttacgataaatggtataactaactgggttcaaggttggaagaaaaatgggtggaagacaagtgcagggaaagaggtgatcaacaaagaggactttgtggcactggagaggcttacccaggggatggacattcagtggatgcatgttcctggtcattcgggatttataggcaatgaagaagctgacagattagccagagaaggagctaaacaatcggaagactgagccatgtgactttagtccttgggagaacttgagccagcggctgtcttgctgcctgtacttactggtgtggaaaatagcctgcaggtaggaccattgcagtgatgggcagatgcgtctttcacacggaatcaggcacagtggccttctgtgacatgtgtttataaaaaatggttaagtatataataaattgaacatctttgagattgggaaaaaaaaaaaaaaaaa

SEQ ID NO: 842 - DNA, 996 bp, Homo sapiens
  ref <308>: DATABASE ACCESSION NUMBER: NM_002937
  ref <309>: DATABASE ENTRY DATE: 2001-06-18
gaattccggcccccctctaagatactgatggctctgcagaggacccattcattgcttctgcttttgctgctgaccctgctggggctggggctggtccagccctcctatggccaggatggcatgtaccagcgattcctgcggcaacacgtgcaccctgaggagacaggtggcagtgatcgctactgcaacttgatgatgcaaagacggaagatgactttgtatcactgcaagcgcttcaacaccttcatccatgaagatatctggaacattcgtagtatctgcagcaccaccaatatccaatgcaagaacggcaagatgaactgccatgagggtgtagtgaaggtcacagattgcagggacacaggaagttccagggcacccaactgcagatatcgggccatagcgagcactagacgtgttgtcattgcctgtgagggtaacccacaggtgcctgtgcactttgacggttagatgccaccatgtagggattatcgcgagtggttgaccttacacttactccttaaatagcagtgagtaatgcatttgagctgtcccaggctctgtctcctcagctcatttcctactctttttctctatataactcattctattaaatacattgcaccaaagagatatggagacataaacctgtaatgaatgaggctgggcttttctgtaataagcttccttttataatactggtcagcttagtctctcagatcctatcctgtggaatttagttattatgtgtatttatgtagtatttcaaacatttcaaaatgctttcatctatgtttatcacattttaataccacagacttataatgatgtcactacatatagaagctcaaagttaagggatttgctgaagactgtaaagttaatggaagaattgagacaaaaatccagtgtagctggccacttatccagggctttttctacttcatcacaaggaatgttttgaaagtgtctgctttttttatccttccggaattc

SEQ ID NO: 843 - DNA, 2397 bp, Homo sapiens
  ref <308>: DATABASE ACCESSION NUMBER: NM_002950
  ref <309>: DATABASE ENTRY DATE: 2001-06-18
ttagctaggcatggtggcacatgcctgtaatcccagctactcgggaggctgaggcaggagaattgcttgaacccgggaggcagaggttgcagccggctgagatggcgccatcacactccagcctgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcggcggctccacgtcccgagctacctctttcctgctggctttggagcctgagctcgaggcccggctggcgcacctgggcgtgcaggtaaagggagaagatgaggaagagaacaatttggaagtacgtgaaaccaaaattaagggtaaaagtgggagattcttcacagtcaagctcccagttgctcttgatcctggggccaagatttcagtcattgtggaaacagtctacacccatgtgcttcatccatatccaacccagatcacccagtcagagaaacagtttgtggtgtttgaggggaaccattatttctactctccctatccaacgaagacacaaaccatgcgtgtgaagcttgcctctcgaaatgtggagagctacaccaagctggggaaccccacgcgctctgaggacctactggattatgggcctttcagagatgtgcctgcctatagtcaggatacttttaaagtacattatgagaacaacagccctttcctgaccatcaccagcatgacccgagtcattgaagtctctcactggggtaatattgctgtggaagaaaatgtggacttaaagcacacaggagctgtgcttaaggggcctttctcacgctatgattaccagagacagccagatagtggaatatcctccatccgttcttttaagaccatccttcctgctgctgcccaggatgtttattaccgggatgagattggcaatgtttctaccagccacctccttattttggatgactctgtagagatggaaatccggcctcgcttccctctctttggcgggtggaagacccattacatcgttggctacaacctcccaagctatgagtacctctataatttgggtgaccagtatgcactgaagatgaggtttgtggaccatgtgtttgatgaacaagtgatagattctctgactgtgaagatcatcctgcctgaaggagccaagaacattgaaattgatagtccctatgaaatcagccgtgccccagatgagctgcactacacctatctggatacatttggccgccctgtgattgttgcctacaagaaaaatctggtagaacagcacattcaggacattgtggtccactacacgttcaacaaggtgctcatgctgcaggagcccctgctggtggtggcggccttctacatcctgttcttcaccgttatcatctatgttcggctggacttctccatcaccaaggatccagccgcagaagccaggatgaaggtagcctgcatcacagagcaggtcttgaccctggtcaacaagagaataggcctttaccgtcactttgacgagaccgtcaataggtacaagcaatcccgggacatctccaccctcaacagtggcaagaagagcctggagactgaacacaaggccttgaccagtgagattgcactgctgcagtccaggctgaagacagagggctctgatctgtgcgacagagtgagcgaaatgcagaagctggatgcacaggtcaaggagctggtgctgaagtcggcggtggaggctgagcgcctggtggctggcaagctcaagaaagacacgtacattgagaatgagaagctcatctcaggaaagcgccaggagctggtcaccaagatcgaccacatcctggatgccctgtagcccctgcccgcatcctccagggggcccagggtgcctgcactttgctgtggcaggcagattgggtggtagtgggaggttgtgcatggaggccagtgaaagctgacatctgtaaaaggccttcaaggaagagaaaccaggccctgcgtcaggcagtgtgagtttgccgtttgtccttaactttctttttttttttttttaaaaaagaaaactttaaaaaaactcccattaaaaacaaaacatctttgtgttgtgaacaaaggaattttcaatatttgattggtattctgttctgaagtctaggatatttttcagcctataaagccccctgttttatgcccttctaattctgatgtttgggtattgtgtgagtgcatgtgtttttttttttttttttttaaagcgtgtgtgaacaaatggaaataaagcagggactgtg

SEQ ID NO: 844 - DNA, 512 bp, Homo sapiens
  ref <308>: DATABASE ACCESSION NUMBER: NM_002961
  ref <309>: DATABASE ENTRY DATE: 2001-06-18
attcttcccctctctacaaccctctctcctcagcgcttcttctttcttggtttgatcctgactgctgtcatggcgtgccctctggagaaggccctggatgtgatggtgtccaccttccacaagtactcgggcaaagagggtgacaagttcaagctcaacaagtcagaactaaaggagctgctgacccgggagctgcccagcttcttggggaaaaggacagatgaagctgctttccagaagctgatgagcaacttggacagcaacagggacaacgaggtggacttccaagagtactgtgtcttcctgtcctgcatcgccatgatgtgtaacgaattctttgaaggcttcccagataagcagcccaggaagaaatgaaaactcctctgatgtggttggggggtctgccagctggggccctccctgtcgccagtgggcacttttttttttccaccctggctccttcagacacgtgcttgatgctgagcaagttcaataaagattcttggaagttt

SEQ ID NO: 845 - DNA, 424 bp, Homo sapiens
  Modified_base 1 ... 424: n = a,c,g, or t
  ref <308>: DATABASE ACCESSION NUMBER: NM_002964
  ref <309>: DATABASE ENTRY DATE: 2001-06-18
atgtctcttgtcagctgtctttcagaagacctggtggggnaagtccgtgggcatcatgttgaccgagctggagaaagccttgaactctatcatcgacgtctaccacaagtactccctgataaaggggaatttccatgccgtctacagggatgacctgaagaaattgctagagaccgagtgtcctcagtatatcaggaaaaagggtgcagacgtctggttcaaagagttggatatcaacactgatggtgcagttaacttccaggagttcctcattctggtgataaagatgggctggcagcccacaaaaaaagccatgaagaaagccacaaagagtagctgagttactgcccagaggctgggcccctgacatgtacctgcagaataataaagtcatcaatacctcaaaaaaaaaaaaaaaaaaaaa

SEQ ID NO: 846 - DNA, 576 bp, Homo sapiens
  ref <308>: DATABASE ACCESSION NUMBER: NM_002965
  ref <309>: DATABASE ENTRY DATE: 2001-06-18
aaacactctgtgtggctcctcggctttgggacagagtgcaagacgatgacttgcaaaatgtcgcagctggaacgcaacatagagaccatcatcaacaccttccaccaatactctgtgaagctggggcacccagacaccctgaaccagggggaattcaaagagctggtgcgaaaagatctgcaaaattttctcaagaaggagaataagaatgaaaaggtcatagaacacatcatggaggacctggacacaaatgcagacaagcagctgagcttcgaggagttcatcatgctgatggcgaggctaacctgggcctcccacgagaagatgcacgagggtgacgagggccctggccaccaccataagccaggcctcggggagggcaccccctaagaccacagtggccaagatcacagtggccacggccatggccacagtcatggtggccacggccacaggccactaatcaggaggccaggccaccctgcctctacccaaccagggccccggggcctgttatgtcaaactgtcttggctgtggggctaggggctggggccaaataaagtctcttcctccaa

SEQ ID NO: 847 - DNA, 649 bp, Homo sapiens
  ref <308>: DATABASE ACCESSION NUMBER: NM_002966
  ref <309>: DATABASE ENTRY DATE: 2001-06-18
agaatacactcacaagccactccgctgctcgcctctccgccccgcgtccagctcgcccagctcgcccagcgtccgccgcgcctcgccaaggcttcaacggaccacaccaaaatgccatctcaaatggaacacgccatggaaaccatgatgtttacatttcacaaattcgctggggataaaggctacttaacaaaggaggacctgagagtactcatggaaaaggagttccctggatttttggaaaatcaaaaagaccctctggctgtggacaaaataatgaaggacctggaccagtgtagagatggcaaagtgggcttccagagcttcttttccctaattgcgggcctcaccattgcatgcaatgactattttgtagtacacatgaagcagaagggaaagaagtaggcagaaatgagcagttcgctcctccctgataagagttgtccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttcc

SEQ ID NO: 848 - DNA, 1407 bp, Homo sapiens
  ref <308>: DATABASE ACCESSION NUMBER: NM_002975
  ref <309>: DATABASE ENTRY DATE: 2001-06-18
cgaccaacggaccggacagagacgaggagaggaacaggaagagagaagctgggagaatcgggaacctgggggctagtgacctgcacacagggcaggggcactcggcagttcccagaggccacccctcccaccccagacatccagacatctggaactttgggtgccaagagtccagcttaatgcaggcagcctggcttttgggggctttggtggtcccccagctcttgggctttggccatggggctcggggagcagagagggagtgggagggaggctggggaggtgcccaggaggaggagcgggagagggaggccctgatgctgaagcatctgcaggaagccctaggactgcctgctgggaggggggatgagaatcctgccggaactgttgagggaaaagaggactgggagatggaggaggaccagggggaggaagaggaggaggaagcaacgccaaccccatcctccggccccagcccctctcccacccctgaggacatcgtcacttacatcctgggccgcctggccggcctggacgcaggcctgcaccagctgcacgtccgtctgcacgcgttggacacccgcgtggtcgagctgacccaggggctgcggcagctgcggaacgcggcaggcgacacccgcgatgccgtgcaagccctgcaggaggcgcagggtcgcgccgagcgcgagcacggccgcttggagggctgcctgaaggggctgcgcctgggccacaagtgcttcctgctctcgcgcgacttcgaagctcaggcggcggcgcaggcgcggtgcacggcgcggggcgggagcctggcgcagccggcagaccgccagcagatggaggcgctcactcggtacctgcgcgcggcgctcgctccctacaactggcccgtgtggctgggcgtgcacgatcggcgcgccgagggcctctacctcttcgaaaacggccagcgcgtgtccttcttcgcctggcatcgctcaccccgccccgagctcggcgcccagcccagcgcctcgccgcatccgctcagcccggaccagcccaacggtggcacgctcgagaactgcgtggcgcaggcctctgacgacggctcctggtgggaccacgactgccagcggcgtctctactacgtctgcgagttccccttctagcggggccggtaccccgcctccttgcccatcccaccacccggcctttccctgcgccgtgcccaccctcctccggaatcgcccttcccttcctggccacgaatggcagcgtcctccccgacccccagtctgggcgcttctgggagggctcttgcggtgccggcactcctccttgttagtgtctttccttgaaggggcgggcaccaggctaggtccggtgccaataaatccttgtggaatctgaaaaaaaaaaaaaaaa

SEQ ID NO: 849 - DNA, 739 bp, Homo sapiens
  ref <308>: DATABASE ACCESSION NUMBER: NM_002982
  ref <309>: DATABASE ENTRY DATE: 2001-06-18
ctaacccagaaacatccaattctcaaactgaagctcgcactctcgcctccagcatgaaagtctctgccgcccttctgtgcctgctgctcatagcagccaccttcattccccaagggctcgctcagccagatgcaatcaatgccccagtcacctgctgttataacttcaccaataggaagatctcagtgcagaggctcgcgagctatagaagaatcaccagcagcaagtgtcccaaagaagctgtgatcttcaagaccattgtggccaaggagatctgtgctgaccccaagcagaagtgggttcaggattccatggaccacctggacaagcaaacccaaactccgaagacttgaacactcactccacaacccaagaatctgcagctaacttattttcccctagctttccccagacaccctgttttattttattataatgaattttgtttgttgatgtgaaacattatgccttaagtaatgttaattcttatttaagttattgatgttttaagtttatctttcatggtactagtgttttttagatacagagacttggggaaattgcttttcctcttgaaccacagttctacccctgggatgttttgagggtctttgcaagaatcattaatacaaagaattttttttaacattccaatgcattgctaaaatattattgtggaaatgaatattttgtaactattacaccaaataaatatatttttgtacaaaaaaaaaaaaaa

SEQ ID NO: 850 - DNA, 776 bp, Homo sapiens
  ref <308>: DATABASE ACCESSION NUMBER: NM_002983
  ref <309>: DATABASE ENTRY DATE: 2001-06-18
aaggacacgggcagcagacagtggtcagtcctttcttggctctgctgacactcgagcccacattccgtcacctgctcagaatcatgcaggtctccactgctgcccttgctgtcctcctctgcaccatggctctctgcaaccagttctctgcatcacttgctgctgacacgccgaccgcctgctgcttcagctacacctcccggcagattccacagaatttcatagctgactactttgagacgagcagccagtgctccaagcccggtgtcatcttcctaaccaagcgaagccggcaggtctgtgctgaccccagtgaggagtgggtccagaaatatgtcagcgacctagagctgagtgcctgaggggtccagaagcttcgaggcccagcgacctcggtgggccagtggggaggagcaggagcctgagccttgggaaacatgcgtgtgacctccacagctacctcttctatggactggttgttgccaaacagccacactgtgggactcttcttaacttaaattttaatttatttatactatttagtttttgtaatttattttcgatttcacagtgtgtttgtgattgtttgctctgagagttcccctgtcccctcccccttccctcacaccgcgtctggtgacaaccgagtggctgtcatcagcctgtgtaggcagtcatggcaccaaagccaccagactgacaaatgtgtatcggatgcttttgttcagggctgtgatcggcctggggaaataataaagcacgctcttttaaaaggt

SEQ ID NO: 851 - DNA, 696 bp, Homo sapiens
  ref <308>: DATABASE ACCESSION NUMBER: NM_002984
  ref <309>: DATABASE ENTRY DATE: 2001-06-18
ttccccccccccccccccccccccgcccgagcacaggacacagctgggttctgaagcttctgagttctgcagcctcacctctgagaaaacctcttttccaccaataccatgaagctctgcgtgactgtcctgtctctcctcatgctagtagctgccttctgctctccagcgctctcagcaccaatgggctcagaccctcccaccgcctgctgcttttcttacaccgcgaggaagcttcctcgcaactttgtggtagattactatgagaccagcagcctctgctcccagccagctgtggtattccaaaccaaaagaagcaagcaagtctgtgctgatcccagtgaatcctgggtccaggagtacgtgtatgacctggaactgaactgagctgctcagagacaggaagtcttcagggaaggtcacctgagcccggatgcttctccatgagacacatctcctccatactcaggactcctctccgcagttcctgtcccttctcttaatttaatcttttttatgtgccgtgttattgtattaggtgtcatttccattatttatattagtttagccaaaggataagtgtcctatggggatggtccactgtcactgtttctctgctgttgcaaatacatggataacacatttgattctgtgtgttttccataataaaactttaaaataaaatgcagacagtta

SEQ ID NO: 852 - DNA, 1160 bp, Homo sapiens
  ref <308>: DATABASE ACCESSION NUMBER: NM_002985
  ref <309>: DATABASE ENTRY DATE: 2001-06-18
cctccgacagcctctccacaggtaccatgaaggtctccgcggcacgcctcgctgtcatcctcattgctactgccctctgcgctcctgcatctgcctccccatattcctcggacaccacaccctgctgctttgcctacattgcccgcccactgccccgtgcccacatcaaggagtatttctacaccagtggcaagtgctccaacccagcagtcgtctttgtcacccgaaagaaccgccaagtgtgtgccaacccagagaagaaatgggttcgggagtacatcaactctttggagatgagctaggatggagagtccttgaacctgaacttacacaaatttgcctgtttctgcttgctcttgtcctagcttgggaggcttcccctcactatcctaccccacccgctccttgaagggcccagattctgaccacgacgagcagcagttacaaaaaccttccccaggctggacgtggtggctcagccttgtaatcccagcactttgggaggccaaggtgggtggatcacttgaggtcaggagttcgagacagcctggccaacatgatgaaaccccatgtgtactaaaaatacaaaaaattagccgggcgtggtagcgggcgcctgtagtcccagctactcgggaggctgaggcaggagaatggcgtgaacccgggagcggagcttgcagtgagccgagatcgcgccactgcactccagcctgggcgacagagcgagactccgtctcaaaaaaaaaaaaaaaaaaaaaaaaaatacaaaaattagccgcgtggtggcccacgcctgtaatcccagctactcgggaggctaaggcaggaaaattgtttgaacccaggaggtggaggctgcagtgagctgagattgtgccacttcactccagcctgggtgacaaagtgagactccgtcacaacaacaacaacaaaaagcttccccaactaaagcctagaagagcttctgaggcgctgctttgtcaaaaggaagtctctaggttctgagctctggctttgccttggctttgcaagggctctgtgacaaggaaggaagtcagcatgcctctagaggcaaggaagggaggaacactgcactcttaagcttccgccgtctcaacccctcacaggagcttactggcaaacatgaaaaatcgggg

SEQ ID NO: 853 - DNA, 803 bp, Homo sapiens
  ref <308>: DATABASE ACCESSION NUMBER: NM_002988
  ref <309>: DATABASE ENTRY DATE: 2001-06-18
ccggcacgagaggagttgtgagtttccaagccccagctcactctgaccacttctctgcctgcccagcatcatgaagggccttgcagctgccctccttgtcctcgtctgcaccatggccctctgctcctgtgcacaagttggtaccaacaaagagctctgctgcctcgtctatacctcctggcagattccacaaaagttcatagttgactattctgaaaccagcccccagtgccccaagccaggtgtcatcctcctaaccaagagaggccggcagatctgtgctgaccccaataagaagtgggtccagaaatacatcagcgacctgaagctgaatgcctgaggggcctggaagctgcgagggcccagtgaacttggtgggcccaggagggaacaggagcctgagccagggcaatggccctgccaccctggaggccacctcttctaagagtcccatctgctatgcccagccacattaactaactttaatcttagtttatgcatcatatttcattttgaaattgatttctattgttgagctgcattatgaaattagtattttctctgacatctcatgacattgtctttatcatcctttcccctttcccttcaactcttcgtacattcaatgcatggatcaatcagtgtgattagctttctcagcagacattgtgccatatgtatcaaatgacaaatctttattgaatggttttgctcagcaccaccttttaatatattggcagtacttattatataaaaggtaaaccagcattctcactgtgaaaaaaaaaaaaaaaaaaaaaaaa

SEQ ID NO: 854 - DNA, 3310 bp, Homo sapiens
  ref <308>: DATABASE ACCESSION NUMBER: NM_002996
  ref <309>: DATABASE ENTRY DATE: 2001-06-18
ggcacgagggcactgagctctgccgcctggctctagccgcctgcctggcccccgccgggactcttgcccaccctcagccatggctccgatatctctgtcgtggctgctccgcttggccaccttctgccatctgactgtcctgctggctggacagcaccacggtgtgacgaaatgcaacatcacgtgcagcaagatgacatcaaagatacctgtagctttgctcatccactatcaacagaaccaggcatcatgcggcaaacgcgcaatcatcttggagacgagacagcacaggctgttctgtgccgacccgaaggagcaatgggtcaaggacgcgatgcagcatctggaccgccaggctgctgccctaactcgaaatggcggcaccttcgagaagcagatcggcgaggtgaagcccaggaccacccctgccgccgggggaatggacgagtctgtggtcctggagcccgaagccacaggcgaaagcagtagcctggagccgactccttcttcccaggaagcacagagggccctggggacctccccagagctgccgacgggcgtgactggttcctcagggaccaggctccccccgacgccaaaggctcaggatggagggcctgtgggcacggagcttttccgagtgcctcccgtctccactgccgccacgtggcagagttctgctccccaccaacctgggcccagcctctgggctgaggcaaagacctctgaggccccgtccacccaggacccctccacccaggcctccactgcgtcctccccagccccagaggagaatgctccgtctgaaggccagcgtgtgtggggtcagggacagagccccaggccagagaactctctggagcgggaggagatgggtcccgtgccagcgcacacggatgccttccaggactgggggcctggcagcatggcccacgtctctgtggtccctgtctcctcagaagggacccccagcagggagccagtggcttcaggcagctggacccctaaggctgaggaacccatccatgccaccatggacccccagaggctgggcgtccttatcactcctgtccctgacgcccaggctgccacccggaggcaggcggtggggctgctggccttccttggcctcctcttctgcctgggggtggccatgttcacctaccagagcctccagggctgccctcgaaagatggcaggagagatggcggagggccttcgctacatcccccggagctgtggtagtaattcatatgtcctggtgcccgtgtgaactcctctggcctgtgtctagttgtttgattcagacagctgcctgggatccctcatcctcatacccacccccacccaagggcctggcctgagctgggatgattggaggggggaggtgggatcctccaggtgcacaagctccaagctcccaggcattccccaggaggccagccttgaccattctccaccttccagggacagagggggtggcctcccaactcaccccagccccaaaactctcctctgctgctggctggttagaggttccctttgacgccatcccagccccaatgaacaattatttattaaatgcccagccccttctgacccatgctgccctgtgagtactacagtcctcccatctcacacatgagcatcaggccaggccctctgcccactccctgcaacctgattgtgtctcttggtcctgctgcagttgccagtcaccccggccacctgcggtgctatctcccccagccccatcctctgtacagagcccacgcccccactggtgacatgtcttttcttgcatgaggctagtgtggtgtttcctgggcactgcttccagtgaggctctgcccttggttaggsattgtgggaaggggagataagggtatctggtgactttcctctttggtctacactgtgctgagtctgaaggctgggttctgatcctagttccaccatcaagccaccaacatactcccatctgtgaaaggaaagagggaggtaaggaatacctgtccccctgacaacactcattgacctgaggcccttctctccagcccctggatgcagcctcacagtccttaccagcagagcaccttagacagtccctgccaatggactaacttgtctttggaccctgaggcccagagggcctgcargggagtgagttgatagcacagaccctgccctgtgggcccccaaatggaaatgggcagagcagagaccatccctgaaggccccgcccaggcttagtcactgagacagcccgggctctgcttcccatcacccgctaagagggagggagggctccagacacatgtccaagaagcccaggaaaggctccaggagcagccacattcctgatgcttcttcagagactcctgcaggcagccaggccacaagacccttgtggtcccaccccacacacgccagattctttcctgaggctgggctcccttcccacctctctcactccttgaaaacactgttctctgccctccaagaccttctccttcacctttgtccccaccgcagacaggaccaggggatttccatgatgttttccatgagtcccctgtttgtttctgaaagggacgctacccgggaagggggctgggacatgggaaaggggaagttgtaggcataaagtcaggggttcccttttttggctgctgaaggctcgagcatgcctggatggggctgcaccggctggcctggcccctcagggtccctggtggcagctcacctctcccttggattgtccccgacccttgccgtctacctgaggggcctcttatgggctgggttctacccaggtgctaggaacactccttcacagatgggtgcttggaggaaggaaacccagctctggtccatagagagcaaaacgctgtgctgccctgcccaccctggcctctgcactcccctgctgggtgtggcgcagcatattcaggaagctcagggccctggctcaggtggggtcactctggcagctcagagagggtgggagtgggtccaatgcactttgttctggctcttccaggctgggagagcctttcaggggtgggacaccctgtgatggggccctgcctcctttgtgaggaagccgctggggccagttggtcccccttccatggactttgttagtttctccaagcaggacatggacaaggatgatctaggaagactttggaaagagtaggaagactttggaaagacttttccaaccctcatcaccaacgtctgtgccattttgtattttactaataaaatttaaaagtcttgtgaaaaaaaaaaaaaaaaaaaaaaa

SEQ ID NO: 855 - DNA, 2402 bp, Homo sapiens
  Modified_base 1 ... 2402: n = a,c,g, or t
  ref <308>: DATABASE ACCESSION NUMBER: NM_002997
  ref <309>: DATABASE ENTRY DATE: 2001-06-18
ggagaggtgcgggccgaatccgagccgagcgagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagctggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtgggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatctgcgggtggggcttggggctcacacacctgtagcacttactggtaggaccaagcatcttgggggggtggccgctgagtggcagggacaggagtcactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacncccgtcctgcctgtgcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagt

SEQ ID NO: 856 - DNA, 2613 bp, Homo sapiens
  ref <308>: DATABASE ACCESSION NUMBER: NM_002999
  ref <309>: DATABASE ENTRY DATE: 2001-06-18
gcgcgccttctccagtccgcggtgccatggcccccgcccgtctgttcgcgctgctgctgctcttcgtaggcggagtcgccgagtcgatccgagagactgaggtcatcgacccccaggacctcctagaaggccgatacttctccggagccctaccagacgatgaggatgtagtggggcccgggcaggaatctgatgactttgagctgtctggctctggagatctggatgacttggaagactccatgatcggccctgaagttgtccatcccttggtgcctctagataaccatatccctgagagggcagggtctgggagccaagtccccaccgaacccaagaaactagaggagaatgaggttatccccaagagaatctcacccgttgaagagagtgaggatgtgtccaacaaggtgtcaatgtccagcactgtgcagggcagcaacatctttgagagaacggaggtcctggcagctctgattgtgggtggcatcgtgggcatcctctttgccgtcttcctgatcctactgctcatgtaccgtatgaagaagaaggatgaaggcagctatgacctgggcaagaaacccatctacaagaaagcccccaccaatgagttctacgcgtgaagcttgcttgtgggcactggcttggactttagcggggagggaagccaggggattttgaagggtggacattagggtagggtgaggtcaacctaatactgacttgtcagtatctccagctctgattacctttgaagtgttcagaagagacattgtcttctactgttctgccaggttcttcttgagctttgggcctcagttgccctggcagaaaaatggattcaacttggcctttctgaaggcaagactgggattggatcacttcttaaacttccagttaagaatctaggtccgccctcaagcccatactgaccatgcctcatccagagctcctctgaagccagggggctaacggatgttgtgtggagtcctggctggaggtcctcccccagtggccttcctcccttcctttcacagccggtctctctgccaggaaatgggggaaggaactagaaccacctgcaccttgagatgtttctgtaaatgggtacttgtgatcacactacgggaatctctgtggtatatacctggggccattctaggctctttcaagtgacttttggaaatcaaccttttttatttgggggggaggatggggaaaagagctgagagtttatgctgaaatggatttatagaatatttgtaaatctatttttagtgtttgttcgtttttttaactgttcattcctttgtgcagagtgtatatctctgcctgggcaagagtgtggaggtgccgaggtgtcttcattctctcgcacatttccacagcacctgctaagtttgtatttaatggtttttgtttttgtttttgtttgtttcttgaaaatgagagaagagccggagagatgatttttattaattttttttttttttttttttttactatttatagctttagatagggcctcccttcccctcttctttctttgttctctttcattaaaccccttccccagttttttttttatactttaaaccccgctcctcatggccttggccctttctgaagctgcttcctcttataaaatagcttttgccgaaacatagtttttttttagcagatcccaaaatataatgaaggggatggtgggatatttgtgtctgtgttcttataatatattattattcttccttggttctagaaaaatagataaatatatttttttcaggaaatagtgtggtgtttccagtttgatgttgctgggtggttgagtgagtgaattttcatgtggctgggtgggtttttgcctttttctcttgccctgttcctggtgccttctgatggggctggaatagttgaggtggatggttctaccctttctgccttctgtttgggacccagctggtgttctttggtttgctttcttcaggctctagggctgtgctatccaatacagtaaccacatgcggctgtttaaagttaagccaattaaaatcacataagattaaaaattccttcctcagttgcactaaccacgtttctagaggcgtcactgtatgtagttcatggctactgtactgacagcgagagcatgtccatctgttggacagcactattctagagaactaaactggcttaacgagtcacagcctcagctgtgctgggacgacccttgtctccctgggtaggggggggggaatgggggagggctgatgaggccccagctggggcctgttgtctgggaccctccctctcctgagaggggaggcctggtggcttagcctgggcaggtcgtgtctcctcctgaccccagtggctgcggtgaggggaaccaccctcccttgctgcaccagtggccattagctcccgtcaccactgcaacccagggtcccagctggctgggtcctcttctgcccccagtgcccttccccttgggctgtgttggagtgagcacctcctctgtaggcacctctcacactgttgtctgttactgattttttttgataaaaagataataaaacctggtactttctaaaaaaaaaaaaaaaaaaa

SEQ ID NO: 857 - DNA, 4469 bp, Homo sapiens
  ref <308>: DATABASE ACCESSION NUMBER: NM_003012
  ref <309>: DATABASE ENTRY DATE: 2001-06-18
cctgcagcctccggagtcagtgccgcgcgcccgccgccccgcgccttcctgctcgccgcacctccgggagccggggcgcacccagcccgcagcgccgcctccccgcccgcgccgcctccgaccgcaggccgagggccgccactggccggggggaccgggcagcagcttgcggccgcggagccgggcaacgctggggactgcgccttttgtccccggaggtccctggaagtttgcggcaggacgcgcgcggggaggcggcggaggcagccccgacgtcgcggagaacagggcgcagagccggcatgggcatcgggcgcagcgaggggggccgccgcggggccctgggcgtgctgctggcgctgggcgcggcgcttctggccgtgggctcggccagcgagtacgactacgtgagcttccagtcggacatcggcccgtaccagagcgggcgcttctacaccaagccacctcagtgcgtggacatccccgcggacctgcggctgtgccacaacgtgggctacaagaagatggtgctgcccaacctgctggagcacgagaccatggcggaggtgaagcagcaggccagcagctgggtgcccctgctcaacaagaactgccacgccgggacccaggtcttcctctgctcgctcttcgcgcccgtctgcctggaccggcccatctacccgtgtcgctggctctgcgaggccgtgcgcgactcgtgcgagccggtcatgcagttcttcggcttctactggcccgagatgcttaagtgtgacaagttcccggagggggacgtctgcatcgccatgacgccgcccaatgccaccgaagcctccaagccccaaggcacaacggtgtgtcctccctgtgacaacgagttgaaatctgaggccatcattgaacatctctgtgccagcgagtttgcactgaggatgaaaataaaagaagtgaaaaaagaaaatggcgacaagaagattgtccccaagaagaagaagcccctgaagttggggcccatcaagaagaaggacctgaagaagcttgtgctgtacctgaagaatggggctgactgtccctgccaccagctggacaacctcagccaccacttcctcatcatgggccgcaaggtgaagagccagtacttgctgacggccatccacaagtgggacaagaaaaacaaggagttcaaaaacttcatgaagaaaatgaaaaaccatgagtgccccacctttcagtccgtgtttaagtgattctcccgggggcagggtggggagggagcctcgggtggggtgggagcgggggggacagtgcccgggaacccgtggtcacacacacgcactgccctgtcagtagtggacattgtaatccagtcggcttgttcttgcagcattcccgctccctttccctccatagccacgctccaaaccccagggtagccatggccgggtaaagcaagggccatttagattaggaaggtttttaagatccgcaatgtggagcagcagccactgcacaggaggaggtgacaaaccatttccaacagcaacacagccactaaaacacaaaaagggggattgggcggaaagtgagagccagcagcaaaaactacattttgcaacttgttggtgtggatctattggctgatctatgcctttcaactagaaaattctaatgattggcaagtcacgttgttttcaggtccagagtagtttctttctgtctgctttaaatggaaacagactcataccacacttacaattaaggtcaagcccagaaagtgataagtgcagggaggaaaagtgcaagtccattatctaatagtgacagcaaagggaccaggggagaggcattgccttctctgcccacagtctttccgtgtgattgtctttgaatctgaatcagccagtctcagatgccccaaagtttcggttcctatgagcccggggcatgatctgatccccaagacatgtggaggggcagcctgtgcctgcctttgtgtcagaaaaaggaaaccacagtgagcctgagagagacggcgattttcgggctgagaaggcagtagttttcaaaacacatagttaaaaaagaaacaaatgaaaaaaattttagaacagtccagcaaattgctagtcagggtgaattgtgaaattgggtgaagagcttaggattctaatctcatgttttttccttttcacatttttaaaagaacaatgacaaacacccacttatttttcaaggttttaaaacagtctacattgagcatttgaaaggtgtgctagaacaaggtctcctgatccgtccgaggctgcttcccagaggagcagctctccccaggcatttgccaagggaggcggatttccctggtagtgtagctgtgtggctttccttcctgaagagtccgtggttgccctagaacctaacaccccctagcaaaactcacagagctttccgtttttttctttcctgtaaagaaacatttcctttgaacttgattgcctatggatcaaagaaattcagaacagcctgcctgttcccccgcactttttacatatatttgtttcatttctgcagatggaaagttgacatgggtggggtgtccccatccagcgagagagtttcaaaagcaaaacatctctgcagtttttcccaagtaccctgagatacttcccaaagcccttatgtttaatcagcgatgtatataagccagttcacttagacaactttacccttcttgtccaatgtacaggaagtagttctaaaaaaaatgcatattaatttcttcccccaaagccggattcttaattctctgcaacactttgaggacatttatgattgtccctctgggccaatgcttatacccagtgaggatgctgcagtgaggctgtaaagtggccccctgcggccctagcctgacccggagaaaggatggtagattctgttaactcttgaagactccagtatgaaaatcagcatgcccgcctagttacctaccggagagttatcctgataaattaacctctcacagttagtgatcctgtccttttaacaccttttttgtggggttctctctgacctttcatcgtaaagtgctggggaccttaagtgatttgcctgtaattttggatgattaaaaaatgtgtatatatattagctaattagaaatattctacttctctgttgtcaaactgaaattcagagcaagttcctgagtgcgtggatctgggtcttagttctggttgattcactcaagagttcagtgctcatacgtatctgctcattttgacaaagtgcctcatgcaaccgggccctctctctgcggcagagtccttagtggaggggtttacctggaacataagtagttaccacagaatacggaagagcaggtgactgtgctgtgcagctctctaaatgggaattctcaggtaggaagcaacagcttcagaaagagctcaaaataaattggaaatgtgaatcgcagctgtgggttttaccaccgtctgtctcagagtcccaggaccttgagtgtcattagttactttattgaaggttttagacccatagcagctttgtctctgtcacatcagcaatttcagaaccaaaagggaggctctctgtaggcacagagctgcactatcacgagcctttgtttttctccacaaagtatctaacaaaaccaatgtgcagactgattggcctggtcattggtctccgagagaggaggtttgcctgtgatttgcctgtgatttcctaattatcgctagggccaaggtgggatttgtaaagctttacaataatcattctggatagagtcctgggaggtccttggcagaactcagttaaatctttgaagaatatttgtagttatcttagaagatagcatgggaggtgaggattccaaaaacattttatttttaaaatatcctgtgtaacacttggctcttggtacctgtgggttagcatcaagttctccccagggtagaattcaatcagagctccagtttgcatttggatgtgtaaattacagtaatcccatttcccaaacctaaaatctgtttttctcatcagactctgagtaactggttgctgtgtcataacttcatagatgcaggaggctcaggtgatctgtttgaggagagcaccctaggcagcctgcagggaataacatactggccgttctgacctgttgccagcagatacacaggacatggatgaaattcccgtttcctctagtttcttcctgtagtactcctcttttagatcctaagtctcttacaaaagctttgaatactgtgaaaatgttttacattccatttcatttgtgttgtttttttaactgcattttaccagatgttttgatgttatcgcttatgttaatagtaattcccgtacgtgttcattttattttcatgctttttcagccatgtatcaatattcacttgactaaaatcactcaattaatcaatgaaaaaaaaaaa

SEQ ID NO: 858 - DNA, 1763 bp, Homo sapiens
  ref <308>: DATABASE ACCESSION NUMBER: NM_003022
  ref <309>: DATABASE ENTRY DATE: 2001-06-18
tagctggattccagccattgctgcagctgctccacagcccttttcaggacccaaacaaccgcagccgctgttcccaggatggtgatccgtgtatatattgcatcttcctctggctctacagcgattaagaagaaacaacaagatgtgcttggtttcctagaagccaacaaaataggatttgaagaaaaagatattgcagccaatgaagagaatcggaagtggatgagagaaaatgtacctgaaaatagtcgaccagccacaggttaccccctgccacctcagattttcaatgaaagccagtatcgcggggactatgatgccttctttgaagccagagaaaataatgcagtgtatgccttcttaggcttgacagccccacctggttcaaaggaagcagaagtgcaagcaaagcagcaagcatgaaccttaagcactgtgctttaagcatcctgaaaaatgagtctccattgcttttataaaatagcagaattagctttgcttcaaaagaaataggcttaatgttgaaataatagattagttgggttttcacatgcaaacattcaaaatgaatacaaaattaaaatttgaacattatggtgattatggtgaggagaatgggatattaacataaaattatattaataagtagatatcgtagaaatagtgttgttacctgccaagccatcctgtatacaccaatgattttacaaagaaaacacccttccctccttctgccattactatggcaacttaagtgtatctgcagctctacattaaaaaggagaaagagaaataacctgtctctcattcctaagttgcctcattaattttcatgaacaagaatatgtacctttttgatgctatattactgcgattaaaaaagttcttgcaggtaatgtttatgtatagttaaacgttgtaatttcttatcgtaattataacattcccattctttgtagatgaaactctacatatgaaccacagattttctgagcttctaaatgtagcctttcattgcacatttcagtgatcagaatagatatccttttacacgcacaaaagcaatagattcattcagtggacaagttccttgtttaactacacagctatgatggaatcatatatccaagttccttgcctcagtgaaatatgcatatgtatatcatgaagtgggatgccaagtaagcttaaaatgcattctctagcaaagagattagacttttaaataactcttataaaacaggttggcgatcatttcccaagattggtttcccttgagtttttgttaaaacaaatcttagtagttttgcccgtttaaaacaactcacaatcgtaaatgctactattcctaagatatcttacctttttatttcagtttagccatgtattgtatgagtgtattagtctaagcagtgagaatcttttctatgcctctattccagcaaaaagtagaagtatcaaataaaaagggcaacttttaaaatattaagcctgaagacttctaaaaagacaagaaacatggcctaaataaccaacatagatttacatagtaagtttcacactaccttattaccaaaagcaaacacctcttactttaaactacattatcatgtatatctattgtatgctggtctttactttttgccaaaatcaacatataatgaagagatgcctttgtttgatgagattcaaacttgatgctatgctttaaaataaactcagtacttttagaaacataaaaaaaaaaaaaaaaaaaaaaaaaa

SEQ ID NO: 859 - DNA, 2117 bp, Homo sapiens
  ref <308>: DATABASE ACCESSION NUMBER: NM_003034
  ref <309>: DATABASE ENTRY DATE: 2001-06-18
ggggggggttgcctggcggcgcagcagcgcgggaggcggcgaagggcgcaggagcatcgctcggaggggacaaggggacgccacgggccacatgtttaggagggagccgagccttctcccggaccctcgccgagggcgaccgtgatgctgcagaaccggcgggagcgactcgccgccgccgctctctgcgcactcggagaccccagcgcccgccttctgcaggggaagcgaccatggccatagatcgtgacttcacccccagccacttcccctagaaagaaatccttggaaaagttgcatttgaaaaaatccttgcgctgacctttggggccgacggggccgaagaagcgtgcgtgcgtttgcaagtaagagaaccaaaggtgtgtgtgcatggggggctggcggtgggggaccctccgctgccacttcgcctagctttgtgctgaggccccggcccccgcccctgggacgccggggctgcgatgagcccctgcgggcgggcccggcgacaaacgtccagaggggccatggctgtactggcgtggaagttcccgcggacccggctgcccatgggagccagtgccctctgtgtcgtggtcctctgttggctctacatcttccccgtctaccggctgcccaacgagaaagagatcgtgcagggggtgctgcaacagggcacggcgtggaggaggaaccagaccgcggccagagcgttcaggaaacaaatggaagactgctgcgaccctgcccatctctttgctatgactaaaatgaattcccctatggggaagagcatgtggtatgacggggagtttttatactcattcaccattgacaattcaacttactctctcttcccacaggcaaccccattccagctgccattgaagaaatgcgcggtggtgggaaatggtgggattctgaagaagagtggctgtggccgtcaaatagatgaagcaaattttgtcatgcgatgcaatctccctcctttgtcaagtgaatacactaaggatgttggatccaaaagtcagttagtgacagctaatcccagcataattcggcaaaggtttcagaaccttctgtggtccagaaagacatttgtggacaacatgaaaatctataaccacagttacatctacatgcctgccttttctatgaagacaggaacagagccatctttgagggtttattatacactgtcagatgttggtgccaatcaaacagtgctgtttgccaaccccaactttctgcgtagcattggaaagttctggaaaagtagaggaatccatgccaagcgcctgtccacaggactttttctggtgagcgcagctctgggtctctgtgaagaggtggccatctatggcttctggcccttctctgtgaatatgcatgagcagcccatcagccaccactactatgacaacgtcttacccttttctggcttccatgccatgcccgaggaatttctccaactctggtatcttcataaaatcggtgcactgagaatgcagctggacccatgtgaagatacctcactccagcccacttcctaggaacaatggaagaagaaaggactgaaccagggtatttttgttaggttttctatgtgactccaagagggaatggtcaagttgtttcatgagtttgcatgggcccttggaaaaacaggaaaggagcaatgaagatccaagcaaaactttactttcagcgttggcttggaggacaaataagaaatgaaacatcctatgaaatactttatagcacatggcagatttgcaactagtaaaatgctggtgaaatgctgttggtaaagcacatggttcaaatctagaagatgcagttcaaaaacaagacagactcgagttgttagggctgaggaaccaatcaaggtagaacaaagaaaatgttggggtaaaagtgttgctgattgtcaacacaaactggcttaataatattaataagaacctgtcttattaagactggctttagaaccgtaggtttttttaaaaaattattatttatttttgccctctttggggaagtgggtgggtagatttaaaaaatcccttcctgagtaataaagatacaaaatgttactgctgataaaaaaaaaaaaa

SEQ ID NO: 860 - DNA, 5198 bp, Homo sapiens
  ref <308>: DATABASE ACCESSION NUMBER: NM_003035
  ref <309>: DATABASE ENTRY DATE: 2001-06-18
ctcacttaaacacgtagttcccgcgaccccaacgtcccagaggcggggccggagtcggcggtggcgctccttggagccggctcccgctcctaccctgcaaacagacctcagctccgcggaagttgcgagacggggtttcaccatgttggtcgggctggtctggaaatcctgacttcaggtgatccacccgcctcggcctcccaaaatgctgggattacaagcgtgagccaccgcccctgacatgagccattgacttttaaagcaggagaataatttggatcagatttatatggaaacactcttctagcagcattatggggacttttccataagtctggatactgaggatttggaattaaagaaatcattcaccagacatcatggagcctatatatccttttgcacggccccagatgaataccaggtttccttcaagcaggatggtacctttccactttcctccatcaaaatgtgcactttggaacccaacgccaactggagatttcatctacttacatctcagttactacagaaatccaaagcttgtggtgactgagaagaccatccgacttgcttatcgtcatgctaacgagaataaaaaaaattcgtcatgctttttacttggttctctgacagcagacgaagatgaagaaggtgtaacattgacagtagatcgctttgatcctggtcgagaagtacctgaatgcctagaaataacccctactgcttctcttcctggggactttttgattccatgcaaagttcatactcaagaactttgttcaagagaaatgatagttcacagtgtagatgacttcagttcagctttaaaggctctacagtgccatatatgtagcaaagattccttggactgtggtaagctgctttccctaagagttcatatcacttccagggagagtttggacagtgtggaatttgacttgcattgggcagcagtaactctagcaaataactttaaatgcacacctgtgaagcccatccccattattccaacagctctggcaagaaacttgagcagtaatctgaatatttctcaagttcaagggacttataaatatggatatcttaccatggatgaaacacgcaaattgttacttttgttggaatctgatcccaaggtttattctctaccattggtgggaatttggctgtctggaattacacatatctatagtcctcaggtatgggcttgctgtttgcgatacatattcaattcttctgttcaagaaagggttttttcagaatctggaaatttcatcatagttctctattctatgacacataaggaacctgagttttatgaatgcttcccttgtgatggcaagatacctgactttcggtttcagttgctaaccagtaaggaaacattacatcttttcaaaaatgttgaacctcctgacaaaaatccaatccgttgtgaactgagcgctgaaagccaaaatgcagaaacagagtttttcagtaaggcttccaagaatttttcaattaagaggtcttcccaaaagttatcttctgggaagatgccaatacatgatcacgactctggtgttgaagatgaagatttttctccaagaccaattcctagtcctcatccagtgagtcagaagatttctaagatccaaccatcagttcctgaactttcacttgtgttggatggcaatttcatagaatcaaaccctctgcctactccattggaaatggtgaataatgaaaatcctcctttgattaaccacttggaacacttgaagccattgcaaccccagctttatgatgagaaacacagtccagaagttgaagctggagagccttccttgagaggaataccaaatcagttaaaccaggataaaccagctcttttgagacactgcaaagtaagacagccacctgcctataagaaagggaacccccataccaggaacagtattaaaccatcttctcataatgggccatctcatgatatatttgaaaagctccaaacagtttctgctggaaatgtacaaaacgaagagtatcctataagaccctccacacttaattctaggcagtcttctcttgccccgcagtcccaaccacacgattttgttttttcaccccataattcaggaagaccaatggaacttcagatacctactcccccactgccatcttactgttccacaaacgtttgcaggtgttgtcagcatcatagtcatattcaatatagtccgctaaattcttggcaaggagcaaacacagttggatccattcaagatgtccagtctgaagcccttcaaaagcattcattatttcacccaagtggatgtccagccctgtactgtaatgcattctgttcttcaagtagtcctatagccttgagacctcagggagatatgggcagttgttctccccacagcaatattgaaccatcgcctgtggcaagaccgccttcacatatggacttatgtaacccacagccttgcacagtgtgcatgcacacacccaagactgagtcagataatggaatgatgggactatctccagatgcatatcggttcctcacagaacaagacagacagctaagactacttcaggcacagattcagcgtttgttggaagcacagtctctgatgccctgttcccctaagacaactgctgttgaagacacagtgcaagctggaagacaaatggagttggtttctgtggaagcacagtcttcccctggcttgcacatgagaaaaggtgtaagcattgctgtgagcacaggtgctagcttgttttggaatgcagcaggtgaggatcaagagcctgactctcaaatgaagcaagatgataccaaaatttccagtgaggacatgaatttttctgtcgatattaataatgaagtcacaagtcttccaggtagtgcatcttcattaaaagcagttgatattcccagttttgaagagagcaacattgctgtggaagaagaatttaaccagccactttctgtatccaactcttctctagttgtgagaaaagaacctgatgtacctgtgttctttccaagtggccagctggcagaaagtgtaagcatgtgtttacagactggaccaacagggggtgccagtaacaattctgaaacatcagaggaaccaaaaattgagcatgtaatgcaacccttgcttcatcaaccatcagataaccagaaaatttaccaggatttattgggtcaagtaaaccacctattaaatagttcctccaaggaaactgagcagccgtctaccaaagcagtaattatcagtcatgaatgcaccagaacccaaaacgtttaccatacaaagaaaaaaacacatcattcaagactggtggacaaagattgtgtccttaatgcaactcttaagcaactaagaagccttggagtaaaaattgattctcccactaaagtgaagaaaaatgcacataacgtggatcacgccagtgtgttggcatgcatcagcccagaagcagtgatctctggattaaactgcatgtcatttgctaatgttggcatgagcggcttaagccccaatggtgtggatttgagcatggaggcaaatgctatagctctgaaatatttaaatgaaaatcagctgtcacaactgtctgtcactcgatcgaaccaaaataattgtgacccattcagccttctccatattaatacagacagaagcacagtggggcttagtttaatttcaccaaacaacatgtcatttgcaaccaaaaaatatatgaagagatatggactcctacaaagcagtgacaatagtgaagatgaagaggaacctcccgacaatgcagatagcaagagtgaatatttattgaatcagaaccttaggtccatacccgaacagcttggtggtcagaaagagccttctaagaatgaccatgaaataattaattgttctaactgtgaatctgtggggaccaacgcagatacgccagtattgagaaatattacaaatgaagttttgcagacaaaagcaaaacagcagttgactgaaaagccagctttcttagtaaagaaccttaaaccaagtcctgcagtgaaccttcgaaccgggaaagcagagttcactcaacatcctgagaaagaaaatgaaggggacattacaatttttcctgaaagtttgcaaccttctgaaacgctaaagcagatgaatagcatgaattcagtaggcaccttcttagatgtaaaacgtctcagacagttaccaaaattattttaaccttttaactccctgcccttttaatacagggacagggtgtctcctgaagatacttagggaaaacaggagcctaccacaaggctcctgatcattctggagtcactgtttcttggtagcagccaattgggaagagtgacttctgtgagatggctggctggtgataggactaagttctcattgttcaaatagagctgttcaacatcactgaaacctttaagaaaagccctgagatcagttattcctacaagtttaagtagtagacagatactatccagctctaagtctcaactgctcttttatactgtacttttttttttgagacggagttttgctcttgtagcccaggctggagtgcaatggcaggatctcagatcactgcaacctctgcctcctgggttcaagcgattttcctgcttcatcttcccaggtagctgggattacaggcatgtgccacaacgcctggctaattttgtatttttagtagagactggtttctccatgttggtcaggctggtctcaaactcccgacctcaggtgatccgcccgcctcggcctcctaaagtgctgggattacaggcgtgagccactgcccagctatactgtatatttaagaaggtccagcatgttgcatctctgcattatcctatatcataaaagaagcataagttatcatggtgttgggtaaattagcgaaatcaaccgcttcctaagtttaagggaaaagttatttttaaaaacaacttaataaaaacttacactcttatacaagagtgtatttccccttaattaggatgcatgttgattaaactcgagatacagctttttgcagtatggtgggttggttttggtgtaacatcttcaacatgtcacactggctatcaaagaataagaaaattattgagtatgagtgtgttttataaactttctgagtttttcagatgtcttaatattttt

SEQ ID NO: 861 - DNA, 2218 bp, Homo sapiens
  ref <308>: DATABASE ACCESSION NUMBER: NM_003039
  ref <309>: DATABASE ENTRY DATE: 2001-06-18
cttctctctccattcagtgcacgcgttactttggctaaaaggaggtgagcggcactctgcccttccagagcaagcatggagcaacaggatcagagcatgaaggaagggaggctgacgcttgtgcttgccctggcaaccctgatagctgcctttgggtcatccttccagtatgggtacaacgtggctgctgtcaactccccagcactgctcatgcaacaattttacaatgagacttactatggtaggaccggtgaattcatggaagacttccccttgacgttgctgtggtctgtaaccgtgtccatgtttccatttggagggtttatcggatccctcctggtcggccccttggtgaataaatttggcagaaaaggggccttgctgttcaacaacatattttctatcgtgcctgcgatcttaatgggatgcagcagagtcgccacatcatttgagcttatcattatttccagacttttggtgggaatatgtgcaggtgtatcttccaacgtggtccccatgtacttaggggagctggcccctaaaaacctgcggggggctctcggggtggtgccccagctcttcatcactgttggcatccttgtggcccagatctttggtcttcggaatctccttgcaaacgtagatggctggccgatcctgctggggctgaccggggtccccgcggcgctgcagctccttctgctgcccttcttccccgagagccccaggtacctgctgattcagaagaaagacgaagcggccgccaagaaagccctacagacgctgcgcggctgggactctgtggacagggaggtggccgagatccggcaggaggatgaggcagagaaggccgcgggcttcatctccgtgctgaagctgttccggatgcgctcgctgcgctggcagctgctgtccatcatcgtcctcatgggcggccagcagctgtcgggcgtcaacgctatctactactacgcggaccagatctacctgagcgccggcgtgccggaggagcacgtgcagtacgtgacggccggcaccggggccgtgaacgtggtcatgaccttctgcgccgtgttcgtggtggagctcctgggtcggaggctgctgctgctgctgggcttctccatctgcctcatagcctgctgcgtgctcactgcagctctggcactgcaggacacagtgtcctggatgccatacatcagcatcgtctgtgtcatctcctacgtcataggacatgccctcgggcccagtcccatacccgcgctgctcatcactgagatcttcctgcagtcctctcggccatctgccttcatggtggggggcagtgtgcactggctctccaacttcaccgtgggcttgatcttcccgttcatccaggagggcctcggcccgtacagcttcattgtcttcgccgtgatctgcctcctcaccaccatctacatcttcttgattgtcccggagaccaaggccaagacgttcatagagatcaaccagattttcaccaagatgaataaggtgtctgaagtgtacccggaaaaggaggaactgaaagagcttccacctgtcacttcggaacagtgactctggagaggaagccagtggagctggtctgccaggggcttcccactttggcttatttttctgacttctagctgtctgtgaatatccagaaataaaacaactctgatgtggaatgcagtcctcatctccagcctccccaccccagtgggaactgtgcaaagggctgccttgctgttcttgaagctgggctgtctctctccatgttggcctgtcaccagacccgagtcaattaaacagctggtcctccactttgctggttcagccttcgtgtggctcctggtaacgtggctccaccttgatgggtcaacctttgtgtggctcctggtaacataacaacaacagttactatagtggtgagatggaaggaatcaaattttgccagagaaactaactcggtggccccaacaggtcttccggggccatgggcatttgtttagagccaaattcatcctcttaccagatccttttccagaaatacctgtctaggaaggtgtgatgtcagaaacaatgacatccagaaagctgaggaacaggttcctgtggagacactgagtcagaattcttcatccaaattattttgttagtggaaaatggaattgcttctgtgtagtcaataaaatgaacctgatcacttttc

SEQ ID NO: 862 - DNA, 2578 bp, Homo sapiens
  ref <308>: DATABASE ACCESSION NUMBER: NM_003051
  ref <309>: DATABASE ENTRY DATE: 2001-06-18
tctacacttaaaatgccaccagcagttggaggtccagttggatacacccccccagatggaggctggggctgggcagtggtaattggagctttcatttccatcggcttctcttatgcatttcccaaatcaattactgtcttcttcaaagagattgaaggtatattccatgccaccaccagcgaagtgtcatggatatcctccataatgttggctgtcatgtatggtggaggtcctatcagcagtatcctggtgaataaatatggaagtcgtatagtcatgattgttggtggctgcttgtcaggctgtggcttgattgcagcttctttctgtaacaccgtacagcaactatacgtctgtattggagtcattggaggtcttgggcttgccttcaacttgaatccagctctgaccatgattggcaagtatttctacaagaggcgaccattggccaacggactggccatggcaggcagccctgtgttcctctgtactctggcccccctcaatcaggttttcttcggtatctttggatggagaggaagctttctaattcttgggggcttgctactaaactgctgtgttgctggagccctcatgcgaccaatcgggcccaagccaaccaaggcagggaaagataagtctaaagcatcccttgagaaagctggaaaatctggtgtgaaaaaagatctgcatgatgcaaatacagatcttattggaagacaccctaaacaagagaaacgatcagtcttccaaacaattaatcagttcctggacttaaccctattcacccacagaggctttttgctatacctctctggaaatgtgatcatgttttttggactctttgcacctttggtgtttcttagtagttatgggaagagtcagcattattctagtgagaagtctgccttccttctttccattctggcttttgttgacatggtagcccgaccatctatgggacttgtagccaacacaaagccaataagacctcgaattcagtatttctttgcggcttccgttgttgcaaatggagtgtgtcatatgctagcacctttatccactacctatgttggattctgtgtctatgcgggattctttggatttgccttcgggtggctcagctccgtattgtttgaaacattgatggaccttgttggaccccagaggttctccagcgctgtgggattggtgaccattgtggaatgctgtcctgtcctcctggggccaccacttttaggtcggctcaatgacatgtatggagactacaaatacacatactgggcatgtggcgtcgtcctaattatttcaggtatctatctcttcattggcatgggcatcaattatcgacttttggcaaaagaacagaaagcaaacgagcagaaaaaggaaagtaaagaggaagagaccagtatagatgttgctgggaagccaaatgaagttaccaaaacagcagaatctccggaccagaaagacacagaaggagggcccaaggaggaggaaagtccagtctgaatccatggggctgaagggtaaattgagcagttcatgacccaggatatctgaaaatattctactggcctgtaatctaccagtggtgctcaatgcaaatagtagacatttgtgtggaaatcataccagttgttcattgatgggatttttgtttgactccttaccaatagcctgaatttgaggagggaatgattggtagcaaaggatgggggaaagaagtaggttctgttttgttttgttttaatcttagcttttaatagtgtcataaagattataatatgtgccttaagttttagtctttagaactctagagagccttaacttcttaaaccatttttgctgaattcatctatttcgagtgttgtgttaaaaggaaaaataacaactaacttgtttgaggcaaatctaaaatttaaaattaatcttgcttcattgttacatgtaatatatttcagacattttcactggaagatttatgaacagaaatattggttgaaagttagagattttacaaaatgctgacaaaaatattttcctagcatcagtagatttctggcatatgtttctgctagctatatatttaggaaattcaaagcataaaactttggcaacatcttggctgttctagacacagtgtacttgtcaacccctctcaggtaccttttcttgggatgcttattagaagccaagtaaagtgcttaaggtttgttttcattaaattagctatttctgctcccctgttcaaagatgcattttgagtgtttatagatcactgccctttttgaaatcacctggtattatttttcttactggaaaagttagtattaaaatctacagaactacatatttgtgcctccttggtaaatacaacacatctaattaaatgtagacagatatttcaaacatcagctgaattcacttaagtttttccaaaacctcagttaaactgtgaagctattggaatttttttttcctggaatttttcccctttgattcacagtggtcccatttatatctgcttctagcttagtgctatgtgtgagatatgtgtgtgtttggtgttttt

SEQ ID NO: 863 - DNA, 594 bp, Homo sapiens
  ref <308>: DATABASE ACCESSION NUMBER: NM_003064
  ref <309>: DATABASE ENTRY DATE: 2001-06-18
gtcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaagcttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgcac

SEQ ID NO: 864 - DNA, 399 bp, Homo sapiens
  ref <308>: DATABASE ACCESSION NUMBER: NM_003066
  ref <309>: DATABASE ENTRY DATE: 2001-06-18
atgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaagcttga

SEQ ID NO: 865 - DNA, 2767 bp, Homo sapiens
  ref <308>: DATABASE ACCESSION NUMBER: NM_003088
  ref <309>: DATABASE ENTRY DATE: 2001-06-18
gcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagtgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggagggctaggactgacccttgtggtgtttttttgggtggtggctggaaacagcccctctcccacgtgggagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgc

SEQ ID NO: 866 - DNA, 1054 bp, Homo sapiens
  ref <308>: DATABASE ACCESSION NUMBER: NM_003090
  ref <309>: DATABASE ENTRY DATE: 2001-06-18
gaattccgcgggaggccacgggctttccacagcgcgggggaacgggaggctgcaggatggtcaagctgacggcggagctgatcgagcaggcggcgcagtacaccaacgcggtgcgcgaccgggagctggacctccgggggtataaaattcccgtcattgaaaatctaggtgctacgttagaccagtttgatgctattgatttttctgacaatgagatcaggaaactggatggttttcctttgttgagaagactgaaaacattgttagtgaacaacaacagaatatgccgtataggtgagggacttgatcaggctctgccctgtctgacagaactcattctcaccaataatagtctcgtggaactgggtgatctggaccctctggcatctctcaaatcgctgacttacctaagtatcctaagaaatccggtaaccaataagaagcattacagattgtatgtgatttataaagttccgcaagtcagagtactggatttccagaaagtgaaactaaaagagcgtcaggaagcagagaaaatgttcaagggcaaacggggtgcacagcttgcaaaggatattgccaggagaagcaaaacttttaatccaggtgctggtttgccaactgacaaaaagagaggtgggccatctccaggggatgtagaagcaatcaagaatgccatagcaaatgcttcaactctggctgaagtggagaggctgaaggggttgctgcagtctggtcagatccctggcagagaacgcagatcagggcccactgatgatggtgaagaagagatggaagaagacacagtcacaaacgggtcctgagcagtgaggcagatgtataataataggccctcttggaacaagtcttgcttttcgaacatggtataatagccttgtttgtgttagcaaagtggaatctatcagcattgttgaaatgcttaagactgctgctgataattttgtaatataagttttgaaatctaaatgtcaattttctacaaattataaaaataaactccactctctatgctaaaaaaaaaaaaaaggaattc

SEQ ID NO: 867 - DNA, 455 bp, Homo sapiens
  ref <308>: DATABASE ACCESSION NUMBER: NM_003096
  ref <309>: DATABASE ENTRY DATE: 2001-06-18
tagacgccgggcctacagcgggaggctgaggaaagccgtgcgttgcgttccaaggacatctgtgagcccgcggagtatacaccatgagcaaagctcaccctcccgagttgaaaaaatttatggacaagaagttatcattgaaattaaatggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgtttactatgatgtaaaaattaggtcatgtacattttcatattagactttttgttaaataaacttttgtaatagtcaaaaaaaaaaaaaaaaa

SEQ ID NO: 868 - DNA, 1974 bp, Homo sapiens
  Modified_base 1 ... 1974: n = a,c,g, or t
  ref <308>: DATABASE ACCESSION NUMBER: NM_003099
  ref <309>: DATABASE ENTRY DATE: 2001-06-18
cgggatcaatttgatttgacagtcggtataactgatcctgagaagatggcgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcagtaaacatcagtctccaaagataactacatcccttcttcccatcaacaatggctccaaagaaaatgggatccatgaagaacaagaccaagagccacaggatctctttgcagatgccacagtggagctatccttggacagcacacaaaataatcagaagaaggtgctagccaaaacactcatttytcttcctcctcaggaagccacaaattcttcgaagccccagccaacctatgaggagctagaggaagaagaacaggaggatcaatttgatttgacagtcggtataactgatcctgagaagataggggatggtatgaatgcatatgtagcctacaaagttacaacacagacaagcttaccattgttcagaagcaaacagtttgcagtaaaaagaagatttagtgactttctgggtctttatgagaagctttccgagaagcactctcagaatggcttcattgtccctccgcccccggagaagagcctcatagggatgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagtgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccntgtccccacgaccaactgtccccagttactctaaccgttatttcatttagctnccatatatattttcttacctaagagaatagtttcctgctttaagnaaaagacctacaataggtggtggaattatgggatggggtggagtattgatataaatatataaatacaaatgtatatttttcaggatgtggtttaggaactgggaataacgttttcatggcaccatcaggagtaacagaaaacc

SEQ ID NO: 869 - DNA, 1984 bp, Homo sapiens
  ref <308>: DATABASE ACCESSION NUMBER: NM_003102
  ref <309>: DATABASE ENTRY DATE: 2001-06-18
ggatccagagatttagattttttataagctttcctgccaccgaaacgggtgtttgggacctcacgaggccctgttcattcttcgtcgctgcgctccccactctgtactggatgcatttactgacgttgttgtctccgtccccagagtatgaacccccaaggtgactcatgcagctgtgggtgcccggcatacagcatggtgactggaatggatgagcacccaataaacatttgttgcaggaatgcaggaggacgggcaggccagcaagcaggctgcctggtttttcccacatgggcttttctgggaaagaagagcttctatttttggaaagggctgctatgattgagaaaagttcatggcagcaaaaaaaggacagacgtcgggagggaaacactcctagttctcccagacaacacattttttaaaaagactccttcatctctttaataataacggtaacgacaatgacaatgatgattacttatgagtgcggctagtgccagccactgtgttgtcactgggcgagtaatgatctcattggatcttcacggtgggcgtgcggggctccagggacagcctgcgttcctgggctggctgggtgcagctctcttttcaggagagaaagctctcttggaggagctggaaaggtgcccgactccagccatgctggcgctactgtgttcctgcctgctcctggcagccggtgcctcggacgcctggacgggcgaggactcggcggagcccaactctgactcggcggagtggatccgagacatgtacgccaaggtcacggagatctggcaggaggtcatgcagcggcgggacgacgacggcacgctccacgccgcctgccaggtgcagccgtcggccacgctggacgccgcgcagccccgggtgaccggcgtcgtcctcttccggcagcttgcgccccgcgccaagctcgacgccttcttcgccctggagggcttcccgaccgagccgaacagctccagccgcgccatccacgtgcaccagttcggggacctgagccagggctgcgagtccaccgggccccactacaacccgctggccgtgccgcacccgcagcacccgggcgacttcggcaacttcgcggtccgcgacggcagcctctggaggtaccgcgccggcctggccgcctcgctcgcgggcccgcactccatcgtgggccgggccgtggtcgtccacgctggcgaggacgacctgggccgcggcggcaaccaggccagcgtggagaacgggaacgcgggccggcggctggcctgctgcgtggtgggcgtgtgcgggcccgggctctgggagcgccaggcgcgggagcactcagagcgcaagaagcggcggcgcgagagcgagtgcaaggccgcctgagcgcggcccccacccggcggcggccagggacccccgaggcccccctctgcctttgagcttctcctctgctccaacagacaccttccactctgaggtctcaccttcgcctctgctgaagtctccccgcagccctctccacccagaggtctccctataccgagacccaccatccttccatcctgaggaccgccccaaccctcggagccccccactcagtaggtctgaaggcctccatttgtaccgaaacaccccgctcacgctgacagcctcctaggctccctgaggtacctttccacccagaccctccttccccaccccataagccctgagactcccgcctttgacctgacgatcttcccccttcccgccttcaggttcctcctaggcgctcagaggccgctctggggggttgcctcgagtccccccacccctccccacccaccaccgctcccgcggcaagccagcccgtgcaacggaagccaggccaactgccccgcgtcttcagctgtttcgcatccaccgccaccccactgagagctgctcctttgggggaatgtttggcaacctttgtgttacagattaaaaattcagcaattca

SEQ ID NO: 870 - DNA, 1808 bp, Homo sapiens
  ref <308>: DATABASE ACCESSION NUMBER: NM_003104
  ref <309>: DATABASE ENTRY DATE: 2001-06-18
gcctagtcccgcccctgcgtgcggcgcttctcccaggccccaccttccatccagtgccctggaccctcggctgggtagcgccaccagagcgaccaaacgtcccgcgccttccaggccgcactccagagccaaaagagctccatggcggcggcggccaagcccaacaacctttccctggtggtgcacggaccgggggacttgcgcctggagaactatcctatccctgaaccaggcccaaatgaggtcttgctgaggatgcattctgttggaatctgtggctcagatgtccactactgggagtatggtcgaattgggaattttattgtgaaaaagcccatggtgctgggacatgaagcttcgggaacagtcgaaaaagtgggatcatcggtaaagcacctaaaaccaggtgatcgtgttgccatcgagcctggtgctccccgagaaaatgatgaattctgcaagatgggccgatacaatctgtcaccttccatcttcttctgtgccacgccccccgatgacgggaacctctgccggttctataagcacaatgcagccttttgttacaagcttcctgacaatgtcacctttgaggaaggcgccctgatcgagccactttctgtggggatccatgcctgcaggagaggcggagttaccctgggacacaaggtccttgtgtgtggagctgggccaatcgggatggtcactttgctcgtggccaaagcaatgggagcagctcaagtagtggtgactgatctgtctgctacccgattgtccaaagccaaggagattggggctgatttagtcctccagatctccaaggagagccctcaggaaatcgccaggaaagtagaaggtcagctggggtgcaagccggaagtcaccatcgagtgcacgggggcagaggcctccatccaggcgggcatctacgccactcgctctggtgggaccctcgtgcttgtggggctgggctctgagatgaccaccgtacccctactgcatgcagccatccgggaggtggatatcaagggcgtgtttcgatactgcaacacgtggccagtggcgatttcgatgcttgcgtccaagtctgtgaatgtaaaacccctcgtcacccataggtttcctctggagaaagctctggaggcctttgaaacatttaaaaagggattggggttgaaaatcatgctcaagtgtgaccccagtgaccagaatccctgatgttaatgggctctgctcatccccacagtcttgggatctcagggcacaatggctggacatgggtgggctctgatgcagaactttctcttttgaatgttaagaataactaatacaattcattgtgaacagaagtccttaagcagaggaattggtgtgccttaaagatacaatctgggatagtttgggggaacttgtagccagaatgccctgttcatgctgagcaaagttcagcaagtagagcagagtttggcaggcaggtgccaggaactccccttcttcctggagtgccttcattgaggaaggaaatctggcccttgggtttcctggttccactgctactgacccagaggggaatgagggctgagttatgaaaagataacttcatgaagacttaactggcccagaagctgattttcatgaaaatctgccactcagggtctgggatgaaggcttgtcagcacttccagtttagaacgcaatgtttctagagacatattggctgtttgttttgatgataaaaggagaataagaaaaggcatcactttcctggatccaggataatttttaaaccaatcaaatgaaaaaaacaaaca

SEQ ID NO: 871 - DNA, 1998 bp, Homo sapiens
  ref <308>: DATABASE ACCESSION NUMBER: NM_003108
  ref <309>: DATABASE ENTRY DATE: 2001-06-18
ggggtgggagggggagggggacctccgcacgagacccagcggcccgggttggagcgtccagccctgcaacggatcatggtgcagcaggcggagagcttggaagcggagagcaacctgccccgggaggcgctggacacggaggagggcgaattcatggcttgcagcccggtggccctggacgagagcgacccagactggtgcaagacggcgtcgggccacatcaagcggccgatgaacgcgttcatggtatggtccaagatcgaacgcaggaagatcatggagcagtctccggacatgcacaacgccgagatctccaagaggctgggcaagcgctggaaaatgctgaaggacagcgagaagatcccgttcatccgggaggcggagcggctgcggctcaagcacatggccgactaccccgactacaagtaccggccccggaaaaagcccaaaatggacccctcggccaagcccagcgccagccagagcccagagaagagcgcggccggcggcggcggcgggagcgcgggcggaggcgcgggcggtgccaagacctccaagggctccagcaagaaatgcggcaagctcaaggcccccgcggccgcgggcgccaaggcgggcgcgggcaaggcggcccagtccggggactacgggggcgcgggcgacgactacgtgctgggcagcctgcgcgtgagcggctcgggcggcggcggcgcgggcaagacggtcaagtgcgtgtttctggatgaggacgacgacgacgacgacgacgacgacgagctgcagctgcagatcaaacaggagccggacgaggaggacgaggaaccaccgcaccagcagctcctgcagccgccggggcagcagccgtcgcagctgctgagacgctacaacgtcgccaaagtgcccgccagccctacgctgagcagctcggcggagtcccccgagggagcgagcctctacgacgaggtgcgggccggcgcgacctcgggcgccgggggcggcagccgcctctactacagcttcaagaacatcaccaagcagcacccgccgccgctcgcgcagcccgcgctgtcgcccgcgtcctcgcgctcggtgtccacctcctcgtccagcagcagcggcagcagcagcggcagcagcggcgaggacgccgacgacctgatgttcgacctgagcttgaatttctctcaaagcgcgcacagcgccagcgagcagcagctggggggcggcgcggcggccgggaacctgtccctgtcgctggtggataaggatttggattcgttcagcgagggcagcctgggctcccacttcgagttccccgactactgcacgccggagctgagcgagatgatcgcgggggactggctggaggcgaacttctccgacctggtgttcacatattgaaaggcgcccgctgctcgctctttctctcggagggtgcagagctgggttccttgggaggaagttgtagtggtgatgatgatgatgatgataatgatgatgatgatggtggtgttgatggtggcggtggtagggtggaggggagagaagaagatgctgatgatattgataagatgtcgtgacgcaaagaaattggaaaacatgatgaaaattttggtggagttaaagtgaaatgagtagtttttaaacatttttcctgtcctttttttgtcccccctcccttcctttatcgtgtctcaaggtagttgcatacctagtctggagttgtgattattttcccaaaaaatgtgtttttgtaattactatttctttttcctgaaattcgtgattgcaacaaaggcagagggggcggcgcggcggaggggaggtaggacccgctccggaaggcgctgtttgaagcttgtcggtctttgaagtctggaagacgtctgcagaggacccttttggcagcacaactgttactctagggagttggtggagatatttttttttcttaagagaacttaaagaactggtgatttttttttaacaaaaaaaggg

SEQ ID NO: 872 - DNA, 2133 bp, Homo sapiens
  ref <308>: DATABASE ACCESSION NUMBER: NM_003118
  ref <309>: DATABASE ENTRY DATE: 2001-06-18
cgggagagcgcgctctgcctgccgcctgcctgcctgccactgagggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtaggagaatttgatgatggtgcagaggaaaccgaagaggaggtggtggcggaaaatccctgccagaaccaccactgcaaacacggcaaggtgtgcgagctggatgagaacaacacccccatgtgcgtgtgccaggaccccaccagctgcccagcccccattggcgagtttgagaaggtgtgcagcaatgacaacaagaccttcgactcttcctgccacttctttgccacaaagtgcaccctggagggcaccaagaagggccacaagctccacctggactacatcgggccttgcaaatacatccccccttgcctggactctgagctgaccgaattccccctgcgcatgcgggactggctcaagaacgtcctggtcaccctgtatgagagggatgaggacaacaaccttctgactgagaagcagaagctgcgggtgaagaagatccatgagaatgagaagcgcctggaggcaggagaccaccccgtggagctgctggcccgggacttcgagaagaactataacatgtacatcttccctgtacactggcagttcggccagctggaccagcaccccattgacgggtacctctcccacaccgagctggctccactgcgtgctcccctcatccccatggagcattgcaccacccgctttttcgagacctgtgacctggacaatgacaagtacatcgccctggatgagtgggccggctgcttcggcatcaagcagaaggatatcgacaaggatcttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaatccaccaaccagaacgtggtttgcctgaggctgtaactgagagaaagattctggggctgtcttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctcccctttgttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatctttcaaaataaaaagtaatgacttagaaactgaaaaaaaaaaaaaaaaaaaaaaaaaaaaaa

SEQ ID NO: 873 - DNA, 1444 bp, Homo sapiens
  ref <308>: DATABASE ACCESSION NUMBER: NM_003121
  ref <309>: DATABASE ENTRY DATE: 2001-06-18
ccaccatgctcgccctggaggctgcacagctcgacgggccacacttcagctgtctgtacccagatggcgtcttctatgacctggacagctgcaagcattccagctaccctgattcagagggggctcctgactccctgtgggactggactgtggccccacctgtcccagccaccccctatgaagccttcgacccggcagcagccgcttttagccacccccaggctgcccagctctgctacgaaccccccacctacagccctgcagggaacctcgaactggcccccagcctggaggccccggggcctggcctccccgcataccccacggagaacttcgctagccagaccctggttcccccggcatatgccccgtaccccagccctgtgctatcagaggaggaagacttaccgttggacagccctgccctggaggtctcggacagcgagtcggatgaggccctcgtggctggccccgaggggaagggatccgagggactcgcaagaagctgcgcctgtaccagttcctgctggggctactgacgcgcggggacatgcgtgagtgcgtgtggtgggtggagccaggcgccggcgtcttccagttctcctccaagcacaaggaactcctggcgcgccgctggggccagcagaaggggaaccgcaagcgcatgacctaccagaagctggcgcgcgccctccgaaactacgccaagaccggcgagatccgcaaggtcaagcgcaagctcacctaccagttcgacagcgcgctgctgcctgcagtccgccgggcctgagcacacccgaggctcccacctgcggagccgctgggggacctcacgtcccagccaggatccccctggaagaaaaagggcgtccccacactctaggtgataggacttacgcatccccaccttttggggtaaggggagtgctgccctgccataatccccaagcccagcccgggcctgtctgggattccccacttgtgcctggggtccctctgggatttctttgtcatgtacagactccctgggatcctcatgttttgggtgacaggacctatggaccactatactcggggaggcagggtagcagtgcttccagagtcccaagagcttctctgggattttcttgtgatatctgattccccagtgaggcctgggacctttttaagatcgctgtgtgtctgtaaaccctgaatctcatctggggtgggggccctgctggcaaccctgagccctgtccaaggttccctcttgtcagatctgagatttcctagttatgtctggggccctctgggagctgttatcatctcagatctcttcgcccatctatggctgtgttgtcacatctgtcccctcatttttgagatcccccaattctctggaactattctgctgcccctttttatgtgtctggagttccccaatcacatctagggctcctcc

SEQ ID NO: 874 - DNA, 721 bp, Homo sapiens
  ref <308>: DATABASE ACCESSION NUMBER: NM_003134
  ref <309>: DATABASE ENTRY DATE: 2001-06-18
tcgagccagcgtcgccgcgatggtgttgttggagagcgagcagttcctgacggagctgaccagacttttccagaagtgccggacgtcgggcagcgtctatatcaccttgaagaagtatgacggtcgaaccaaacccattccaaagaaaggtactgtggagggctttgagcccgcagacaacaagtgtctgttaagagctaccgatgggaagaagaagatcagcactgtggtgagctccaaggaagtgaataagtttcagatggcttattcaaacctccttagagctaacatggatgggttgaagaagagagacaaaaagaacaaaactaagaagaccaaagcagcagcagcagcagcagcagcagcacctgccgcagcagcaacagcagcaacaacagcagcaacaacagcagcaacagcagcacagtaaagggcatacatttcctgctttcaccaattaaccactgaattgctattttttccttttggccagatagctaggtttctggttcccccacagtaggtgttttcacataagattagggtccttttggaaagaatagttgcagtgtttataggatagttgtggtaagaatctagtttattttgcatttggctaattggtctgtgctgcatggttatatactcctggattatagattaaaagtctctgtagacatctctgtgaagagcaagctatcattaaacatgtctgtttatc

SEQ ID NO: 875 - DNA, 4326 bp, Homo sapiens
  ref <308>: DATABASE ACCESSION NUMBER: NM_003137
  ref <309>: DATABASE ENTRY DATE: 2001-06-18
atataaaatagtattccaaataagtacattttatagcaaaattatgcatttttcctaagactttcatcaccaatatcgccttataccctgcttttgttgggtctcaccatggagcggaaagtgcttgcgctccaggcccgaaagaaaaggaccaaggccaagaaggacaaagcccaaaggaaatctgaaactcagcaccgaggctctgctccccactctgagagtgatctaccagagcaggaagaggagattctgggatctgatgatgatgagcaagaagatcctaatgattattgtaaaggaggttatcatcttgtgaaaattggagatctattcaatgggagataccatgtgatccgaaagttaggctggggacacttttcaacagtatggttatcatgggatattcaggggaagaaatttgtggcaatgaaagtagttaaaagtgctgaacattacactgaaacagcactagatgaaatccggttgctgaagtcagttcgcaattcagaccctaatgatccaaatagagaaatggttgttcaactactagatgactttaaaatatcaggagttaatggaacacatatctgcatggtatttgaagttttggggcatcatctgctcaagtggatcatcaaatccaattatcaggggcttccactgccttgtgtcaaaaaaattattcagcaagtgttacagggtcttgattatttacataccaagtgccgtatcatccacactgacattaaaccagagaacatcttattgtcagtgaatgagcagtacattcggaggctggctgcagaagcaacagaatggcagcgatctggagctcctccgccttccggatctgcagtcagtactgctccccagcctaaaccagctgacaaaatgtcaaagaataagaagaagaaattgaagaagaagcagaagcgccaggcagaattactagagaagcgaatgcaggaaattgaggaaatggagaaagagtcgggccctgggcaaaaaagaccaaacaagcaagaagaatcagagagtcctgttgaaagacccttgaaagagaacccacctaataaaatgacccaagaaaaacttgaagagtcaagtaccattggccaggatcaaacgcttatggaacgtgatacagagggtggtgcagcagaaattaattgcaatggagtgattgaagtcattaattatactcagaacagtaataatgaaacattgagacataaagaggatctacataatgctaatgactgtgatgtccaaaatttgaatcaggaatctagtttcctaagtctcccaaatggagacagcagcacatctcaagaaacagactcttgtacacctataacatctgaggtgtcagacaccatggtgtgccagtcttcctcaactgtaggtcagtcattcagtgaacaacacattagccaacttcaagaaagcattcgggcagagataccctgtgaagatgaacaagagcaagaacataacggaccactggacaacaaaggaaaatccacggctggaaattttcttgttaatccccttgagccaaaaaatgcagaaaagctcaaggtgaagattgctgaccttggaaatgcttgttgggtgcacaaacatttcactgaagatattcaaacaaggcaatatcgttccttggaagttctaatcggatctggctataatacccctgctgacatttggagcacggcatgcatggcctttgaactggccacaggtgactatttgtttgaacctcattcaggggaagagtacactcgagatgaagatcacattgcattgatcatagaacttctggggaaggtgcctcgcaagctcattgtggcaggaaaatattccaaggaatttttcaccaaaaaaggtgacctgaaacatatcacgaagctgaaaccttggggcctttttgaggttctagtggagaagtatgagtggtctcaggaagaggcagctggcttcacagatttcttactgcccatgttggagctgatccctgagaagagagccactgccgccgagtgtctccggcacccttggcttaactcctaagcccctgcccagcaccacagcagagatcacacactgaccctccgcccttccccttcaagcattttcctcttcccttttcagggtgaagctcttccttcaagagtttctagatcttgttttttttttaatccaacatgttcatttgggtttgcttacttgaccctgtggagatccccacagccattgggcatcctaggtgaatttggccttggttggctctgccaaagactaatggactaaaatgtgaaacagcctcttgccctgtacctttccttcccattaggacatcctttaaattataagcatcctttttgaaaagagctatgaaggtgtatgagcccatccttttattcattgactctaagagtcaaattttctagtgcatatcctattgccagcataaggatgaggagggggaaagggtcttaattctatgtacagcagagacattaaacttgctgtgtccgggctgcatcatcttcctggactgtttctgttgttctctgtgttcacattttttcctgcaacttttaagctactgtcttttttaaatagctatatgaacaccaaatttgggtaccattttatcactgttcaaagcactgtcaaattcctttcatcctttaatagttaagatctttgaatcttcagtctgatttttaatgtaagcaaaaacagaaccattgaatagtaatttcttgagaacctcaggtgttctataaacagtcctttcctgtatgtcttctattaccctaagaccagagttattttggttggttgttttgttttattttttgtttttgtatccatggctggcactttactcattgcacttgagtttattgccccataactaaaggatcaggatgatggtagaacggagatctgggtttcagagctttcccatttaagaaaaatagatcttgagattctgattcttttccaaacagtcccctgctttcatgtacagctttttctttaccttacccaaaattctggccttgaagcagttttcctctatggctttgctttctgattttctcagaggctcgagtctttaatataaccccaaatgaaagaaccaaggggaggggtgggatggcacttttttttgttggtcttgttttgttttgttttttggttggttggttattttttaagattagccattctctgctgctatttccctacataatgtcaatttttaaccataattttgacatgattgagatgtacttgaggcttttttgttttaattgagaaaagactttgcaatttttttttaggatgagcctctcctagacttgacctagaatattacatattcctccagtaatactgaagagcaaaagagaggcaggattggggtcacagccgcttcttcagcatggaccaagtgggccttggggattgcagcgttctcgaagtggctgtaggactcgaatttacagaaagccacagaggtgcaacttgaggctctgctagcaagccaccagtgaggctattgggtaaccacctttctatacaggagattggaatctactttgtcatttatccaccacagtgacaaaggaaaagtggtgccgttatgcaatccatttaactcataaacatattactctgagtaactggccagccattcatcggatccttcattgggtactcctgaaatcagacatgttcctgtagaaagaattttaagttaggctttctatgcacctatcaagaatcaagagaatagattgtatcaaacaacggcagggaaatccttcagcaattctaatccactttgggttttcagctgtttttacatctaaagcaatagactagaactgaattatcttctacatagtaaaatcacaattgtggaattctggtgatattaaggtgaaataacaaaacacaaaaggccctattttaacagttgatgtgacagtaagttttaatagaacctgtaacttcattttggaaatgcttctccaccaaataagggctttttcccctatttaaggagccagatggattgaaagatgtggaaataggcagctgtagatcttgatcttccaggtaccccatgtacctttattgagcttaattataatactgtcaaattgccacgatctcactaaaggatttctatttgctgtcagttaaaaataaagccctaaatacatttttattctttctactgagggcattgtctgttttctttgtaaatgccgtacaataaacaaattatttaataaccta

SEQ ID NO: 876 - DNA, 3285 bp, Homo sapiens
  ref <308>: DATABASE ACCESSION NUMBER: NM_003144
  ref <309>: DATABASE ENTRY DATE: 2001-06-18
ctagaattcagcggccgctgaattctagacccggatgaagagtaacgccattaccgcccgagccgccgagagccttagccgacggaaactggacactggaccggcagcgccatgagactcctcccccgcttgctgctgcttctcttactcgtgttccctgccactgtcttgttccgaggcggccccagaggctcgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggaccaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccagtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtaattgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatggcctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcattttttttttttagcatagattgagaacagttgaactcttaaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccggatgtgtgagaataatgtgttcataaagcatggatctcgtaaaaaaaaaaaaaaaaaaaaa

SEQ ID NO: 877 - DNA, 2839 bp, Homo sapiens
  ref <308>: DATABASE ACCESSION NUMBER: NM_003146
  ref <309>: DATABASE ENTRY DATE: 2001-06-18
gaattccgtacggcttccggtggcgggacgcggggccgcgcacgcgggaaaagcttccccggtgtccccccatccccctccccgcgccccccccgcgtccccccagcgcgcccacctctcgcgccggggccctcgcgaggccgcagcctgaggagattcccaacctgctgagcatccgcacacccactcaggagttggggcccagctcccagtttacttggtttcccttgtgcagcctggggctctgcccaggccaccacaggcaggggtcgacatggcagagacactggagttcaacgacgtctatcaggaggtgaaaggttccatgaatgatggtcgactgaggttgagccgtcagggcatcatcttcaagaatagcaagacaggcaaagtggacaacatccaggctggggagttaacagaaggtatctggcgccgtgttgctctgggccatggacttaaactgcttacaaagaatggccatgtctacaagtatgatggcttccgagaatcggagtttgagaaactctctgatttcttcaaaactcactatcgccttgagctaatggagaaggacctttgtgtgaagggctggaactgggggacagtgaaatttggtgggcagctgctttcctttgacattggtgaccagccagtctttgagatacccctcagcaatgtgtcccagtgcaccacaggcaagaatgaggtgacactggaattccaccaaaacgatgacgcagaggtgtctctcatggaggtgcgcttctacgtcccacccacccaggaggatggtgtggaccctgttgaggcctttgcccagaatgtgttgtcaaaggcggatgtaatccaggccacgggagatgccatctgcatcttccgggagctgcagtgtctgactcctcgtggtcgttatgacattcggatctaccccacctttctgcacctgcatggcaagacctttgactacaagatcccctacaccacagtactgcgtctgtttttgttaccccacaaggaccagcgccagatgttctttgtgatcagcctggatcccccaatcaagcaaggccaaactcgctaccacttcctgatcctcctcttctccaaggacgaggacatttcgttgactctgaacatgaacgaggaagaagtggagaagcgctttgagggtcggctcaccaagaacatgtcaggatccctctatgagatggtcagccgggtcatgaaagcactggtaaaccgcaagatcacagtgccaggcaacttccaagggcactcaggggcccagtgcattacctgttcctacaaggcaagctcaggactgctctacccgctggagcggggcttcatctacgtccacaagccacctgtgcacatccgcttcgatgagatctcctttgtcaactttgctcgtggtaccactactactcgttcctttgactttgaaattgagaccaagcagggcactcagtataccttcagcagcattgagagggaggagtacgggaaactgtttgattttgtcaacgcgaaaaagctcaacatcaaaaaccgaggattgaaagagggcatgaacccaagctacgatgaatatgctgactctgatgaggaccagcatgatgcctacttggagaggatgaaggaggaaggcaagatccgggaggagaatgccaatgacagcagcgatgactcaggagaagaaaccgatgagtcattcaacccaggtgaagaggaggaagatgtggcagaggagtttgacagcaacgcctctgccagctcctccagtaatgagggtgacagtgaccgggatgagaagaagcggaaacagctcaaaaaggccaagatggccaaggaccgcaagagccgcaagaagcctgtggaggtgaagaagggcaaagaccccaatgcccccaagaggcccatgtctgcatacatgctgtggctcaatgccagccgagagaagatcaagtcagaccatcctggcatcagcatcacggatctttccaagaaggcaggcgagatctggaagggaatgtccaaagagaagaaagaggagtgggatcgcaaggctgaggatgccaggagggactatgaaaaagccatgaaagaatatgaagggggccgaggcgagtcttctaagagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggactctgaagaagaagaactagccagtactccccccagctcagaggactcagcgtcaggatccgatgagtagaaacggaggaaggttctctttgcgcttgccttctcacaccccccgactccccacccatattttggtaccagtttctcctcatgaaatgcagtccctggattctgtgccatctgaacatgctctcctgttggtgtgtatgtcactagggcagtggggagacgtcttaactctgctgcttcccaaggatggctgtttataatttggggagagatagggtgggaggcagggcaatgcaggatccaaatcctcatcttactttcccgaccttaaggatgtagctgctgcttgtcctgttcaagttgctggagcaggggtcatgtgaggccaggcctgtagctcctacctggggcctatttctactttcattttgtatttctggtctgtgaaaatgatttaataaagggaactgactttggaaaccaaaaaaaggaattc

SEQ ID NO: 878 - DNA, 2963 bp, Homo sapiens
  ref <308>: DATABASE ACCESSION NUMBER: NM_003149
  ref <309>: DATABASE ENTRY DATE: 2001-06-18
gttcctccgggagcccaacaccgttcccgcgcggccacgatgatccctccgagcagcccccgcgaggacggcgtggacgggctgcccaaggaggcggtgggcgccgagcaaccgccctctcctgcatccaccagcagccaggaatccaagctccagaaactaaaacgatcactttctttcaagaccaagagtttacggagcaaaagtgctgacaacttcttccagcgaaccaacagcgaagacatgaaactgcaagcacacatggtggctgagatcagccccagctccagcccactccctgctccaggaagcctgacgtccacacccgccagggctggtctgcatccaggtggcaaggctcatgcctttcaggaatacatcttcaagaagcccactttctgtgatgtctgcaaccacatgatagtgggaacaaatgctaagcatggactgcgctgcaaagcctgtaagatgagcatccaccacaagtgcacagatggcctggcaccccagcggtgcatgggcaagctgccaaaggggtttcggcgttactacagctcccccttgctcattcatgaacagtttggctgcattaaagaagttatgcccattgcctgtggcaataaggtggaccctgtctacgagaccctccgcttcggcacctccctggcccagaggacaaagaagggcagctccggcagtggctctgactcacctcacagaacctctacttcagatcttgtggaggttcctgaggaagccaatgggccaggaggcgggtatgacctaaggaaacgcagcaacagcgtgtttacatatccagaaaatggcactgatgatttcagagatccagcgaagaacataaaccaccagggatctctttccaaagacccattacagatgaacacctatgttgccttgtacaaatttgtaccacaggagaatgaagatttggaaatgaggccaggagacataattactcttttagaggattccaatgaagactggtggaaagggaaaattcaagacagaattggcttctttccagccaactttgttcagagactacaacaaaatgagaagatttttagatgtgttagaaccttcattgggtgtaaggaacaggggcagataacactgaaagagaatcagatctgcgtgagttctgaagaagaacaagatggttttatcagagtcctcagtggaaaaaagaaaggcctcatcccccttgatgtactagaaaacatctgattgctggctcctcctccgtttgcagtaggcaagctctgctgcgatgcctctgcctcatctcacactgcgtcaacccaaaggagctgccgcactgacccagccccccaggaaacagtgagacaagaatcaagtatctgagactgtggagtaatagccacaaaacagagggcccactgcacagcatatccaggctgccacaggtggggacgaggctgagagagtcagcaggcagagccagatgccatgcttggcagcagcagtaggactataaaccacagctgtcccccaggatcccactcctttcctgtctgtgtggtgtaagttaacacactggagtgtgctccagtttgcagggtagcccagtgcaaggttcagatccatgtagctaagtattatcctgcttccagacctatgtcaccagtaccaatcagtcagtgtcatcacatttcaggccccaagcaatctctgtgcaaagcatcagaaagacctgcttcccagcccccagcattccagtgctctccaggcttcctctctttgtgattgtgctgtccagagtgtccagcttgttctttctttctcttcagtcctctgagtacatctggtggtgtgcattagatgtgagggctatgttgacatggcatcacctccaaagacctgacctgcctaaagactgatgacaggccatccttcctgctgttctaggtactggcctgggtgacagagcaggacatgagacatagatacagtggggaggagaagtggggaaaggtggagcagagagttcttacttattgaagattatacagccctttcggttatgaagtccctgcttgaaggcaatggacctggggaagagactatcacaaaaagtctccattttcattttacatcctctctattggaggcagcacttttccctcatgctgtcctataggactccactttgaaggttgtgcctacgttgcagggaactaggaacatggaggggaaccaacaacagcatcttagaagaaatgtagccaaattggagtccattcttctttagggcagtatatgaaatcctagcagatgtaaaatggaaaagaatcctaatgcttcttccttcagaaagtagaggaactaggggcccaattagcatcatctaggggaatctctattactctgtacttatactaatgtttacaagaatgcaatatactgtgatgccttcctactcaagcctcctagcattcaaacttccatcctattagtcattaacgtggttaaacttcaattcacaatcaccttggaatcaatgtcagtttgatttattttgttacagagcaataaaatcattagaacaatggtttttaaaagacttaagtggatgcatcctatgcatgtaagcattatttcccaaaccaaagcatcattcatctccatttatttcttttgttcccgctcagtgtgaagttgggaactgagaggggatggctgctggtttcacagaagtttggatgccttactcttatcttaaagccagcatccagaatttcctccctctctgatgccacatgcaaaaccaggtgtacgatgtcaagatggattctttgagagccagggtagatcatatgactgcctttctgtaaaattggatgcctagtacaaatgctctttgcctctaattcagtattccatttaataaaaacaatacagtggctggaaaggagcatcag

SEQ ID NO: 879 - DNA, 2588 bp, Homo sapiens
  ref <308>: DATABASE ACCESSION NUMBER: NM_003151
  ref <309>: DATABASE ENTRY DATE: 2001-06-18
gctttctcctagggactgtgaggggcgcttctgactttggacttgagcactgcctgggacctgtgctgagagagcgctagcatgtctcagtggaatcaagtccaacagttagaaatcaagtttttggagcaggtggatcaattctatgatgacaactttcccatggaaattcggcatctgttggcccaatggattgaaaatcaagactgggaggcagcttctaacaatgaaaccatggcaacgattcttcttcaaaacttgttaatacaactggatgaacagttaggtcgtgtttccaaagagaaaaacctactcttgatacacaatctaaaaagaattaggaaggtccttcagggaaaatttcatggaaatccaatgcatgtagctgtggttatttcaaactgtttaagggaagagaggagaatattggctgcagccaacatgcctgtccaggggcctctagagaaatccttacaaagttcttcagtttcagaaagacagaggaatgtggagcacaaagtggctgccattaaaaacagtgtgcagatgacagaacaagataccaaatacttagaagatctgcaagacgaatttgactacaggtataaaacaattcagacaatggatcagagtgacaagaatagtgccatggtgaatcaggaagttttgacactgcaggaaatgcttaacagcctcgatttcaagagaaaggaggctctcagtaaaatgacccaaatcatccatgagacagacctgttaatgaacaccatgctcatagaagagctgcaagactggaagcggcggcagcaaatcgcctgcatcgggggtccactccacaatgggctcgaccagcttcagaactgctttacactattggcagaaagtcttttccaactgagaaggcaattggagaaactagaggagcaatctaccaaaatgacatatgaaggtgatcccattccaatgcaaagaactcacatgctagaaagagtcaccttcttgatctacaaccttttcaagaactcatttgtggttgagcgacagccatgtatgccaacccaccctcagaggccgttggtacttaaaaccctaattcagttcactgtaaaactaaggctactaataaaattgccagaactaaactatcaggtaaaggttaaggcatcaattgacaagaatgtttcaactctaagcaaccgaagatttgtactttgtggaactaatgtcaaagccatgtctattgaagaatcttccaatgggagtctctcagtagaatttcgacatttgcaaccaaaggaaatgaagtccagtgctggaggtaaaggaaatgagggctgtcacatggtgactgaagaacttcattccataacgtttgaaacacagatctgcctctatggcctgaccatagatttggagaccagctcattgcctgtggtgatgatttccaatgtcagtcagttacctaatgcttgggcatccatcatttggtacaacgtgtcaaccaacgattcccagaacttggttttctttaataatcctccacctgccacattgagtcaactactggaggtgatgagctggcagttttcatcgtacgttggtcgtggtcttaactcagatcaactccatatgctggcagagaagcttacagtccaatctagctacagtgatggtcacctcacctgggccaagttctgcaaggaacatttacctggtaaatcatttaccttttggacatggcttgaagcaatattggatctaattaagaaacacattcttcccctttggattgatgggtatgtcatgggctttgttagcaaagagaaggaacggctgttgctaaaggataaaatgcctggcacctttttattaagattcagtgaaagccatctcggaggaataactttcacctgggtggaccattctgaaagtggggaagtgagattccactctgtagaaccctacaataaaggccggttgtctgctctgccattcgctgacatcctgcgagactacaaagttattatggctgaaaacattcctgaaaaccctctgaagtacctatatcctgacattcccaaagacaaagccttcggtaaacactacagctctcagccttgcgaagtttcaagaccaacagaaaggggtgacaaaggttatgttccttctgtttttatccccatctcaacaatccgaagtgattcaacagagccacattctccatcagaccttcttcccatgtctccaagtgtgtatgcggtgttgagagaaaacctgagtcccacaacaattgaaactgcaatgaagtctccttattctgctgaatgacaggataaactctgacgcaccaagaaaggaagcaaatgaaaaagtttaaagactgttctttgcccaataaccacattttatttcttcagctttgtaaataccaggttctaggaaatgtttgacatctgaagctctcttcacactcccgtggcactcctcaattgggagtgttgtgactgaaatgcttgaaaccaaagcttcagataaacttgcaagataagacaactttaagaaaccagtgttaataacaatattaacag

SEQ ID NO: 880 - DNA, 3698 bp, Homo sapiens
  ref <308>: DATABASE ACCESSION NUMBER: NM_003157
  ref <309>: DATABASE ENTRY DATE: 2001-06-18
tggatcgctatggcagcggcgtcgtcgcgggccgggccccagcaatcccgcccgggcccggctgcctcaacagccgcccccactgccccctctcgggcatgaaccgagcttcttgttgccgcccgctgccctacccgccgctgccgccgcatcccgactctgggccagcgctgggaacatgcccctggccgcctactgctacctgcgggtcgtgggcaaggggagctatggagaggtgacgcttgtgaagcaccggcgggacggcaagcagtatgtcatcaaaaaactgaacctccgaaatgcctctagccgagagcggcgagctgctgaacaggaagcccagctcttgtctcagttgaagcatcccaacattgtcacctacaaggagtcatgggaaggaggagatggtctgctctacattgtcatgggcttctgtgaaggaggtgatttgtaccgaaagctcaaggagcagaaagggcagcttctgccggagaatcaggtggtagagtggtttgtacagatcgccatggctttgcagtatttacatgaaaaacacatccttcatcgagatctgaaaactcaaaatgtcttcctaacaagaacaaacatcatcaaagtaggggacctaggaattgcccgagtgttggagaaccactgtgacatggctagcaccctcattggcacaccctactacatgagccctgaattgttctcaaacaaaccctacaactataagtctgatgtttgggctctaggatgctgtgtctatgaaatggccaccttgaagcatgctttcaatgcaaaagatatgaattctttagtttatcggattattgaaggaaagctgccagcaatgccaagagattacagcccagagctggcagaactgataagaacaatgctgagcaaaaggcctgaagaaaggccgtctgtgaggagcatcctgaggcagccttatataaagcggcaaatctccttctttttggaggccacaaagataaaaacctccaaaaataacattaaaaatggtgactctcaatccaagccttttgctacagtggtttctggagaggcagaatcaaatcatgaagtaatccacccccaaccactctcttctgagggctcccagacatatataatgggtgaaggcaaatgtttgtcccaggagaaacccagggcctctggtctcttgaagtcacctgccagtctgaaagcccatacctgcaaacaggacttgagcaataccacagaactagccacaatcagtagcgtaaatattgacatcttacctgcaaaagggagggattcagtgagtgatggctttgttcaggagaatcagccaagatatttggatgcctctaatgagttaggaggtatatgcagtatttctcaagtggaagaggagatgctgcaggacaacactaaatccagtgcccagcctgaaaacctgattcccatgtggtcctctgacattgtcactggggaaaagaatgaaccagtgaagcctctgcagcccctaatcaaagaacaaaagccaaaggaccagagtcttgccctgtcgcccaagctggagtgcagtggcacaatcttggctcacagcaacctccgcctcctgggttcaagtgattctccagcctcagcctcccgagtagctgggattacaggcgtgtgccaccacgcccaggatcaagttgctggtgaatgtattatagaaaaacagggcagaatccacccagatttacagccacacaactctgggtctgaaccttccctgtctcgacagcgacggcaaaagaggagagaacagactgagcacagaggggaaaagagacaggtccgcagagatctctttgctttccaagagtcgcctcctcgatttttgccttctcatcccattgttgggaaagtggatgtcacatcaacacaaaaagaggctgaaaaccaacgtagagtggtcactgggtctgtgagcagttcaaggagcagtgagatgtcatcatcaaaggatcgaccattatcagccagagagaggaggcgactaaagcagtcacaggaagaaatgtcctcttcaggcccttcagtgaggaaagcgtctctgagtgtagcagggccaggaaaaccccaggaagaagaccagcccttgcctgcccgacggctctcctctgactgcagcgtcactcaggaaaggaaacagattcattgtctgtctgaggatgagttaagttcttctacaagttcaactgataagtcagatggggattacggggaagggaaaggtcagacaaatgaaattaatgccttggtacaattgatgactcagaccctgaaactggattctaaagagagctgtgaagatgtcccggtagcaaacccagtgtcagaattcaaacttcatcggaaatatcgggacacactgatacttcatgggaaggttgcagaagaggcagaggaaatccattttaaagagctaccttcagctattatgccaggttctgaaaagatcaggagactagttgaagtcttgagaactgatgtaattcgtggcctgggagttcagcttttagagcaggtgtatgatcttttggaggaggaggatgaatttgatagagaggtacgtttgcgggagcacatgggtgaaaagtatacaacttacagtgtgaaagctcgccagttgaaattttttgaagaaaacatgaatttttgagcatttgtcctaatctgctgccagaattaaagacctatttttagaggattttggcttaaaaagcaagggcaaacagtcatttggaagccactcaccactgttttatatctcttttttatatctctttggcgtttccctacagaaaagaaattggacagaacagaataatatgaagcaggatcacaaaagaaaaaaaactttggctttcatattctctttgtgaggacaaatctgttgtttgtttgattactgtttactgagccttaatccaccaagtttatatttagaattttatttttttaaggtactaattaacttaaacacagagctataaaatgctggattgaaaattttatattgtaatgtagagataaaagcagtaggagaaacaaatgacataatatgtcgtcataattcctgctattgttaataaccttaaggagtagttgataaattataaaattttaaaaagtcaattcagttctagaaatagatttaaagaatatgaagttctatctagtacttgagcagctgtatttcttttctacacattgatggacttttaatattttattctcatttaatataaacctcatctagggtatatacaaattaaaactgagacacattggctttgtaaatcagtatgtttttacataatggttttgttagatttatttttccatcagtgaaaacatttcttaaacacaaatttcatttccatttaagcaatttgtaagcaaagtccaggtccatttagtttttggatatatttaatgtttgtctcctgaagtttgtcttcatgtactgtaagatattagttgtctttccatgttttaaatgtatgattatatagcacatattttattagttgtttaataagaggtaatacccatctaggaaagaaattttatgaagttaaatacaagtcttgaatagtacattttcacttctgtattcgagggactctaaaaataaatattgctccagaaaa

SEQ ID NO: 881 - DNA, 2033 bp, Homo sapiens
  ref <308>: DATABASE ACCESSION NUMBER: NM_003158
  ref <309>: DATABASE ENTRY DATE: 2001-06-18
gaattccgggactgagctcttgaagacttgggtccttggtcgcaggtggagcgacgggtctcactccattgcccaggccagagtgcgggatatttgataagaaacttcagtgaaggccgggcgcggtgctcatgcccgtaatcccagcattttcggaggccgaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcgttcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcgcacctgaaaataatcctgaggaggaactggcatcaaaacagaaaaatgaagaatcaaaaagaggcagtggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctaacttatataacagaattgcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatattttgtttttactcagcaggtgtgccttaacctccctattcagaaagctccacatcaataaacatgacactctgaagtgaaagtagccacgagaattgtgctacttatactggaacataatctggaggcaaggttcgactgcagtcgaaccttgcctccagattatgaaccagtataagtagcacaattctcgtggctactttcacttcagagtgtcatgtttattgatgtggagctttctgaatagggaggttaaggcacacctgctgagtaaaacaaatatttcttgtgtagcgttcttaggaatctggtgtctgtccggccccggtaggcctgttgggtttctagtcctccttaccatcatctccatatgagagtgtgaaaataggaacacgtgctctacctccatttagggatttgcttgggatacagaagaggccatgtgtctcagagctgttaagggcttatttttttaaaacattggagtcatagcatgtgtgtaaactttaaatatgcaggccttcgtggctcgag

SEQ ID NO: 882 - DNA, 3899 bp, Homo sapiens
  ref <308>: DATABASE ACCESSION NUMBER: NM_003165
  ref <309>: DATABASE ENTRY DATE: 2001-06-18
ctgacgcgcggctgcggggcggagagctgcggctggcccagcgcgcccacctgaggaggcggcggggtccgcaggcgtcgcgggacgaggagatcggagccgggagactcgcgcagcgccatggcccccattggcctcaaagctgttgtcggagagaagattatgcatgatgtgataaagaaggtcaagaagaagggggaatggaaggtgctggtggtggatcagttaagcatgaggatgctgtcctcctgctgcaagatgacagacatcatgaccgagggcataacgattgtggaagatatcaataagcgcagagagccgctccccagcctggaggctgtgtatctcatcactccatccgagaagtccgtccactctctcatcagtgactttaaggacccgccgactgctaaataccgggctgcacacgtcttcttcactgactcttgtccagatgccctgtttaatgaactggtaaaatcccgagcagccaaagtcatcaaaactctgacggaaatcaatattgcatttctcccgtatgaatcccaggtctattccttggactctgctgactctttccaaagcttctacagtccccacaaggctcagatgaagaatcctatactggagcgcctggcagagcagatcgcgaccctttgtgccaccctgaaggagtacccggctgtgcggtatcggggggaatacaaggacaatgccctgctggctcagctaatccaggacaagctcgatgcctataaagctgatgatccaacaatgggggagggcccagacaaggcacgctcccagctcctgatcctggatcgaggctttgaccccagctcccctgtgctccatgaattgacttttcaggctatgagttatgatctgctgcctatcgaaaatgatgtatacaagtatgagaccagcggcatcggggaggcacgggtgaaggaggtgctcctggacgaggacgacgacctgtggatagcactgcgccacaagcacatcgcagaggtgtcccaggaagtcacccggtctctgaaagatttttcttctagcaagagaatgaatactggagagaagaccaccatgcgggacctgtcccagatgctgaagaagatgcctcagtaccagaaagagctcagcaagtactccacccacctgcaccttgctgaggactgtatgaagcattaccaaggcaccgtagacaaactctgccgagtggagcaggacctggccatgggcacagatgctgagggagagaagatcaaggaccctatgcgagccatcgtccccattctgctggatgccaatgtcagcacttatgacaaaatccgcatcatccttctctacatctttttgaagaatggcatcacggaggaaaacctgaacaaactgatccagcacgcccagatacccccggaggatagtgagatcatcaccaacatggctcacctcggcgtgcccatcgtcaccgattccacgctgcgtcgccggagcaagccggagcggaaggaacgcatcagcgagcagacctaccagctctcacggtggactccgattatcaaggacatcatggaggacactattgaggacaaacttgacaccaaacactacccttatatctctacccgttcctctgcctccttcagcaccaccgccgtcagcgcccgctatgggcactggcataagaacaaggccccaggcgagtaccgcagtggcccccgcctcatcattttcatccttgggggtgtgagcctgaatgagatgcgctgcgcctacgaggtgacccaggccaacggaaagtgggaggtgctgataggttctactcacattcttactcccaccaaatttctcatggacctgagacaccccgacttcagggagtcctctagggtatcttttgaggatcaggctccaacaatggagtgagagccaaagaaacaaagatccacacacatcctcaccccacagaaactgctggacacactgaagaaactgaataaaacagatgaagaaataagcagttaaaaaaataagtcgcccctccaaaacacgcccccatcccacagcgctccgcagcttcccaccaccgcccgcctcagttcctttgcgtctgttgcctccccagccctgcacgccctggctggcactgttgccgctgcattctcgtgttcagtgatgccctcttcttgtttgaaacaaaagaaaataatgcattgtgttttttaaaaagagtatcttatacatgtatcctaaaaagagaagctcatgtgcaattggtgcacagcaggagaaatttctggactgttaggatgaatggacgccttctccccgttatttaagatttgtgaccttgtacataaccctgggtgacgtgcacattgcttgggtatggaacggtagaaatttgggtgtttttaaaaccttgtttggggttgttcctgtccttgttgagaatcatagagatgtctgtgttcttggagtatttcacactgaggactaatctgctatcttcattccagtccctacccctcagtgcctgctctcatccaaataacctgggaggtgacaatcaggatatctcaggaggtccaaggtggaacagacctctttgcctttcccagcgtctcatacccccggtagtgcagctgtgggtggaggctggggtgtctgcacgaagtcaggccagcgtcctcctccacagcctgtcactgccccctccccagcctgtgtccacagtgctgtgatcccgagggaagtcctccagtctaagtcacagtgccctgacaggtgagaagcaaactcccgctggaagcctccatctctttggaaaaacagttagtctggagcctgtggcccaggcccttctgtccccaggcatcatcccaacagctcattttccctagtccgccttcgttcaagggtcaggaatggaccagaacagatgggttctggaggcccctgaacagagggctatggctgtggagaaggttcttggcccgttggactcacacagaccctgtaccctctcggcaagcatcttcagtcagattatcctcagtttcagatacttcataataccttgtgttgtgtggggtcatacatcatcgtgtttgtaagagaagatggtcattttattctctgtataaaacttagctctaaagcagaaactaaagcagcaaatgcaggaaggctgtctcgccatcctcaagactcagcagctctcattctccagtggtgagcacaccatttgtgctgctgctgttgtcgtgaaatataataacagtggaagtcacaaaaatgtcccctgcccagccccctcgccgcccttgacctcctgcaggccatgtgtgtattacttgtctagtgatgtcctctcaaagtgctgtacgcgagctcggcgccacctccgcctccctttcagagcctgctccccgccctctctgctcgctgcattgtggtgttctcttctcaaggctttgaaatctccccttgcactgagattagtcgtcagatctctccccgtctccctcccaacttatacgacctgatttccttaggacggaaccgcaggcacctgcgccgggcgtcttactcccgctgcttgttctgtcccctccctcggaccaaacagtgctcatgcttcaggaccttgtttgtcgaagatgttggtttccctttctctgttatttatataaaaataatttatcaaaaggatattttaaaaaagctagtctgtcttgaaacttgtttaccttaaaattatcagaatctcagtgtttgaaagtactgaagcacaaacatatatcatctctgtaccattctgtactaaagcacttgagtctaataaataaagaaatcagcaccccttcccggtgtccagggggaaaaaaaaa

SEQ ID NO: 883 - DNA, 1019 bp, Homo sapiens
  ref <308>: DATABASE ACCESSION NUMBER: NM_003172
  ref <309>: DATABASE ENTRY DATE: 2001-06-18
cggggccgggtgcgatggcggcggtggctgcgttgcagctggggctgcgggcggcggggctgggacgggccccggccagcgccgcctggaggagcgtcctcagggtctccccgcgcccaggggtggcctggaggccaagcagatgtggcagttctgcagcagaagcatctgccacaaaagcggaagatgactcctttcttcagtgggtcctgctcctcatccctgtgactgcctttggcttggggacatggcaggtccagcgtcggaagtggaagctgaacctgattgcagagttggagtccagagttctggctgagcctgtccctctgccagccgacccaatggaactgaaaaatctggagtataggccagtgaaggtcagggggtgctttgaccattccaaggagctgtatatgatgccccggaccatggtggaccctgtccgggaggcccgggagggcggcctcatctcctcctcaactcagagtggggcctatgtggtcactcccttccactgcaccgacctgggagtcaccatcctggtaaatagagggttcgttcccaggaagaaagtgaatcctgaaacccggcagaaaggccagattgagggagaagtggacctcattgggatggtgaggctgacagaaaccaggcagccttttgtccctgagaacaatccagaaaggaaccactggcattatcgagacctggaagctatggccagaatcacaggcgcagagcccatcttcattgatgccaacttccagagcacagtccctggaggacccattggagggcaaaccagagttactctgaggaacgagcatctgcagtacatcgtgacctggtatggactctctgcagctacatcctacctgtggtttaagaaattcctacgtgggacacctggtgtgtgacagatcagctgctgaagccctgtccctggataatgcagtatttcaagactgcctttatgctggatcatgtgctactggtataaagttctggccttctacctt

SEQ ID NO: 884 - DNA, 2541 bp, Homo sapiens
  ref <308>: DATABASE ACCESSION NUMBER: NM_003177
  ref <309>: DATABASE ENTRY DATE: 2001-06-18
gaggaagagccgcgggcccggcggctgaggccaccccggcggcggctggagagcgaggaggagcgggtggccccgcgctgcgcccgccctcgcctcacctggcgcaggtggacacctgcgcaggtgtgtgccctccggcccctgaagcatggccagcagcggcatggctgacagcgccaaccacctgcccttctttttcggcaacatcacccgggaggaggcagaagattacctggtccaggggggcatgagtgatgggctttatttgctgcgccagagccgcaactacctgggtggcttcgccctgtccgtggcccacgggaggaaggcacaccactacaccatcgagcgggagctgaatggcacctacgccatcgccggtggcaggacccatgccagccccgccgacctctgccactaccactcccaggagtctgatggcctggtctgcctcctcaagaagcccttcaaccggccccaaggggtgcagcccaagactgggccctttgaggatttgaaggaaaacctcatcagggaatatgtgaagcagacatggaacctgcagggtcaggctctggagcaggccatcatcagtcagaagcctcagctggagaagctgatcgctaccacagcccatgaaaaaatgccttggttccatggaaaaatctctcgggaagaatctgagcaaattgtcctgataggatcaaagacaaatggaaagttcctgatccgagccagagacaacaacggctcctacgccctgtgcctgctgcacgaagggaaggtgctgcactatcgcatcgacaaagacaagacagggaagctctccatccccgagggaaagaagttcgacacgctctggcagctagtcgagcattattcttataaagcagatggtttgttaagagttcttactgtcccatgtcaaaaaatcggcacacagggaaatgttaattttggaggccgtccacaacttccaggttcccatcctgcgtcctcccctgcccaagggaaccggcaagagagtactgtgtcattcaatccgtatgagccagaacttgcaccctgggctgcagacaaaggcccccagagagaagccctacccatggacacagaggtgtacgagagcccctacgcggaccccgaggagatcaggcccaaggaggtttacctggaccgaaagctgctgacgctggaagacaaagaactgggctctggtaattttggaactgtgaaaaagggctactaccaaatgaaaaaagttgtgaaaaccgtggctgtgaaaatactgaaaaacgaggccaatgaccccgctcttaaagatgagttattagcagaagcaaatgtcatgcagcagctggacaacccgtacatcgtgcggatgatcgggatatgcgaggccgagtcctggatgctggttatggagatggcagaacttggtcccctcaataagtatttgcagcagaacagacatgtcaaggataagaacatcatagaactggttcatcaggtttccatgggcatgaagtacttggaggagagcaattttgtgcacagagatctggctgcaagaaatgtgttgctagttacccaacattacgccaagatcagtgatttcggactttccaaagcactgcgtgctgatgaaaactactacaaggcccagacccatggaaagtggcctgtcaagtggtacgctccggaatgcatcaactactacaagttctccagcaaaagcgatgtctggagctttggagtgttgatgtgggaagcattctcctatgggcagaagccatatcgagggatgaaaggaagtgaagtcaccgctatgttagagaaaggagagcggatggggtgccctgcagggtgtccaagagagatgtacgatctcatgaatctgtgctggacatacgatgtggaaaacaggcccggattcgcagcagtggaactgcggctgcgcaattactactatgacgtggtgaactaaccgctcccgcacctgtcggtggctgcctttgatcacaggagcaatcacaggaaaatgtatccagaggaattgattgtcagccacctccctctgccagtcgggagagccaggcttggatggaacatgcccacaacttgtcacccaaagcctgtcccaggactcaccctccacaaagcaaaggcagtcccgggagaaaagacggatggcaggatccaaggggctagctggatttgtttgttttcttgtctgtgtgattttcatacaggttatttttacgatctgtttccaaatccctttcatgtctttccacttctctgggtcccggggtgcatttgttactcatcgggcccagggacattgcagagtggcctagagcactctcaccccaagcggccttttccaaatgcccaaggatgccttagcatgtgactcctgaagggaaggcaaaggcagaggaatttggctgcttctacggccatgagactgatccctggccactgaaaagctttcctgacaataaaaatgttttgaggctttaaaaagaaaaaaaaaaa

SEQ ID NO: 885 - DNA, 1448 bp, Homo sapiens
  ref <308>: DATABASE ACCESSION NUMBER: NM_003197
  ref <309>: DATABASE ENTRY DATE: 2001-06-18
tcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtgactattaagaccatgttggaagatttgggaatggatgatgaaggagatgatgacccagttcctctaccaaatgtgaatgcagcaatattaaaaaaggtcattcagtggtgcacccaccacaaggatgaccctcctcctcctgaagatgatgagaacaaagaaaagcgaacagatgatatccctgtttgggaccaagaattcctgaaagttgaccaaggaacactttttgaactcattctggctgcaaactacttagacatcaaaggtttgcttgatgttacatgcaagactgttgccaatatgatcaaggggaaaactcctgaggagattcgcaagaccttcaatatcaaaaatgactttactgaagaggaggaagcccaggtacgcaaagagaaccagtggtgtgaagagaagtgaaatgttgtgcctgacactgtaacactgtaaggattgttccaaatactagttgcactgctctgtttataattgttaatattagacaaacagtagacaaatgcagcagcaagtcaattgtattagcagaatattgtcctcattgcatgtgtagttgtagctcgagtcccaaaccttacggccaagtttcttctagtatgatggaaagtttcttttttctttgctctgaataaaactgaactgtgggttctctataagtggcattttgggctttcctcccttttttgtaaagcaatgtctgcctagtttattgtccaagttaactttaggtgaccttttaaaagttggcattgaaaataaaacaacttgcaaaaaagttttctggaatagaattaacaaaatattatctttatcatgagttggaaactggaaaaaggcttcttgaagtaaatgttctgagtggagctactaggatgtcttccagcctcctgcagtcaaggagtaccactgtattgattagcctgtatgtagcagggctcccttcattgcatctgaggacttgttttctttttctttatttttaatcctcttagttttaaatatattgcctagagactcagttactacccagtttgtggttttttgggagaaatgtaactggacagttagcttttcaattaaaaagacacttaacccatgtgggatgtcatctttttataattagtgttcccatgtggagaaaattattcacactacttgcatgtaaagaataatttaacttttaacattaaaatatgtggtaaaacccagaaagcatccatcatgaatgcaagatactttcaataaagtaagttatat

SEQ ID NO: 886 - DNA, 2910 bp, Homo sapiens
  ref <308>: DATABASE ACCESSION NUMBER: NM_003202
  ref <309>: DATABASE ENTRY DATE: 2001-06-18
gcccaggtgactgactaatccgccgccttcaggagacagaattggccaaggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagaccctggctcgcctaagaaatgccgtgctcgctttggcctcaaccagcagacggattggtgtggtccgtgcagataactctcttcactattcctaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagcggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaaatgacagagacccagatctcatggaaactggcaggggtcctgttaacgtcatctcagggtccagaccctgaagatttcagaggctgcagaacttctgcctgaacctggggtcatcgattcaaactgctccaagtggtgggaatcagatctgtcttgatgtgtcatctaattaagggaatcccttgtacctatgactccgtcgatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagcttctgggcagcttgagagggcaaacccaaaacctcatgacagccagagcctgtctttcagcattcagtcgcctgggaagctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgccgggccaggcgcggtcgtcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaagggctgtccatgtattcacacacccctcaaaaaaagcctttagttcctactttagccactggtttctcagaatccaaagatcacatattctagtgtaacactgcaagaagtcttgagaaaaagattattgtagtgttcaaaatatttttgtattgttaatgcatcatcatagaaaaacttttaaacatgagaataaagatactttttactgggtttgtttttcaaagcctgaaaaaaa

SEQ ID NO: 887 - DNA, 1670 bp, Homo sapiens
  ref <308>: DATABASE ACCESSION NUMBER: NM_003213
  ref <309>: DATABASE ENTRY DATE: 2001-06-18
ggcgggagggccgcagctccggcgccgcgccgtcccgccagaacgatcgccgcggccggaagagttggcgctcggggcggactccttggaactggcttagcgcacccatcccaccttcccgcaccctgggaccggtccaacgagcgctcctccaagcggagccttggagggcacggccggcaccattacctccaacgagtggagctctcccacctcccctgaggggagcaccgcctctgggggcagtcaggcactggacaagcccatcgacaatgacggagagggcgtgtggagcccggatattgagcagagtttccaggaggccctcgccatctacccgccctgtggcaggcgcaaaatcatcctgtcggacgagggcaagatgtatggtcgaaacgagctgattgcccgctacatcaagctccggacagggaagacccgcaccaggaagcaggtctccagccacatccaggtgctggctcgtcgcaaagctcgcgagatccaggccaagctaaaggaccaggcagctaaggacaaggccctgcagagcatggctgccatgtcgtctgcacagatcatctccgccacggccttccacagtagcatgcgcctcgcccggggccccggccgcccagcagtctcagggttttggcaaggagctttgccaggccaagccgaaacgtcccatgatgtgaagcctttctctcagcaaacctatgctgtccagcctccgctgcctctgccagggtttgagtctcctgcagggcccgccccatcgccctctgcgcccccggcacccccatggcagggccgcaggcgtggcagctccaagctctggatgttggagttctctgccttcctggagcagcagcaggacccggacacgtacaacaagcacctgttcgtgcacattggccagtccagcccaagctacctgcgcccctacctcgaagccgtggacatccgccaaatctatgacaaattcccggagaaaaagggtggactcaaggatctcttcgaacggggaccctccaatgccttttttcttgtgaagttctgggcagacctcaacaccaacatcgaggatgaaggcagctccttctatggggtctccagccagtatgagagccccgagaacatgatcatcacctgctccacgaaggtctgctctttcggcaagcaggtggtggagaaagttgagacagagtatgctcgctatgagaatggacactactcttaccgcatccaccggtccccgctctgtgagtacatgatcaacttcatccacaagctcaagcacctccctgagaagtacatgatgaacagcgtgctggagaacttcaccatcctgcaggtggtcaccaacagagacacacaggagaccttgctgtgcattgcctatgtctttgaggtgtcagccagtgagcacggggctcagcaccacatctacaggctggtgaaagaatgagagactcggggagcagggaggggggaagagacgtgtgtgcaggaaacggggacgtggggaggggacctgcaggggccagccccctgaagtgccaagagagctgagaggagcagttgtgactctacccaggaacaaactgtgcctgaacctgaggtgcccaaccccaaataaacccaagatgctgtgtattttcagaggaaaa

SEQ ID NO: 888 - DNA, 2600 bp, Homo sapiens
  ref <308>: DATABASE ACCESSION NUMBER: NM_003217
  ref <309>: DATABASE ENTRY DATE: 2001-06-18
ggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacagcaatgatctttacctgcttcaccctcagtgcactctatgccaggcgccgtagctacctctttctgggaggtatcttgatgtcagccctgagcttgttgcttttgtcttccctggggaatgttttctttggatccatttggcctttccaggcaaacctgtatgtgggactggtggtcatgtgtggcttcgtccttgttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagccagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccgccccttgcctgaccctcagggagtcagcctgcttccatccatgggtgggaagacttcagcacaaaggaaagactaattcttgtcaggcatttttgaaaaggctgattatgtgtatcaaggtacagctacgtaggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaaaaaaaaaaaaaaaaaaaaaaaa

SEQ ID NO: 889 - DNA, 540 bp, Homo sapiens
  ref <308>: DATABASE ACCESSION NUMBER: NM_003225
  ref <309>: DATABASE ENTRY DATE: 2001-06-18
atccctgactcggggtcgcctttggagcagagaggaggcaatggccaccatggagaacaaggtgatctgcgccctggtcctggtgtccatgctggccctcggcaccctggccgaggcccagacagagacgtgtacagtggccccccgtgaaagacagaattgtggttttcctggtgtcacgccctcccagtgtgcaaataagggctgctgtttcgacgacaccgttcgtggggtcccctggtgcttctatcctaataccatcgacgtccctccagaagaggagtgtgaattttagacacttctgcagggatctgcctgcatcctgacggggtgccgtccccagcacggtgattagtcccagagctcggctgccacctccaccggacacctcagacacgcttctgcagctgtgcctcggctcacaacacagattgactgctctgactttgactactcaaaattggcctaaaaattaaaagagatcgatattaaaaaaaaaaaaaaaaaaaaaaaaaaaaaaaaaaaaaaaaaaaaaaaaaa

SEQ ID NO: 890 - DNA, 398 bp, Homo sapiens
  ref <308>: DATABASE ACCESSION NUMBER: NM_003226
  ref <309>: DATABASE ENTRY DATE: 2001-06-18
gatgctggggctggtcctggccttgctgtcctccagctctgctgaggagtacgtgggcctgtctgcaaaccagtgtgccgtgccggccaaggacagggtggactgcggctacccccatgtcacccccaaggagtgcaacaaccggggctgctgctttgactccaggatccctggagtgccttggtgtttcaagcccctgactaggaagacagaatgcaccttctgaggcacctccagctgcccctgggatgcaggctgagcacccttgcccggctgtgattgctgccaggcactgttcatctcagtttttctgtccctttgctcccggcaagctttctgctgaaagttcatatctggagcctgatgtcttaacgaataaaggtcccatgctccacccg

SEQ ID NO: 891 - DNA, 5010 bp, Homo sapiens
  ref <308>: DATABASE ACCESSION NUMBER: NM_003234
  ref <309>: DATABASE ENTRY DATE: 2001-06-18
ggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggttcgcttactttgagtgatcctccaacttcatttgatgctaaataggagataccaggttgaaagacctctccaaatgagatctaagcctttccataaggaatgtagcaggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccatttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagcagcatacatttataatgtttgctattgacaagtcattttaatttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcatataaacgtgtagtacagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagtagggccttttggaggtaaaggtata

SEQ ID NO: 892 - DNA, 4119 bp, Homo sapiens
  ref <308>: DATABASE ACCESSION NUMBER: NM_003236
  ref <309>: DATABASE ENTRY DATE: 2001-06-18
ctggagagcctgctgcccgcccgcccgtaaaatggtcccctcggctggacagctcgccctgttcgctctgggtattgtgttggctgcgtgccaggccttggagaacagcacgtccccgctgagtgcagacccgcccgtggctgcagcagtggtgtcccattttaatgactgcccagattcccacactcagttctgcttccatggaacctgcaggtttttggtgcaggaggacaagccagcatgtgtctgccattctgggtacgttggtgcacgctgtgagcatgcggacctcctggccgtggtggctgccagccagaagaagcaggccatcaccgccttggtggtggtctccatcgtggccctggctgtccttatcatcacatgtgtgctgatacactgctgccaggtccgaaaacactgtgagtggtgccgggccctcatctgccggcacgagaagcccagcgccctcctgaagggaagaaccgcttgctgccactcagaaacagtggtctgaagagcccagaggaggagtttggccaggtggactgtggcagatcaataaagaaaggcttcttcaggacagcactgccagagatgcctgggtgtgccacagaccttcctacttggcctgtaatcacctgtgcagccttttgtgggccttcaaaactctgtcaagaactccgtctgcttggggttattcagtgtgacctagagaagaaatcagcggaccacgatttcaagacttgttaaaaaagaactgcaaagagacggactcctgttcacctaggtgaggtgtgtgcagcagttggtgtctgagtccacatgtgtgcagttgtcttctgccagccatggattccaggctatatatttctttttaatgggccacctccccacaacagaattctgcccaacacaggagatttctatagttattgttttctgtcatttgcctactggggaagaaagtgaaggaggggaaactgtttaatatcacatgaagaccctagctttaagagaagctgtatcctctaaccacgagactctcaaccagcccaacatcttccatggacacatgacattgaagaccatcccaagctatcgccacccttggagatgatgtcttatttattagatggataatggttttatttttaatctcttaagtcaatgtaaaaagtataaaaccccttcagacttctacattaatgatgtatgtgttgctgactgaaaagctatactgattagaaatgtctggcctcttcaagacagctaaggcttgggaaaagtcttccagggtgcggagatggaaccagaggctgggttactggtaggaataaaggtaggggttcagaaatggtgccattgaagccacaaagccggtaaatgcctcaatacgttctgggagaaaacttagcaaatccatcagcagggatctgtcccctctgttggggagagaggaagagtgtgtgtgtctacacaggataaacccaatacatattgtactgctcagtgattaaatgggttcacttcctcgtgagccctcggtaagtatgtttagaaatagaacattagccacgagccataggcatttcaggccaaatccatgaaagggggaccagtcatttattttccattttgttgcttggttggtttgttgctttatttttaaaaggagaagtttaactttgctatttattttcgagcactaggaaaactattccagtaatttttttttcctcatttccattcaggatgccggctttattaacaaaaactctaacaagtcacctccactatgtgggtcttcctttcccctcaagagaaggagcaattgttcccctgacatctgggtccatctgacccatggggcctgcctgtgagaaacagtgggtcccttcaaatacatagtggatagctcatccctaggaattttcattaaaatttggaaacagagtaatgaagaaataatatataaactccttatgtgaggaaatgctactaatatctgaaaagtgaaagatttctatgtattaactcttaagtgcacctagcttattacatcgtgaaaggtacatttaaaatatgttaaattggcttgaaattttcagagaattttgtcttcccctaattcttcttccttggtctggaagaacaatttctatgaattttctctttattttttttttataattcagacaattctatgacccgtgtcttcatttttggcactcttatttaacaatgccacacctgaagcacttggatctgttcagagctgaccccctagcaacgtagttgacacagctccaggtttttaaattactaaaataagttcaagtttacatcccttgggccagatatgtgggttgaggcttgactgtagcatcctgcttagagaccaatcaatggacactggtttttagacctctatcaatcagtagttagcatccaagagactttgcagaggcgtaggaatgaggctggacagatggcggaacgagaggttccctgcgaagacttgagatttagtgtctgtgaatgttctagttcctaggtccagcaagtcacacctgccagtgccctcatccttatgcctgtaacacacatgcagtgagaggcctcacatatacgcctccctagaagtgccttccaagtcagtcctttggaaaccagcaggtctgaaaaagaggctgcatcaatgcaagcctggttggaccattgtccatgcctcaggatagaacagcctggcttatttggggatttttcttctagaaatcaaatgactgataagcattggctccctctgccatttaatggcaatggtagtctttggttagctgcaaaaatactccatttcaagttaaaaatgcatcttctaatccatctctgcaagctccctgtgtttccttgccctttagaaaatgaattgttcactacaattagagaatcatttaacatcctgacctggtaagctgccacacacctggcagtggggagcatcgctgtttccaatggctcaggagacaatgaaaagcccccatttaaaaaaataacaaacattttttaaaaggcctccaatactcttatggagcctggatttttcccactgctctacaggctgtgactttttttaagcatcctgacaggaaatgttttcttctacatggaaagatagacagcagccaaccctgatctggaagacagggccccggctggacacacgtggaaccaagccagggatgggctggccattgtgtccccgcaggagagatgggcagaatggccctagagttcttttccctgagaaaggagaaaaagatgggattgccactcacccacccacactggtaagggaggagaatttgtgcttctggagcttctcaagggattgtgttttgcaggtacagaaaactgcctgttatcttcaagccaggttttcgagggcacatgggtcaccagttgctttttcagtcaatttggccgggatggactaatgaggctctaacactgctcaggagacccctgccctctagttggttctgggctttgatctcttccaacctgcccagtcacagaaggaggaatgactcaaatgcccaaaaccaagaacacattgcagaagtaagacaaacatgtatatttttaaatgttctaacataagacctgttctctctagccattgatttaccaggctttctgaaagatctagtggttcacacagagagagagagagtactgaaaaagcaactcctcttcttagtcttaataatttactaaaatggtcaacttttcattatctttattataataaacctgatgcttttttttagaactccttactctgatgtctgtatatgttgcactgaaaaggttaatatttaatgttttaatttattttgtgtggtaagttaattttgatttctgtaatgtgttaatgtgattagcagttattttccttaatatctgaattatacttaaagagtagtgagcaatataagacgcaattgtgtttttcagtaatgtgcattgttattgagttgtactgtaccttatttggaaggatgaaggaatgaacctttttttcctaaaaaaaaaaaaaaaaaaaaaaaaaaaaaaaaa

SEQ ID NO: 893 - DNA, 2574 bp, Homo sapiens
  ref <308>: DATABASE ACCESSION NUMBER: NM_003239
  ref <309>: DATABASE ENTRY DATE: 2001-06-18
cctgtttagacacatggacaacaatcccagcgctacaaggcacacagtccgcttcttcgtcctcagggttgccagcgcttcctggaagtcctgaagctctcgcagtgcagtgagttcatgcaccttcttgccaagcctcagtctttgggatctggggaggccgcctggttttcctccctccttctgcacgtctgctggggtctcttcctctccaggccttgccgtccccctggcctctcttcccagctcacacatgaagatgcacttgcaaagggctctggtggtcctggccctgctgaactttgccacggtcagcctctctctgtccacttgcaccaccttggacttcggccacatcaagaagaagagggtggaagccattaggggacagatcttgagcaagctcaggctcaccagcccccctgagccaacggtgatgacccacgtcccctatcaggtcctggccctttacaacagcacccgggagctgctggaggagatgcatggggagagggaggaaggctgcacccaggaaaacaccgagtcggaatactatgccaaagaaatccataaattcgacatgatccaggggctggcggagcacaacgaactggctgtctgccctaaaggaattacctccaaggttttccgcttcaatgtgtcctcagtggagaaaaatagaaccaacctattccgagcagaattccgggtcttgcgggtgcccaaccccagctctaagcggaatgagcagaggatcgagctcttccagatccttcggccagatgagcacattgccaaacagcgctatatcggtggcaagaatctgcccacacggggcactgccgagtggctgtcctttgatgtcactgacactgtgcgtgagtggctgttgagaagagagtccaacttaggtctagaaatcagcattcactgtccatgtcacacctttcagcccaatggagatatcctggaaaacattcacgaggtgatggaaatcaaattcaaaggcgtggacaatgaggatgaccatggccgtggagatctggggcgcctcaagaagcagaaggatcaccacaaccctcatctaatcctcatgatgattcccccacaccggctcgacaacccgggccaggggggtcagaggaagaagcgggctttggacaccaattactgcttccgcaacttggaggagaactgctgtgtgcgccccctctacattgacttccgacaggatctgggctggaagtgggtccatgaacctaagggctactatgccaacttctgctcaggcccttgcccatacctccgcagtgcagacacaacccacagcacggtgctgggactgtacaacactctgaaccctgaagcatctgcctcgccttgctgcgtgccccaggacctggagcccctgaccatcctgtactatgttgggaggacccccaaagtggagcagctctccaacatggtggtgaagtcttgtaaatgtagctgagaccccacgtgcgacagagagaggggagagagaaccaccactgcctgactgcccgctcctcgggaaacacacaagcaacaaacctcactgagaggcctggagcccacaaccttcggctccgggcaaatggctgagatggaggtttccttttggaacatttctttcttgctggctctgagaatcacggtggtaaagaaagtgtgggtttggttagaggaaggctgaactcttcagaacacacagactttctgtgacgcagacagaggggatggggatagaggaaagggatggtaagttgagatgttgtgtggcaatgggatttgggctaccctaaagggagaaggaagggcagagaatggctgggtcagggccagactggaagacacttcagatctgaggttggatttgctcattgctgtaccacatctgctctagggaatctggattatgttatacaaggcaagcatttttttttttaaagacaggttacgaagacaaagtcccagaattgtatctcatactgtctgggattaagggcaaatctattacttttgcaaactgtcctctacatcaattaacatcgtgggtcactacagggagaaaatccaggtcatgcagttcctggcccatcaactgtattgggccttttggatatgctgaacgcagaagaaagggtggaaatcaaccctctcctgtctgccctctgggtccctcctctcacctctccctcgatcatatttccccttggacacttggttagacgccttccaggtcaggatgcacatttctggattgtggttccatgcagccttggggcattatgggtcttcccccacttcccctccaagaccctgtgttcatttggtgttcctggaagcaggtgctacaacatgtgaggcattcggggaagctgcacatgtgccacacagtgacttggccccagacgcatagactgaggtataaagacaagtatgaatattactctcaaaatctttgtataaataaatatttttggggcatcctggatgatttcatcttctggaatattgtttctagaacagtaaaagccttattctaaggtg

SEQ ID NO: 894 - DNA, 3074 bp, Homo sapiens
  ref <308>: DATABASE ACCESSION NUMBER: NM_003248
  ref <309>: DATABASE ENTRY DATE: 2001-06-18
gaattccggggagcaggaagagccaacatgctggccccgcgcggagccgccgtcctcctgctgcacctggtcctgcagcggtggctagcggcaggcgcccaggccaccccccaggtctttgaccttctcccatcttccagtcagaggctaaacccaggcgctctgctgccagtcctgacagaccccgccctgaatgatctctatgtgatttccaccttcaagctgcagactaaaagttcagccaccatcttcggtctttactcttcaactgacaacagtaaatattttgaatttactgtgatgggacgcttaagcaaagccatcctccgttacctgaagaacgatgggaaggtgcatttggtggttttcaacaacctgcagctggcagacggaaggcggcacaggatcctcctgaggctgagcaatttgcagcgaggggccggctccctagagctctacctggactgcatccaggtggattccgttcacaatctccccagggcctttgctggcccctcccagaaacctgagaccattgaattgaggactttccagaggaagccacaggacttcttggaagagctgaagctggtggtgagaggctcactgttccaggtggccagcctgcaagactgcttcctgcagcagagtgagccactggctgccacaggcacaggggactttaaccggcagttcttgggtcaaatgacacaattaaaccaactcctgggagaggtgaaggaccttctgagacagcaggttaaggaaacatcatttttgcgaaacaccatagctgaatgccaggcttgcggtcctctcaagtttcagtctccgaccccaagcacggtggtcgccccggctccccctgcaccgccaacacgcccacctcgtcggtgtgactccaacccatgtttccgaggtgtccaatgtaccgacagtagagatggcttccagtgtgggccctgccccgagggctacacaggaaacgggatcacctgtattgatgttgatgagtgcaaataccatccctgctacccgggcgtgcactgcataaatttgtctcctggcttcagatgtgacgcctgcccagtgggcttcacagggcccatggtgcagggtgttgggatcagttttgccaagtcaaacaagcaggtctgcactgacattgatgagtgtcgaaatggagcgtgcgttcccaactcgatctgcgttaatactttgggatcttaccgctgtgggccttgtaagccggggtatactggtgatcagataaggggatgcaaagtggaaagaaactgcagaaacccagagctgaacccttgcagtgtgaatgcccagtgcattgaagagaggcagggggatgtgacatgtgtgtgtggagtcggttgggctggagatggctatatctgtggaaaggatgtggacatcgacagttaccccgacgaagaactgccatgctctgccaggaactgtaaaaaggacaactgcaaatatgtgccaaattctggccaagaagatgcagacagagatggcattggcgacgcttgtgacgaggatgctgacggagatgggatcctgaatgagcaggataactgtgtcctgattcataatgtggaccaaaggaacagcgataaagatatctttggggatgcctgtgataactgcctgagtgtcttaaataacgaccagaaagacaccgatggggatggaagaggagatgcctgtgatgatgacatggatggagatggaataaaaaacattctggacaactgcccaaaatttcccaatcgtgaccaacgggacaaggatggtgatggtgtgggggatgcctgtgacagttgtcctgatgtcagcaaccctaaccagtctgatgtggataatgatctggttggggactcctgtgacaccaatcaggacagtgatggagatgggcaccaggacagcacagacaactgccccaccgtcattaacagtgcccagctggacaccgataaggatggaattggtgacgagtgtgatgatgatgatgacaatgatggtatcccagacctggtgccccctggaccagacaactgccggctggtccccaacccagcccaggaggatagcaacagcgacggagtgggagacatctgtgagtctgactttgaccaggaccaggtcatcgatcggatcgacgtctgcccagagaacgcagaggtcaccctgaccgacttcagggcttaccagaccgtgggcctggatcctgaaggggatgcccagatcgatcccaactgggtggtcctgaaccagggcatggagattgtacagaccatgaacagtgatcctggcctggcagtggggtacacagcttttaatggagttgacttcgaagggaccttccatgtgaatacccagacagatgatgactatgcaggctttatctttggctaccaagatagctccagcttctacgtggtcatgtggaagcagacggagcagacatattggcaagccaccccattccgagcagttgcagaacctggcattcagctcaaggctgtgaagtctaagacaggtccaggggagcatctccggaactccctgtggcacacgggggacaccagtgaccaggtcaggctgctgtggaaggactccaggaatgtgggctggaaggacaaggtgtcctaccgctggttcctacagcacaggccccaggtgggctacatcagggtacgattttatgaaggctctgagttggtggctgactctggcgtcaccatagacaccacaatgcgtggaggccgacttggcgttttctgcttctctcaagaaaacatcatctggtccaacctcaagtatcgctgcaatgacaccatccctgaggacttccaagagtttcaaacccagaatttcgaccgcttcgataattaaaccaaggaagcaatctgtaactgcttttcggaacactaaaaccatatatattttaacttcaattttctttagcttttaccaacccaaatatatcaaaacgttttatgtgaatgtggcaataaaggagaagagatcatttttaaaaaaaaaaaaaaaaaaaa

SEQ ID NO: 895 - DNA, 1075 bp, Homo sapiens
  ref <308>: DATABASE ACCESSION NUMBER: NM_003255
  ref <309>: DATABASE ENTRY DATE: 2001-06-18
cgcagcaaacacatccgtagaaggcagcgcggccgccgagagccgcagcgccgctcgcccgccgccccccaccccgccgccccgcccggcgaattgcgccccgcgcccctcccctcgcgcccccgagacaaagaggagagaaagtttgcgcggccgagcggggcaggtgaggagggtgagccgcgcgggaggggcccgcctcggccccggctcagcccccgcccgcgcccccagcccgccgccgcgagcagcgcccggaccccccagcggcggcccccgcccgcccagccccccggcccgccatgggcgccgcggcccgcaccctgcggctggcgctcggcctcctgctgctggcgacgctgcttcgcccggccgacgcctgcagctgctccccggtgcacccgcaacaggcgttttgcaatgcagatgtagtgatcagggccaaagcggtcagtgagaaggaagtggactctggaaacgacatttatggcaaccctatcaagaggatccagtatgagatcaagcagataaagatgttcaaagggcctgagaaggatatagagtttatctacacggccccctcctcggcagtgtgtggggtctcgctggacgttggaggaaagaaggaatatctcattgcaggaaaggccgagggggacggcaagatgcacatcaccctctgtgacttcatcgtgccctgggacaccctgagcaccacccagaagaagagcctgaaccacaggtaccagatgggctgcgagtgcaagatcacgcgctgccccatgatcccgtgctacatctcctccccggacgagtgcctctggatggactgggtcacagagaagaacatcaacgggcaccaggccaagttcttcgcctgcatcaagagaagtgacggctcctgtgcgtggtaccgcggcgcggcgccccccaagcaggagtttctcgacatcgaggacccataagcaggcctccaacgcccctgtggccaactgcaaaaaaagcctccaagggtttcgactggtccagctctgacatcccttcctggaaacagcatgaataaaacactcatccc

SEQ ID NO: 896 - DNA, 1421 bp, Homo sapiens
  ref <308>: DATABASE ACCESSION NUMBER: NM_003258
  ref <309>: DATABASE ENTRY DATE: 2001-06-18
acttactgcgggacggccttggagagtactcgggttcgtgaacttcccggaggcgcaatgagctgcattaacctgcccactgtgctgcccggctcccccagcaagacccgggggcagatccaggtgattctcgggccgatgttctcaggaaaaagcacagagttgatgagacgcgtccgtcgcttccagattgctcagtacaagtgcctggtgatcaagtatgccaaagacactcgctacagcagcagcttctgcacacatgaccggaacaccatggaggcgctgcccgcctgcctgctccgagacgtggcccaggaggccctgggcgtggctgtcataggcatcgacgaggggcagtttttccctgacatcatggagttctgcgaggccatggccaacgccgggaagaccgtaattgtggctgcactggatgggaccttccagaggaagccatttggggccatcctgaacctggtgccgctggccgagagcgtggtgaagctgacggcggtgtgcatggagtgcttccgggaagccgcctataccaagaggctcggcacagagaaggaggtcgaggtgattgggggagcagacaagtaccactccgtgtgtcggctctgctacttcaagaaggcctcaggccagcctgccgggccggacaacaaagagaactgcccagtgccaggaaagccaggggaagccgtggctgccaggaagctctttgccccacagcagattctgcaatgcagccctgccaactgagggacctgcaagggccgcccgctcccttcctgccactgccgcctactggacgctgccctgcatgctgcccagccactccaggaggaagtcgggaggcgtggagggtgaccacaccttggccttctgggaactctcctttgtgtggctgccccacctgccgcatgctccctcctctcctacccactggtctgcttaaagcttccctctcagctgctgggacgatcgcccaggctggagctggccccgcttggtggcctgggatctggcacactccctctccttggggtgagggacagagccccacgctgttgacatcagcctgcttcttcccctctgcggctttcactgctgagtttctgttctccctgggaagcctgtgccagcacctttgagccttggcccacactgaggcttaggcctctctgcctgggatgggctcccaccctcccctgaggatggcctggattcacgccctcttgtttccttttgggctcaaagcccttcctacctctggtgatggtttccacaggaacaacagcatctttcaccaagatgggtggcaccaaccttgctgggacttggatcccaggggcttatctcttcaagtgtggagagggcagggtccacgcctctgctgtagcttatgaaattaactaatt

SEQ ID NO: 897 - DNA, 2600 bp, Homo sapiens
  ref <308>: DATABASE ACCESSION NUMBER: NM_003264
  ref <309>: DATABASE ENTRY DATE: 2001-06-18
ggatccaaaggagacctatagtgactcccaggagctcttagtgaccaagtgaaggtacctgtggggctcattgtgcccattgctctttcactgctttcaactggtagttgtgggttgaagcactggacaatgccacatactttgtggatggtgtgggtcttgggggtcatcatcagcctctccaaggaagaatcctccaatcaggcttctctgtcttgtgaccgcaatggtatctgcaagggcagctcaggatctttaaactccattccctcagggctcacagaagctgtaaaaagccttgacctgtccaacaacaggatcacctacattagcaacagtgacctacagaggtgtgtgaacctccaggctctggtgctgacatccaatggaattaacacaatagaggaagattctttttcttccctgggcagtcttgaacatttagacttatcctataattacttatctaatttatcgtcttcctggttcaagcccctttcttctttaacattcttaaacttactgggaaatccttacaaaaccctaggggaaacatctcttttttctcatctcacaaaattgcaaatcctgagagtgggaaatatggacaccttcactaagattcaaagaaaagattttgctggacttaccttccttgaggaacttgagattgatgcttcagatctacagagctatgagccaaaaagtttgaagtcaattcagaacgtaagtcatctgatccttcatatgaagcagcatattttactgctggagatttttgtagatgttacaagttccgtggaatgtttggaactgcgagatactgatttggacactttccatttttcagaactatccactggtgaaacaaattcattgattaaaaagtttacatttagaaatgtgaaaatcaccgatgaaagtttgtttcaggttatgaaacttttgaatcagatttctggattgttagaattagagtttgatgactgtacccttaatggagttggtaattttagagcatctgataatgacagagttatagatccaggtaaagtggaaacgttaacaatccggaggctgcatattccaaggttttacttattttatgatctgagcactttatattcacttacagaaagagttaaaagaatcacagtagaaaacagtaaagtttttctggttccttgtttactttcacaacatttaaaatcattagaatacttggatctcagtgaaaatttgatggttgaagaatacttgaaaaattcagcctgtgaggatgcctggccctctctacaaactttaattttaaggcaaaatcatttggcatcattggaaaaaaccggagagactttgctcactctgaaaaacttgactaacattgatatcagtaagaatagttttcattctatgcctgaaacttgtcagtggccagaaaagatgaaatatttgaacttatccagcacacgaatacacagtgtaacaggctgcattcccaagacactggaaattttagatgttagcaacaacaatctcaatttattttctttgaatttgccgcaactcaaagaactttatatttccagaaataagttgatgactctaccagatgcctccctcttacccatgttactagtattgaaaatcagtaggaatgcaataactacgttttctaaggagcaacttgactcatttcacacactgaagactttggaagctggtggcaataacttcatttgctcctgtgaattcctctccttcactcaggagcagcaagcactggccaaagtcttgattgattggccagcaaattacctgtgtgactctccatcccatgtgcgtggccagcaggttcaggatgtccgcctctcggtgtcggaatgtcacaggacagcactggtgtctggcatgtgctgtgctctgttcctgctgatcctgctcacgggggtcctgtgccaccgtttccatggcctgtggtatatgaaaatgatgtgggcctggctccaggccaaaaggaagcccaggaaagctcccagcaggaacatctgctatgatgcatttgtttcttacagtgagcgggatgcctactgggtggagaaccttatggtccaggagctggagaacttcaatccccccttcaagttgtgtcttcataagcgggacttcattcctggcaagtggatcattgacaatatcattgactccattgaaaagagccacaaaactgtctttgtgctttctgaaaactttgtgaagagtgagtggtgcaagtatgaactggacttctcccatttccgtctttttgaagagaacaatgatgctgccattctcattcttctggagcccattgagaaaaaagccattccccagcgcttctgcaagctgcggaagataatgaacaccaagacctacctggagtggcccatggacgaggctcagcgggaaggattttgggtaaatctgagagctgcgataaagtcctaggttcccatatttaagaccagtctttgtctagttgggatctttatgtcactagttatagttaagttcattcagacataattatataaaaactacgtggatgtaccgtcatttgagga

SEQ ID NO: 898 - DNA, 899 bp, Homo sapiens
  ref <308>: DATABASE ACCESSION NUMBER: NM_003283
  ref <309>: DATABASE ENTRY DATE: 2001-06-18
aagattcacagcatctcagacgcagcctaggccgcaccaggatgtcggacaccgaggagcaggaatatgaggaggagcagccggaagaggaggctgcggaggaggaggaggaagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagacaaaaaaaaaaaaaaaaaaa

SEQ ID NO: 899 - DNA, 3866 bp, Homo sapiens
  ref <308>: DATABASE ACCESSION NUMBER: NM_003318
  ref <309>: DATABASE ENTRY DATE: 2001-06-18
ggaattcctttttttttttttttgagatggagtttcactcttgttggccaggctggagtgcaatggcacaatctcagcttactgcaacctccgcctcccgggttcaagcgattctcctgcctcagcctctcaagtagctgggattacaggcatgtgccaccacccctggctaactaatttcttttctatttagtagagatggggtttcaccatgttggtcaggctggtcttgaactcctgacctcaggtgatccacttgccttggcctcccaaagtgctaggattacagccgtgaaactgtgcctggctgattctttttttgttgttggatttttgaaacagggtctcccttggtcgcccaggctggagtgcagtggtgcgatcttggctcactataacctccacctcctggtttcaagtgatcctcccactttagcctcctgagtagctgtgattacaggcgtgcaccaccacacccggctaatttttgtatttttattagagacagggtttcaccatgttggccaggctgttctcaaactcctggactcaagggatccgcctgcctccacttcccaaagtcccgagattacaggtgtgagtcaccatgcctgaccttataattcttaagtcattttttctggtccatttcttccttagggtcctcacaacaaatctgcattaggcggtacaataatccttaacttcatgattcacaaaaggaagatgaagtgattcatgatttagaaaggggaagtagtaagcccactgcacactcctggatgatgatcctaaatccagatacagtaaaaatggggtatgggaaggtagaatacaaaatttggtttaaattaattatctaaatatctaaaaacatttttggatacattgttgatgtgaatgtaagactgtacagacttcctagaaaacagtttgggttccatcttttcatttccccagtgcagttttctgtagaaatggaatccgaggatttaagtggcagagaattgacaattgattccataatgaacaaagtgagagacattaaaaataagtttaaaaatgaagaccttactgatgaactaagcttgaataaaatttctgctgatactacagataactcgggaactgttaaccaaattatgatgatggcaaacaacccagaggactggttgagtttgttgctcaaactagagaaaaacagtgttccgctaagtgatgctcttttaaataaattgattggtcgttacagtcaagcaattgaagcgcttcccccagataaatatggccaaaatgagagttttgctagaattcaagtgagatttgctgaattaaaagctattcaagagccagatgatgcacgtgactactttcaaatggccagagcaaactgcaagaaatttgcttttgttcatatatcttttgcacaatttgaactgtcacaaggtaatgtcaaaaaaagtaaacaacttcttcaaaaagctgtagaacgtggagcagtaccactagaaatgctggaaattgccctgcggaatttaaacctccaaaaaaagcagctgctttcagaggaggaaaagaagaatttatcagcatctacggtattaactgcccaagaatcattttccggttcacttgggcatttacagaataggaacaacagttgtgattccagaggacagactactaaagccaggtttttatatggagagaacatgccaccacaagatgcagaaataggttaccggaattcattgagacaaactaacaaaactaaacagtcatgcccatttggaagagtcccagttaaccttctaaatagcccagattgtgatgtgaagacagatgattcagttgtaccttgttttatgaaaagacaaacctctagatcagaatgccgagatttggttgtgcctggatctaaaccaagtggaaatgattcctgtgaattaagaaatttaaagtctgttcaaaatagtcatttcaaggaacctctggtgtcagatgaaaagagttctgaacttattattactgattcaataaccctgaagaataaaacggaatcaagtcttctagctaaattagaagaaactaaagagtatcaagaaccagaggttccagagagtaaccagaaacagtggcaagctaagagaaagtcagagtgtattaaccagaatcctgctgcatcttcaaatcactggcagattccggagttagcccgaaaagttaatacagagcagaaacataccacttttgagcaacctgtcttttcagtttcaaaacagtcaccaccaatatcaacatctaaatggtttgacccaaaatctatttgtaagacaccaagcagcaataccttggatgattacatgagctgttttagaactccagttgtaaagaatgactttccacctgcttgtcagttgtcaacaccttatggccaacctgcctgtttccagcagcaacagcatcaaatacttgccactccacttcaaaatttacaggttttagcatcttcttcagcaaatgaatgcatttcggttaaaggaagaatttattccatattaaagcagataggaagtggaggttcaagcaaggtatttcaggtgttaaatgaaaagaaacagatatatgctataaaatatgtgaacttagaagaagcagataaccaaactcttgatagttaccggaacgaaatagcttatttgaataaactacaacaacacagtgataagatcatccgactttatgattatgaaatcacggaccagtacatctacatggtaatggagtgtggaaatattgatcttaatagttggcttaaaaagaaaaaatccattgatccatgggaacgcaagagttactggaaaaatatgttagaggcagttcacacaatccatcaacatggcattgttcacagtgatcttaaaccagctaactttctgatagttgatggaatgctaaagctaattgattttgggattgcaaaccaaatgcaaccagatacaacaagtgttgttaaagattctcaggttggcacagttaattatatgccaccagaagcaatcaaagatatgtcttcctccagagagaatgggaaatctaagtcaaagataagccccaaaagtgatgtttggtccttaggatgtattttgtactatatgacttacgggaaaacaccatttcagcagataattaatcagatttctaaattacatgccataattgatcctaatcatgaaattgaatttcccgatattccagagaaagatcttcaagatgtgttaaagtgttgtttaaaaagggacccaaaacagaggatatccattcctgagctcctggctcatccatatgttcaaattcaaactcatccagttaaccaaatggccaagggaaccactgaagaaatgaaatatgttctgggccaacttgttggtctgaattctcctaactccattttgaaagctgctaaaactttatatgaacactatagtggtggtgaaagtcataattcttcatcctccaagacttttgaaaaaaaaaggggaaaaaaatgatttgcagttattcgtaatgtcagataggaggtataaaatatattggactgttatactcttgaatccctgtggaaatctacatttgaagacaacatcactctgaagtgttatcagcaaaaaaaattcagtgagattatctttaaaagaaaactgtaaaaatagcaaccacttatggcactgtatatattgtagacttgttttctctgttttatgctcttgtgtaatctacttgacatcattttactcttggaatagtgggtggatagcaagtatattctaaaaaactttgtaaataaagttttgtggctaaaatga

SEQ ID NO: 900 - DNA, 501 bp, Homo sapiens
  ref <308>: DATABASE ACCESSION NUMBER: NM_003329
  ref <309>: DATABASE ENTRY DATE: 2001-06-18
gaattcgctttggatccatttccatcggtccttacagccgctcgtcagactccagcagccaagatggtgaagcagatcgagagcaagactgcttttcaggaagccttggacgctgcaggtgataaacttgtagtagttgacttctcagccacgtggtgtgggccttgcaaaatgatcaaccctttctttcattccctctctgaaaagtattccaacgtgatattccttgaagtagatgtggatgactgtcaggatgttgcttcagagtgtgaagtcaaatgcacgccaacattccagttttttaagaagggacaaaaggtgggtgaattttctggagccaataaggaaaagcttgaagccaccattaatgaattagtctaatcatgttttctgaaaacataaccagccattggctatttaaacttgtatttttttatttacaaaatataaatatgaagacataaccagttgccatctgcgtgacaataaacattatgctaa

SEQ ID NO: 901 - DNA, 604 bp, Homo sapiens
  ref <308>: DATABASE ACCESSION NUMBER: NM_003332
  ref <309>: DATABASE ENTRY DATE: 2001-06-18
ccacgcgtccgcgctgcgccacatcccaccggcccttacactgtggtgtccagcagcatccggcttcatggggggacttgaaccctgcagcaggctcctgctcctgcctctcctgctggctgtaagtggtctccgtcctgtccaggcccaggcccagagcgattgcagttgctctacggtgagcccgggcgtgctggcagggatcgtgatgggagacctggtgctgacagtgctcattgccctggccgtgtacttcctgggccggctggtccctcgggggcgaggggctgcggaggcagcgacccggaaacagcgtatcactgagaccgagtcgccttatcaggagctccagggtcagaggtcggatgtctacagcgacctcaacacacagaggccgtattacaaatgagcccgaatcatgacagtcagcaacatgatacctggatccagccattcctgaagcccaccctgcacctcattccaactcctaccgcgatacagacccacagagtgccatccctgagagaccagaccgctccccaatactctcctaaaataaacatgaagcacaaaaaaaaaaaaaaaaaaaaaaaaaaaaaaaaaa

SEQ ID NO: 902 - DNA, 1637 bp, Homo sapiens
  ref <308>: DATABASE ACCESSION NUMBER: NM_003358
  ref <309>: DATABASE ENTRY DATE: 2001-06-18
gaggcgaaccggagcgcggggccgcggtcgccccgaccagagccgggagaccgcagcacccgcagccgcccgcgagcgcgccgaagacagcgcgcaggcgagagcgcgcgggcgggggcgcgcaggccctgcccgccccttccgtccccacccccctccgccctttcctctccccaccttcctctcgcctcccgcgcccccgcaccgggcgcccaccctgtcctcctcctgcgggagcgttgtccgtgttggcggccgcagcgggccgggccggtccggcgggccgggggatggcgctgctggacctggccttggagggaatggccgtcttcgggttcgtcctcttcttggtgctgtggctgatgcatttcatggctatcatctacacccgattacacctcaacaagaaggcaactgacaaacagccttatagcaagctcccaggtgtctctcttctgaaaccactgaaaggggtagatcctaacttaatcaacaacctggaaacattctttgaattggattatcccaaatatgaagtgctcctttgtgtacaagatcatgatgatccagccattgatgtatgtaagaagcttcttggaaaatatccaaatgttgatgctagattgtttataggtggtaaaaaagttggcattaatcctaaaattaataatttaatgccaggatatgaagttgcaaagtatgatcttatatggatttgtgatagtggaataagagtaattccagatacgcttactgacatggtgaatcaaatgacagaaaaagtaggcttggttcacgggctgccttacgtagcagacagacagggctttgctgccaccttagagcaggtatattttggaacttcacatccaagatactatatctctgccaatgtaactggtttcaaatgtgtgacaggaatgtcttgtttaatgagaaaagatgtgttggatcaagcaggaggacttatagcttttgctcagtacattgccgaagattactttatggccaaagcgatagctgaccgaggttggaggtttgcaatgtccactcaagttgcaatgcaaaactctggctcatattcaatttctcagtttcaatccagaatgatcaggtggaccaaactacgaattaacatgcttcctgctacaataatttgtgagccaatttcagaatgctttgttgccagtttaattattggatgggcagcccaccatgtgttcagatgggatattatggtatttttcatgtgtcattgcctggcatggtttatatttgactacattcaactcaggggtgtccagggtggcacactgtgtttttcaaaacttgattatgcagtcgcctggttcatccgcgaatccatgacaatatacatttttttgtctgcattatgggacccaactataagctggagaactggtcgctacagattacgctgtgggggtacagcagaggaaatcctagatgtataactacagctttgtgactgtatataaaggaaaaaagagaagtattataaattatgtttatataaatgcttttaaaaatctaccttctgtagttttatcacatgtatgttttggtatctgttctttaatttatttttgcatggcacttgcatctgtgaaaaaaaa

SEQ ID NO: 903 - DNA, 2950 bp, Homo sapiens
  ref <308>: DATABASE ACCESSION NUMBER: NM_003359
  ref <309>: DATABASE ENTRY DATE: 2001-06-18
gcggcccgtaggaaggtgctgtccgatcgatcgggataggagcggtccctgcgcttgctgctgggaagtggtacaatcatgtttgaaattaagaagatctgttgcatcggtgcaggctatgttggaggacccacatgtagtgtcattgctcatatgtgtcctgaaatcagggtaacggttgttgatgtcaatgaatcaagaatcaatgcgtggaattctcctacacttcctatttatgagccaggactaaaagaagtggtagaatcctgtcgaggaaaaaatctttttttttctaccaatattgatgatgccatcaaagaagctgatcttgtatttatttctgtgaatactccaacaaaaacctatggaatggggaaaggccgggcagcagatctgaagtatattgaagcttgtgctagacgcattgtgcaaaactcaaatgggtacaaaattgtgactgagaaaagcacagttccagtgcgggcagcagaaagtatccgtcgcatatttgatgcaaacacaaaacccaacttgaatttacaggtgctgtccaaccctgagtttctggcagagggaacagccatcaaggacctaaagaacccagacagagtactgattggaggggatgaaactccagagggccagagagctgtgcaggccctgtgtgctgtatatgagcactgggttcccagagaaaagatcctcaccactaatacttggtcttcagagctttccaaactggcagcaaatgcttttcttgcccagagaataagcagcattaactccataagtgctctgtgtgaagcaacaggagctgatgtagaagaggtagcaacagcgattggaatggaccagagaattggaaacaagtttctaaaagccagtgttgggtttggtgggagctgtttccaaaaggatgttctgaatttggtttatctctgtgaggctctgaatttgccagaagtagctcgttattggcagcaggtcatagacatgaatgactaccagaggaggaggtttgcttcccggatcatagatagtctgtttaatacagtaactgataagaagatagctattttgggatttgcattcaaaaaggacactggtgatacaagagaatcttctagtatatatattagcaaatatttgatggatgaaggtgcacatctacatatatatgatccaaaagtacctagggaacaaatagttgtggatctttctcatccaggtgtttcagaggatgaccaagtgtcccggctcgtgaccatttccaaggatccatatgaagcatgtgatggtgcccatgctgttgttatttgcactgagtgggacatgtttaaggaattggattatgaacgcattcataaaaaaatgctaaagccagcctttatcttcgatggacggcgtgtcctggatgggctccacaatgaactacaaaccattggcttccagattgaaacaattggcaaaaaggtgtcttcaaagagaattccatatgctccttctggtgaaattccgaagtttagtcttcaagatccacctaacaagaaacctaaagtgtagagattgccatttttatttgtgatttttttttttttttggtacttcaggatagcaaatatctatctgctattaaatggtaaatgaaccaagtgtttttttttgttttttttttgagacagagtctcactgttgcccaggctggagtgcagtggtgcaatctcggctcactgcaagctctgcttcccaggttcacgccattctcctggctcagcctcccaagtagctgggactacaggcacccgccacagtgcctgggctaattttttgtatttttagtagagacagggtttcaccatgtgagccaggatggtctcaatctcctgaccttgtgaaccacccgtctcggcctcccaaagtgctgggattacaggtgtgagccaccacgcctgggcccatgaaccaagtgtttttaaggaaacaaaactatttttttaatcatcagatttatactagctatatggatattagcatatctggtaattatgaatctagaatttttttacatatttttataatactgttagctcagttattggatgagtgaaagataatcatgttggttttaatagtgtcaatttttgtaaaataaaaattaaacttcaaactctttactttataaattgtccataggccacactttaatatcacattataaagggaaggacagtcttcattcctcctggttattggtttgtttgtcattaaagatatattttgaatccatgaaattgctatgctaaacagcctttacatgtatggtctggttaaagttcctttgttccttttgttttaataaaatgtgtcactgattttttagctcaaaatcatcactgttaatttccagtcaccccaaatatggttaaaagatttttttttttaatcatgaagagaaaattagtagcatttctttctctccccattatttattggttttcctcactaatctttttttttttagtccaaaagccaaaaatatttatcttggttttacattttaatttccattcttaattgtaatttttttctttaaataaggaaaccaatataatctcatgtataaaaacttaaatattttacaagttacatatagcatcattctaaaataagaattttttttgttttctgtctgcttttttcttatgtctcttgttgagttttatattttcagtggttatttttgcttgtgttagatcattattaaaatatatccaatgtccctttgatacttgtgctctgctgagaatgtacagtttgcattaaacatcccaggtctcatccttcaggaattttgcagttcaatgagaagagggagacaaatataaagatgaggacagaagcatctctacagatgaaaattacataaataaaacattctccatcaacaaaa

SEQ ID NO: 904 - DNA, 1894 bp, Homo sapiens
  ref <308>: DATABASE ACCESSION NUMBER: NM_003360
  ref <309>: DATABASE ENTRY DATE: 2001-06-18
ggctgaggacccgagggaggacacggttaaagcatcgctatcaactgcgtaacccagagagccctccttagccaacacgctaactccgaagcctccccttacgcccccgaaccaccgaaggcggcgacacctgattcagcgcacaaacacaggtcccttctgtcccggatacaattacgcggcagacacacactcagactcgcgcggggcagccaagagacgagctatgaagtcttacactccatatttcattctcctgtggagtgctgttgggatagcgaaggctgctaaaatcatcatcgtgccgccaattatgtttgaaagccatatgtacattttcaagacgctagcctcagccttgcacgagagaggccaccatacagtgttcctcctctctgaaggcagagacatcgccccatctaatcattacagcctccagcgctacccaggaatctttaacagtaccacctcagatgctttcctacagtccaagatgcggaatattttctctgggagattgccagcaatcgaactgtttgacatactggatcactatactaagaactgtgacatgatggttggcaaccatgccctgatccagggtctgaagaaagaaaaatttgacctgctgctggtggaccctaatgatatgtgtggatttgtgatagctcatcttttaggggttaaatatgctgtattttcaactggcctttggtatcctgctgaagtgggtgctcctgctccattagcatacgtcccagagtttaactcactcctcacagaccgcatgaacttgctgcaaaggatgaaaaataccggtgtttacctcatttccagattaggggtcagctttctggttcttcccaaatatgaaaggataatgcagaagtacaacctgctgccggagaagtccatgtatgatttggttcatgggtccagcctgtggatgctgtgtactgacgtagcactggaattcccaagacccactctgcctaatgttgtttatgtaggaggaatcctaaccaaaccagccagcccactaccagaagatctccaaagatgggtaaatggtgctaatgaacatggctttgtcttggtgtcttttggagctggtgtcaagtatctgtcagaagacattgctaacaaactggcaggagctctggggagattgcctcaaaaagtgatttggaggttttctggacccaaaccaaagaatctaggaaacaacactaaactcatagaatggttaccacaaaatgacctgcttgggcattcaaagattaaagccttcgtgagccatggtggtttgaacagtatttttgaaactatgtatcatggtgtgcctgtagtgggaattccagtctttggagaccattatgatactatgaccagagtacaggcaaaaggcatggggatattgctagaatggaagacagttactgaaaaagagctctatgaagcactagtgaaggttatcaataatcccagctaccgtcagagggctcagaagctttcggaaattcacaaggatcaacctggtcaccctgtcaatcgaactatctattggatagattatattattcgtcacaatggagcccatcacctacgtgccgctgtccatcagatctccttttgtcagtattttttactggatattgcctttgtgcttttgcttggtgctgccttgttatactttctcttgtcttgggtgacaaaatttatctacagaaaaatcaaaagtctgtggtctagaaataagcatagcacagttaatggacattaccacaatggaatcctcaatggcaagtacaaaagaaatggccatattaaacatgaaaagaaagtgaaatgagccgacagcccaggtgatagaaataaattggttcactcattg

SEQ ID NO: 905 - DNA, 3221 bp, Homo sapiens
  ref <308>: DATABASE ACCESSION NUMBER: NM_003368
  ref <309>: DATABASE ENTRY DATE: 2001-06-18
ggcacgagccgccgcggacttcgctttgggccatgaccagatataattggtgattacaactttcctctataaattaactcttgacactccttgggatttgaagaaaaaaatgcctggtgtcatacctagtgaaagtaatggactttcaagaggtagcccttcaaagaaaaacagactttccttaaagttttttcagaaaaaggaaactaagagagctttggatttcacagattctcaagaaaatgaagaaaaagcttctgaatatagagcatctgaaattgatcaagttgttcctgcagcacagtcttcacctataaactgtgagaagagagaaaacttgttaccatttgtgggactgaataatctcggcaatacttgctatcttaatagtatacttcaggtattatatttttgtcccggttttaaatctggagtaaagcacttatttaatattatttcaaggaagaaagaagctctaaaggatgaagccaatcaaaaagacaagggaaattgcaaagaagattctttggcaagttatgaattgatatgcagtttacagtccttaatcatttcggttgaacagctccaggctagttttctcttaaatccagagaaatatactgatgaacttgccactcagccaaggcgactgcttaacacactgagggaactcaaccctatgtatgaaggatatctacagcatgatgcacaggaagtattacaatgtattttgggaaacattcaagaaacatgccaactcctaaaaaaagaagaagtaaaaaatgtggcagaattacctactaaggtagaagaaatacctcatccgaaagaggaaatgaatggtattaacagcatagagatggacagtatgaggcattctgaagactttaaagagaaactcccaaaaggaaatgggaaaagaaaaagtgacactgaatttggtaacatgaagaaaaaagttaaattatccaaggaacaccagtcattggaagagaaccagagacaaactagatcaaaaagaaaagctacaagtgatacattagagagtcctcctaaaataattcccaagtatatttctgaaaatgagagtccaagaccctcacaaaagaaatcaagagttaaaataaattggttaaagtctgcaactaagcaacccagcattctttctaaattttgtagtctgggaaaaataacaacaaaccaaggagtcaaaggacaatctaaagaaaatgaatgtgatcctgaagaggacttggggaagtgtgaaagtgataacacaactaatggttgtggacttgaatctccaggaaatactgttacacctgtaaatgttaatgaagttaaacccataaacaaaggtgaagaacaaattggttttgagctagtggagaaattatttcaaggtcagctggtattaaggacgcgttgcttggaatgtgaaagtttaacagaaagaagagaagattttcaagacatcagtgtgccagtacaagaagatgagctttccaaagtagaggagagttctgaaatttctccagagccaaaaacagaaatgaagaccctgagatgggcaatttcacaatttgcttcagtagaaaggattgtaggagaagataaatatttctgtgaaaactgccatcattatactgaagctgaacgaagtcttttgtttgacaaaatgcctgaagttataactattcatttgaagtgctttgctgctagtggtttggagtttgattgttatggtggtggactttccaagatcaacactcctttattgacacctcttaaattgtcactagaagaatggagcacaaagccaactaacgacagctatggattatttgcggttgtgatgcatagtggcattacaattagtagtgggcattacactgcttctgttaaagtcactgaccttaacagtttagaactagataaaggaaattttgtggttgaccaaatgtgtgaaataggtaagccagaaccattgaatgaggaggaagcaaggggtgtggttgagaattataatgatgaagaagtgtcaattagagttggtggaaatacacagccaagtaaagttttgaacaaaaaaaatgtagaagctattggacttcttggaggacaaaagagcaaagcagattatgagctatacaacaaagcctctaatcctgataaggttgctagtacagcgtttgctgaaaatagaaattctgagactagtgatactactgggacccatgaatctgatagaaacaaggaatccagtgaccaaacaggcattaatattagtggatttgagaacaaaatttcatacgtagtgcaaagcttaaaggagtatgaggggaagtggttgctttttgatgattctgaagtcaaagttactgaagagaaggactttctgaattctctttccccttctacatctcctacttctactccttacttgctattttataagaaattatagagtgagtgtattttccttgtgtatatattaaacacacccatacaaacattggtaaagttgattacatcaaagaatctttagcttatcttttgaagctactggatattattggtctctctaggtttttatataaatagtgaaatttgaattactgaaaaccatgttaatttttagaactcattttcctcagtagagactagtgatgcattagcttctgggaacaaacttgtatcggttcttaattaaattatccaaaacggaggcatttaaacacttggatttacaccagtcttttgtgtttgctttttaaaataaagtgctcgtatttgtattctccatattttggagtaattatctacatgatgtttatagttcctgtggtttttcacccaagaagcagaatctcattcagtacatttagttttataagagtcatgaagctaaatccttgggctatgtcagaggcacaaagtctagaatgtgtgtattcacaatggtgtatgtacattttgtgccttgattcacttagaagtgtctcagaaaacctggacagttcgcttctacacaagaattttatatgtatttatgaagatgattctgtaccctagtatatctttttgggcatggactaatttgtatctgtttaactcatattctgcacgatctgtatatagtacatcaaacttagaggtgtgaccttaaatttaactttttttaaaaactgggaggtcaataaaatttaaactgcttaact

SEQ ID NO: 906 - DNA, 649 bp, Homo sapiens
  ref <308>: DATABASE ACCESSION NUMBER: NM_003376
  ref <309>: DATABASE ENTRY DATE: 2001-06-18
tcgggcctccgaaaccatgaactttctgctgtcttgggtgcattggagccttgccttgctgctctacctccaccatgccaagtggtcccaggctgcacccatggcagaaggaggagggcagaatcatcacgaagtggtgaagttcatggatgtctatcagcgcagctactgccatccaatcgagaccctggtggacatcttccaggagtaccctgatgagatcgagtacatcttcaagccatcctgtgtgcccctgatgcgatgcgggggctgctgcaatgacgagggcctggagtgtgtgcccactgaggagtccaacatcaccatgcagattatgcggatcaaacctcaccaaggccagcacataggagagatgagcttcctacagcacaacaaatgtgaatgcagaccaaagaaagatagagcaagacaagaaaatccctgtgggccttgctcagagcggagaaagcatttgtttgtacaagatccgcagacgtgtaaatgttcctgcaaaaacacagactcgcgttgcaaggcgaggcagcttgagttaaacgaacgtacttgcagatgtgacaagccgaggcggtgagccgggcaggaggaaggagcctccctcagcgtttcgggaaccagatctctcaccagg

SEQ ID NO: 907 - DNA, 1851 bp, Homo sapiens
  ref <308>: DATABASE ACCESSION NUMBER: NM_003380
  ref <309>: DATABASE ENTRY DATE: 2001-06-18
gggcgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctaggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacattcctgattaagacggttgaaactagagatggacaggttatcaacgaaacttctcagcatcacgatgaccttgaataaaaattgcacacactcagtggcaggcgatatattacccaggcaagaataaaaaagaaatcccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaactcca

SEQ ID NO: 908 - DNA, 4114 bp, Homo sapiens
  ref <308>: DATABASE ACCESSION NUMBER: NM_003392
  ref <309>: DATABASE ENTRY DATE: 2001-06-18
attaattctggctccacttgttgctcggcccaggttggggagaggacggagggtggccgcagcgggttcctgagtgaattacccaggagggactgagcacagcaccaactagagaggggtcagggggtgcgggactcgagcgagcaggaaggaggcagcgcctggcaccagggctttgactcaacagaattgagacacgtttgtaatcgctggcgtgccccgcgcacaggatcccagcgaaaatcagatttcctggtgaggttgcgtgggtggattaatttggaaaaagaaactgcctatatcttgccatcaaaaaactcacggaggagaagcgcagtcaatcaacagtaaacttaagagacccccgatgctcccctggtttaacttgtatgcttgaaaattatctgagagggaataaacatcttttccttcttccctctccagaagtccattggaatattaagcccaggagttgctttggggatggctggaagtgcaatgtcttccaagttcttcctagtggctttggccatatttttctccttcgcccaggttgtaattgaagccaattcttggtggtcgctaggtatgaataaccctgttcagatgtcagaagtatatattataggagcacagcctctctgcagccaactggcaggactttctcaaggacagaagaaactgtgccacttgtatcaggaccacatgcagtacatcggagaaggcgcgaagacaggcatcaaagaatgccagtatcaattccgacatcgacggtggaactgcagcactgtggataacacctctgtttttggcagggtgatgcagataggcagccgcgagacggccttcacatacgccgtgagcgcagcaggggtggtgaacgccatgagccgggcgtgccgcgagggcgagctgtccacctgcggctgcagccgcgccgcgcgccccaaggacctgccgcgggactggctctggggcggctgcggcgacaacatcgactatggctaccgctttgccaaggagttcgtggacgcccgcgagcgggagcgcatccacgccaagggctcctacgagagtgctcgcatcctcatgaacctgcacaacaacgaggccggccgcaggacggtgtacaacctggctgatgtggcctgcaagtgccatggggtgtccggctcatgtagcctgaagacatgctggctgcagctggcagacttccgcaaggtgggtgatgccctgaaggagaagtacgacagcgcggcggccatgcggctcaacagccggggcaagttggtacaggtcaacagccgcttcaactcgcccaccacacaagacctggtctacatcgaccccagccctgactactgcgtgcgcaatgagagcaccggctcgctgggcacgcagggccgcctgtgcaacaagacgtcggagggcatggatggctgcgagctcatgtgctgcggccgtgggtacgaccagttcaagaccgtgcagacggagcgctgccactgcaagttccactggtgctgctacgtcaagtgcaagaagtgcacggagatcgtggaccagtttgtgtgcaagtagtgggtgccacccagcactcagccccgctcccaggacccgcttatttatagaaagtacagtgattctggtttttggtttttagaaatattttttatttttccccaagaattgcaaccggaaccattttttttcctgttaccatctaagaactctgtggtttattattaatattataattattatttggcaataatgggggtgggaaccacgaaaaatatttattttgtggatctttgaaaaggtaatacaagacttcttttggatagtatagaatgaagggggaaataacacataccctaacttagctgtgtgggacatggtacacatccagaaggtaaagaaatacattttctttttctcaaatatgccatcatatgggatgggtaggttccagttgaaagagggtggtagaaatctattcacaattcagcttctatgaccaaaatgagttgtaaattctctggtgcaagataaaaggtcttgggaaaacaaaacaaaacaaaacaaacctcccttccccagcagggctgctagcttgctttctgcattttcaaaatgataatttacaatggaaggacaagaatgtcatattctcaaggaaaaaaggtatatcacatgtctcattctcctcaaatattccatttgcagacagaccgtcatattctaatagctcatgaaatttgggcagcagggaggaaagtccccagaaattaaaaaatttaaaactcttatgtcaagatgttgatttgaagctgttataagaattgggattccagatttgtaaaaagacccccaatgattctggacactagattttttgtttggggaggttggcttgaacataaatgaaatatcctgtattttcttagggatacttggttagtaaattataatagtagaaataatacatgaatcccattcacaggtttctcagcccaagcaacaaggtaattgcgtgccattcagcactgcaccagagcagacaacctatttgaggaaaaacagtgaaatccaccttcctcttcacactgagccctctctgattcctccgtgttgtgatgtgatgctggccacgtttccaaacggcagctccactgggtcccctttggttgtaggacaggaaatgaaacattaggagctctgcttggaaaacagttcactacttagggatttttgtttcctaaaacttttattttgaggagcagtagttttctatgttttaatgacagaacttggctaatggaattcacagaggtgttgcagcgtatcactgttatgatcctgtgtttagattatccactcatgcttctcctattgtactgcaggtgtaccttaaaactgttcccagtgtacttgaacagttgcatttataaggggggaaatgtggtttaatggtgcctgatatctcaaagtcttttgtacataacatatatatatatatacatatatataaatataaatataaatatatctcattgcagccagtgatttagatttacagcttactctggggttatctctctgtctagagcattgttgtccttcactgcagtccagttgggattattccaaaagttttttgagtcttgagcttgggctgtggccccgctgtgatcataccctgagcacgacgaagcaacctcgtttctgaggaagaagcttgagttctgactcactgaaatgcgtgttgggttgaagatatctttttttcttttctgcctcacccctttgtctccaacctccatttctgttcactttgtggagagggcattacttgttcgttatagacatggacgttaagagatattcaaaactcagaagcatcagcaatgtttctcttttcttagttcattctgcagaatggaaacccatgcctattagaaatgacagtacttattaattgagtccctaaggaatattcagcccactacatagatagctttttttttttttttttttttttaataaggacacctctttccaaacaggccatcaaatatgttcttatctcagacttacgttgttttaaaagtttggaaagatacacatcttttcatacccccccttaggaggttgggctttcatatcacctcagccaactgtggctcttaatttattgcataatgatatccacatcagccaactgtggctctttaatttattgcataatgatattcacatcccctcagttgcagtgaattgtgagcaaaagatcttgaaagcaaaaagcactaattagtttaaaatgtcacttttttggtttttattatacaaaaaccatgaagtactttttttatttgctaaatcagattgttcctttttagtgactcatgtttatgaagagagttgagtttaacaatcctagcttttaaaagaaactatttaatgtaaaatattctacatgtcattcagatattatgtatatcttctagcctttattctgtacttttaatgtacatatttctgtcttgcgtgatttgtatatttcactggtttaaaaaacaaacatcgaaaggcttattccaaatggaag

SEQ ID NO: 909 - DNA, 3138 bp, Homo sapiens
  ref <308>: DATABASE ACCESSION NUMBER: NM_003412
  ref <309>: DATABASE ENTRY DATE: 2001-06-18
cgggtgccatgcagctttctctaatttgctctcagttcctggctatgaattgctaaactatcagtctcgcgctcaccgcccggctgaggaggtgaaagtttctccccaggaagataaaccgcaaaagacatatattgtgcatgatttgcgccttttctttggctttttctttctttcttcacccccccacccacttttttttttttttttttcaaaaagcagagagggaaaaacggagagtgaaggagcgaggaggcgagcgtgagagaaaggagagagagagaaaagaaagggcgaggggctagtggaggaaggaaggaggggcggctgcgcgaggcggagagagggcgaagcagtcgcggcactggcgctcacattcctctatgctacaaatccaggaggaagtttttttttagggggctgagatgctccatgcctttaaaagggcagccttgacgcgcggccctctcggcagagactgagcggcgagaaagtgcgagccgggccggcagaatctgcctggcgggcgctggagcctgcgttactcgcggcccgcagccgtccggctactttgcgtttggcccggccagcgccgcgcggcgcgcgcgcgccattgcctgcaggctaggacttcgcgaggtgggtcgactcaccctccctcctcctcttcttcctcctcttcctcctcctcttgttcctcctcctcctcccgattttccctcctcggctggcgagggtggggggggcgggggaggccggggctcgccccgagcagccacgatgctcctggacgccggcccccagtacccagcgatcggcgtgaccacctttggcgcgtcccgccaccactccgcgggcgacgtggccgaacgagacgtgggcctgggcatcaacccgttcgccgacggcatgggcgccttcaagctcaaccccagttcgcacgagctggcttcggccggccagacagccttcacgtcgcaggcgccaggctacgcggctgctgcggccctgggccatcaccatcacccgggccacgtcggctcctattccagcgcagccttcaactccacgcgggactttctgttccgcaaccggggttttggcgacgcggcggcggcagccagcgcacagcacagcctctttgctgcatcggccgggggcttcgggggcccacacggccacacggacgccgcgggccacctcctcttccccgggcttcacgagcaggctgccggccacgcgtcgcctaacgtggtcaacgggcagatgaggctcggcttctcgggggacatgtacccgcgaccggagcagtacggccaggtgaccagcccgcgttcggagcactatgctgcgccgcagctgcacggctacgggcccatgaacgtgaacatggccgcgcatcacggcgccggcgccttcttccgctacatgcgccaacccatcaagcaagagctcatctgcaagtggatcgagcccgagcagctggccaaccccaaaaagtcgtgcaacaaaactttcagcaccatgcacgagctagttacgcacgtcaccgtggagcacgtaggtggcccggagcagagtaatcacatctgcttctgggaggagtgtccgcgcgagggcaagcccttcaaagccaaatacaaactggttaaccacatccgcgtgcacacgggcgagaagccctttccctgccccttccctggctgtggcaaggtcttcgcgcgctccgagaatttaaagatccacaaaaggacgcacacaggggagaagcccttcaagtgcgagtttgagggctgtgaccggcgcttcgctaacagcagcgaccgcaagaagcacatgcacgtgcacacgagcgacaagccctatctttgcaagatgtgcgacaagtcctacacgcatcccagttccgtgcgcaaacacatgaaggtccacgaatcctcctcgcagggctcgcagccttcgccggccgccagctctggctacgaatcctccacgcctcccaccatcgtgtctccctccacagacaacccgaccacaagctccttatcgccctcctcctccgcagtccaccacacagccggccacagtgcgctctcttccaattttaacgaatggtacgtttaaaatcagaaacaaaacatcgaacaaaaccctatttaagagacttgatcacacacgtatacacaacattactgaaagaaccctgcgaatcaaaacaacccccacacagaccccgcaatcctcttttaaaaaatctgccaatagacccaggacgagtaagagaggaagcatcaaccttttaaaaatttcctttcgctttcattatttttctttttttggcaaaggcttggtacccaaggtgcggtagggggtcgagggggaggaggccacctgaccaaatgccgccaaccccgagggccagtttcttgtcgaattggtacgggctctctggggcttcggcttctttttttctttgttttcttgtaaatacagaattattagcttaaaactgtactgttgaattctgtaaatagttatatctcggttggagcgggtgggtgggattgtggcgttgtggtctttgcattgggggaggggggagggaccggatgggcggggggagggggagggggaggggtgggcggccgaaagccaactgtttgtactgaatggcaagaatgttctagtaaatgtgtaccaaaatgtgaattactttgtacgattacagtctccacgtcgacctaacccaatattattggtattaatgtgctttttttgtataaagtgcaaacatttcgtcccaaagtctaagtactttagtgcagtaaaatgttgtttcatgtcctgtcaagaattcgtatagtacgagcctggatctgcgtgtcaaactgttccatttgtttatgtaaagtgatattaaaaaagatataaactataactgtccgttacttttggcaaaagatacaaccacataatgtatataattcctagtttccatatttatccgcatgtaaagggccggtttatccatgttacagctcttcaatatttatggctagaagaactcgtatgtacactttagtttccagaactgtttggtaacctttcgtaccttattaaagattcttaaatctcaaa

SEQ ID NO: 910 - DNA, 3839 bp, Homo sapiens
  ref <308>: DATABASE ACCESSION NUMBER: NM_003430
  ref <309>: DATABASE ENTRY DATE: 2001-06-18
caggtctcgacttcactgctctgtgtcctctgctccaggaggcccagcctgtgtggccctgtgacctgcaggtattggaagagccacagctaagatgccaggaacccctggaagcctagaaatgggactgttgacatttagggatgtggccatagaattctctccggaggagtggcaatgtctggacactgcacagcagaatttatataggaatgtgatgttagagaactacagaaacctggccttcctgggtattgctctctctaagccagacctgattacttatctggagcaaggaaaagagccctggaatatgaagcaacatgagatggtggatgaacccacaggtatatgtcctcattttcctcaagacttttggccagagcagagcatggaagattcttttcaaaaagtattactgagaaaatatgaaaaatgtggacatgagaatttacagttaagaaaaggttgtaaaagtgtggatgagtgtaaggtgcacaaagaaggttataataaacttaaccagtgtctcacaactgcccagagcaaagtatttcaatgtgggaaatatttgaaagtcttctataaatttttaaattcaaacagacatacgataagacataccggaaagaaatgcttcaaatgtaaaaaatgtgtcaagtcattttgcatccgtttacacaaaacccaacataaatgcgtttatattacagagaagtcctgtaaatgtaaagaatgtgaaaaaacctttcattggtcctcaacccttactaatcataaggaaattcatactgaagataaaccctacaaatgtgaagaatgtggcaaagcttttaagcagctctcaacccttactacacataaaataatctgtgctaaagagaaaatctacaagtgtgaagaatgtggcaaagcatttctatggtcctcaaccctaactagacataagaggatacacactggagagaaaccctacaaatgtgaagaatgtggcaaagcttttagccattcttcaacccttgctaaacataagagaattcatactggagagaaaccctacaaatgtgaagaatgtggcaaagcttttagccattcttcagcccttgctaaacataagagaattcatactggagagaaaccctacaaatgtaaagaatgtggcaaagcttttagcaattcctcaacccttgctaatcataagataactcatactgaagagaaaccctacaaatgtaaagaatgtgacaaaacttttaagcgactctcaacccttactaaacataaaataatacatgctggagagaaactctacaaatgtgaagaatgtggcaaagcttttaatcgatcttcaaatcttactatacataagtttattcatactggagagaaaccttacaagtgtgaagaatgtggcaaagcatttaactggtcctcaagccttactaaacataaaagatttcatactagagagaaacccttcaaatgtaaagaatgtggcaaaggatttatatggtcttcaaccctaactagacataagaggatacacactggagagaagccctacaaatgtgaagaatgtggcaaagcttttaggcaatcctcaacccttactaaacataagataattcatactggagagaaaccctacaaatttgaagaatgtggcaaagcttttagacaatccttaacccttaataaacataagataattcatagtagagagaaaccctacaaatgtaaagaatgtggcaaagcttttaagcaattctcaacccttactacacataaaataattcatgctggaaagaaactctacaaatgtgaagaatgtggcaaagcttttaatcattcctcaagtctttctacacataagataattcatactggagagaagtcttacaagtgtgaagaatgtggcaaagcatttctatggtcctcaaccctaagaagacataagaggatacacactggagagaaaccctacaaatgtgaagaatgtggcaaagcttttagccattcttcagcccttgctaaacataagagaattcatactggagagaaaccctacaaatgtaaagaatgtggcaaagcttttagcaattcctcaacccttgctaatcataagataactcatactgaagagaaaccctacaaatgtaaagaatgtgacaaaacttttaagcgactctcaacccttactaaacataaaataatacatgctggagagaaactctacaaatgtgaagaatgtggcaaagcttttaatcgatcttcaaatcttactatacataagtttattcatactggagagaaaccttacaagtgtgaagaatgtggcaaagcatttaactggtcctcaagccttactaaacataaaagaattcatactagagagaaacccttcaaatgtaaagaatgtggcaaagcatttatatggtcttcaaccctaactagacataagaggatacacactggagagaagccctacaaatgtgaagaatgtggcaaagcttttagccgttcctcaacccttactaagcataagacaattcatactggagagaaaccctacaaatgtaaagaatgtggcaaagcttttaagcactcctcagcccttgctaaacataaaataatacatgctggagagaaactctacaaatgtgaggaatgtggcaaagcttttaatcaatcttcaaatcttacgacacataagataattcatactaaagagaaaccttccaagagtgaagaatgtgacaaagcatttatctggtcctcaacccttactgaacataagagaattcataccagagagaaaccctacaaatgtgaagaatgtggcaaagcatttagccagccttcacaccttactacacataagaggatgcacactggagagaaaccctacaaatgtgaagaatgtggcaaagcttttagccaatcctcaacccttactacacataagataattcatactggagagaaaccctacaaatgtgaagaatgtggcaaagcttttaggaaatcttcaactcttactgaacataagataattcatactggagagaaaccctacaaatgtgaagaatgtggcaaagcatttagccaatcctcaaccctaactagacatacgaggatgcacactggagagaaaccatacaaatgtgaagaatgtgggaaagcttttaatcgatcctcaaagcttactacacataagataattcatactggagagaaaccttacaagtgtgaagaatgtggcaaagcatttatatcatcctcaaccctaaatggacataagagaattcatactagagagaaaccctacaaatgtgaagaatgtggcaaagcatttagccaatcttcaaccctaactagacataagaggttgcacaccggagagaaaccctacaaatgtggagaatgtggcaaagcctttaaagagtcctcagctcttactaaacataagataattcacactggagagaaaccctacaaatgtgaaaaatgttgcaaagcctttaaccagtcttcaatccttactaaccataagaaaattcatactatcacacctgtaatcccactactttgggaggccgaggcgggcggatcacgaggtcaggagatggagaccatcctggctaacacagtgaaaccccttctctactaaaaaatacaaaaaactagccgggcgtggtggcgggcgcctgtagtcccagctatgcgagaggctgaggcaggagaatggcgtgaacccgggaggcggagcttgcagtgagccgagatcacgccactgcactcaagcctgggcgacagagcgagactccgtctcaaaaaaa

SEQ ID NO: 911 - DNA, 929 bp, Homo sapiens
  ref <308>: DATABASE ACCESSION NUMBER: NM_003462
  ref <309>: DATABASE ENTRY DATE: 2001-06-18
caaacaaggcccacactggacagggcagctgctgggttgctactctcgcctccgccatgattccgcccgcagactcttttgctcaagtacgacaccccagtgctggtgagccggaacacggagaaacggagccccaaggtcggctactgaaagtcagcccccagcagcctggaccttcaggttcagccccacagccacccaagaccaagctcccctcaactccctgtgtcccagatcctacaaagcaggcagaagaaatcttgaatgccatactacccccaagggagtgggtggaagacacgcagctatggatccagcaggtgtccagcacccctacgcaccaggatggacgtggtgcacctccaggagcagttagacttaaagctgcagcagcggcaggccagggaaacaggcatctgccctgtccgcaggaactctactcacagtgttttgatgagttgatccgggagtcaccatcaactgtgcggagagggggctgctgctgctgcagtcgggacgagatccgcatgaccatcgctgcctaccagaccctgtacgagagcagcgtggcgtttggcatgaggaaggcactgcaggctgagcaggggaagtcagacatggagaggaaaatcgcagaattggagacggaaaagagagacctggagaggcaagtgaacgagcagaaggcaaaatgtgaagccactgagaagcgggagagcgagaggcggcaggtggaggagaagaagcacaatgaggagattcagttcctgaagcgaacaaatcagcagctgaaggcccaactggaaggcattattgcaccaaagaagtgataatttccacatgattaatttccaacaagacacttgggagttatttactgtgttcctctggcagccaataaaatcatcataagccctttgtaataaaaa

SEQ ID NO: 912 - DNA, 1679 bp, Homo sapiens
  ref <308>: DATABASE ACCESSION NUMBER: NM_003467
  ref <309>: DATABASE ENTRY DATE: 2001-06-18
gtttgttggctgcggcagcaggtagcaaagtgacgccgagggcctgagtgctccagtagccaccgcatctggagaaccagcggttaccatggaggggatcagtatatacacttcagataactacaccgaggaaatgggctcaggggactatgactccatgaaggaaccctgtttccgtgaagaaaatgctaatttcaataaaatcttcctgcccaccatctactccatcatcttcttaactggcattgtgggcaatggattggtcatcctggtcatgggttaccagaagaaactgagaagcatgacggacaagtacaggctgcacctgtcagtggccgacctcctctttgtcatcacgcttcccttctgggcagttgatgccgtggcaaactggtactttgggaacttcctatgcaaggcagtccatgtcatctacacagtcaacctctacagcagtgtcctcatcctggccttcatcagtctggaccgctacctggccatcgtccacgccaccaacagtcagaggccaaggaagctgttggctgaaaaggtggtctatgttggcgtctggatccctgccctcctgctgactattcccgacttcatctttgccaacgtcagtgaggcagatgacagatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaagcgcaaggccctcaagaccacagtcatcctcatcctggctttcttcgcctgttggctgccttactacattgggatcagcatcgactccttcatcctcctggaaatcatcaagcaagggtgtgagtttgagaacactgtgcacaagtggatttccatcaccgaggccctagctttcttccactgttgtctgaaccccatcctctatgctttccttggagccaaatttaaaacctctgcccagcacgcactcacctctgtgagcagagggtccagcctcaagatcctctccaaaggaaagcgaggtggacattcatctgtttccactgagtctgagtcttcaagttttcactccagctaacacagatgtaaaagacttttttttatacgataaataacttttttttaagttacacatttttcagatataaaagactgaccaatattgtacagtttttattgcttgttggatttttgtcttgtgtttctttagtttttgtgaagtttaattgacttatttatataaattttttttgtttcatattgatgtgtgtctaggcaggacctgtggccaagttcttagttgctgtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgtattaagttgttaataaaagtacatgttaaacttacttagtgttatg

SEQ ID NO: 913 - DNA, 2699 bp, Homo sapiens
  Modified_base 1 ... 2699: n = a,c,g, or t
  ref <308>: DATABASE ACCESSION NUMBER: NM_003472
  ref <309>: DATABASE ENTRY DATE: 2001-06-18
ggcccgcggcggccgaaatccgcggttcacagcatgtccgcctcggcccctgctgcggagggggagggaacccccacccagcccgcgtccgagaaagaacccgaaatgcccggtcccagagaggagagcgaggaggaagaggacgaggacgacgaggaggaggaggaggaggaaaaagaaaagagtctcatcgtggaaggcaagagggaaaagaaaaaagtagagaggttgacaatgcaagtctcttccttacagagagagccatttacaattgcacaaggaaaggggcagaaactttgtgaaattgagaggatacatttttttctaagtaagaagaaaaccgatgaacttagaaatctacacaaactgctttacaacaggccaggcactgtgtcctcattaaagaagaatgtgggtcagttcagtggctttccatttgaaaaaggaagtgtccaatataaaaagaaggaagaaatgttgaaaaaatttagaaatgccatgttaaagagcatctgtgaggttcttgatttggagagatcaggtgtaaatagtgaactagtgaagaggatcttgaatttcttaatgcatccaaagccttctggcaaaccattgccgaaatctaaaaaaacttgtagcaaaggcagtaaaaaggaacggaacagttctggaatggcaaggaaggctaagcgaaccaaatgtcctgaaattctgtcagatgaatctagtagtgatgaagatgaaaagaaaaacaaggaagagtcttcagatgatgaagataaagaaagtgaagaggagccaccaaaaaagacagccaaaagagaaaaacctaaacagaaagctacttctaaaagtaaaaaatctgtgaaaagtgccaatgttaagaaagcagatagcagcaccaccaagaagaatcaaaacagttccaaaaaagaaagtgagtctgaggatagttcagatgatgaacctttaattaaaaagttgaagaaaccccctacagatgaagagttaaaggaaacaataaagaaattactggccagtgctaacttggaagaagtcacaatgaaacagatttgcaaaaaggtctatgaaaattatcctacttatgatttaactgaaagaaaagatttcataaaaacaactgtaaaagagctaatttcttgagatagaggacagagaagatgactcgttcccatagatttgaagatctgatttataccattataccagcaaagagaatgtatttccttttctaaatccttgttaagcaacgttagtagaacttactgctgacctttttatcttgagtgttatgtgaatttgagtttgctgttttaaattgcatttctatgccatttttagtttaaaatcttgcatggcattaattgttccttgcttttatagttgtattttgtacattttggatttctttatataaggtcatagattcttgagctgttgtggtttttagtgcacttaatattagcttgcttaaggcatacttttaatcaagtagaacaaaaactattatcaccaggatttatacatacagagattgtagtatttagtatatgaaatattttgaatacacatctctgtcagtgtgaaaattcagcggcagtgtgtccatcatattaaaaatatacaagctacagttgtccagatcactgaattggaacttttctcctgcatgtgtatatatgtcaaattgtcagcatgacaaaagtgacagatgttattttngtatttttaaaaaacaattggttgtatataaagtttttttatttcttttgtgcagatcactttttaaactcacataggtaggtatctttatagttgtagactatggaatgtcagtgttcagccaaacagtatgatggaacagtgaaagtcaattcagtgatggcaacactgaaggaacagttaccctgctttgcctcgaaagtgtcatcaatttgtaattttagtattaactctgtaaaagtgtctgtaggtacgttttatattatataaggacagaccaaaaatcaacctatcaaagcttcaaaaactttgggaaagggtgggattaagtacaagcacatttggcttacagtaaatgaactgatttttattaactgcttttgcccatataaaatgctgatatttactggaaacctagccagcttcacgattatgactaaagtaccagattataatgccagaatataatgtgcaggcaatcgtggatgtctctgacaaagtgtgtctcaaaaataatatacttttacattaaagaaatttaatgtttctctggagttggggctcttggctttcagagtttggttaatcagtgttgattctagatgatcaacataatggaccactcctgaatgagacttaattttgtctttcaaatttactgtcttaaatcagtttattaaatctgaattttaaaacatgctgtttatgacacaatgacacatttgttgcaccaattaagtgttgaaaaatatctttgcatcatagaacagaaatatataaaaatatatgttgaatgttaacaggtattttcacaggtttgtttcttgatagttactcagacactagggaaaggtaaatacaagtgaacaaaataagcaactaaatgagacctaataattggccttcgattttaaatatttgttcttataaaccttgtcaataaaaataaatctaaatca

SEQ ID NO: 914 - DNA, 1526 bp, Homo sapiens
  ref <308>: DATABASE ACCESSION NUMBER: NM_003479
  ref <309>: DATABASE ENTRY DATE: 2001-06-18
gtttttttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagat

SEQ ID NO: 915 - DNA, 7247 bp, Homo sapiens
  ref <308>: DATABASE ACCESSION NUMBER: NM_003489
  ref <309>: DATABASE ENTRY DATE: 2001-06-18
gggaatatattcactaaggattctatctgcttactgctacagacctatgtgttaaggaattcttctcctcctccttgcgtagaagttgatcagcactgtggtcagactgcatttatcttgtcattgccagaagaaatcttggacagaatgtaacagtacgtctctctctgattgcgatggaaggtgataaactgatactcctttattaaagttacatcgcactcaccacagaaaaccattctttaaagtgaatagaaaccaagcccttgtgaacacttctattgaacatgactcatggagaagagcttggctctgatgtgcaccaggattctattgttttaacttacctagaaggattactaatgcatcaggcagcagggggatcaggtactgccgttgacaaaaagtctgctgggcataatgaagaggatcagaactttaacatttctggcagtgcatttcccacctgtcaaagtaatggtccagttctcaatacacatacatatcagggatctggcatgctgcacctcaaaaaagccagactgttgcagtcttctgaggactggaatgcagcaaagcggaagaggctgtctgattctatcatgaatttaaacgtaaagaaggaagctttgctagctggcatggttgacagtgtccgtaaaggcaaacaggatagcacattactggcctctttgcttcagtcattcagctctaggctgcagactgttgctctgtcacaacaaatcaggcagagcctcaaggagcaaggatatgccctcagtcatgattctttaaaagtggagaaggatttaaggtgctatggtgttgcatcaagtcacttaaaaactttgttgaagaaaagtaaagttaaagatcaaaagcctgatacgaatcttcctgatgtgactaaaaacctcatcagagataggtttgcagagtctcctcatcatgttggacaaagtggaacaaaggtcatgagtgaaccgttgtcatgtgctgcaagattacaggctgttgcaagcatggtggaaaaaagggctagtcctgccacctcacctaaacctagtgttgcttgtagccagttagcattacttctgtcaagcgaagcccatttgcagcagtattctcgagaacacgctttaaaaacgcaaaatgcaaatcaagcagcaagtgaaagacttgctgctatggccagattgcaagaaaatggccagaaggatgttggcagttaccagctcccaaaaggaatgtcaagccatcttaatggtcaggcaagaacatcatcaagcaaactgatggctagcaaaagtagtgctacagtgtttcaaaatccaatgggtatcattccttcttcccctaaaaatgcaggttataagaactcactggaaagaaacaatataaaacaagctgctaacaatagtttgcttttacatcttcttaaaagccagactatacctaagccaatgaatggacacagtcacagtgagagaggaagcatttttgaggaaagtagtacacctacaactattgatgaatattcagataacaatcctagttttacagatgacagcagtggtgatgaaagttcttattccaactgtgttcccatagacttgtcttgcaaacacggaactgaaaaatcagaatctgaccaacctgtttccctggataacttcactcaatccttgctaaacacttgggatccaaaagtcccagatgtagatatcaaagaagatcaagatacctcaaagaattctaagctaaactcacaccagaaagtaacacttcttcaattgctacttggccataagaatgaagaaaatgtagaaaaaaacaccagccctcagggagtacacaatgatgtgagcaagttcaatacacaaaattatgcaaggacttctgtgatagaaagccccagtacaaatcggactactccagtgagcactccacctttacttacatcaagcaaagcagggtctcccatcaatctctctcaacactctctggtcatcaaatggaattccccaccatatgtctgcagtactcagtctgaaaagctaacaaatactgcatctaaccactcaatggaccttacaaaaagcaaagacccaccaggagagaaaccagcccaaaatgaaggtgcacagaactctgcaacgtttagtgccagtaagctgttacaaaatttagcacaatgtggaatgcagtcatccatgtcagtggaagagcagagacccagcaaacagctgttaactggaaacacagataaaccgataggtatgattgatagattaaatagccctttgctctcaaataaaacaaatgcagttgaagaaaataaagcatttagtagtcaaccaacaggtcctgaaccagggctttctggttctgaaatagaaaatctgcttgaaagacgtactgtcctccagttgctcctggggaacccaacaaagggaagagtgaaaaaaaaagagaaaactcccttaagagatgaaagtactcaggaacactcagagagagctttaagtgaacaaatactgatggtgaaaataaaatctgagccttgtgatgacttacaaattcctaacacaaatgtgcacttgagccatgatgctaagagtgccccattcttgggtatggctcctgctgtgcagagaagcgcacctgccttaccagtgtccgaagactttaaatcggagcctgtttcacctcaggatttttctttctccaagaatggtctgctaagtcgattgctaagacaaaatcaagatagttacctggcagatgattcagacaggagtcacagaaataatgaaatggcacttctagaatcaaagaatctttgcatggtccctaagaaaaggaagctttatactgagccattagaaaatccatttaaaaagatgaaaaacaacattgttgatgctgcaaacaatcacagtgccccagaagtactgtatgggtccttgcttaaccaggaagagctgaaatttagcagaaatgatcttgaatttaaatatcctgctggtcatggctcagccagcgaaagtgaacacaggagttgggccagagagagcaaaagctttaatgttctgaaacagctgcttctctcagaaaactgtgtgcgagatttgtccccgcacagaagtaactctgtggctgacagtaaaaagaaaggacacaaaaataatgtgaccaacagcaaacctgaatttagcatttcttctttaaatggactgatgtacagttccactcagcccagcagttgcatggataacaggacattttcatacccaggtgtagtaaaaactcctgtgagtcctactttccctgagcacttgggctgtgcagggtctagaccagaatctgggcttttgaatgggtgttccatgcccagtgagaaaggacccattaagtgggttatcactgatgcggagaagaatgagtatgaaaaagactctccaagattgaccaaaaccaacccaatactatattacatgcttcaaaaaggaggcaattctgttgccagtcgagaaacacaagacaaggacatttggagggaggcttcatctgctgaaagtgtctcacaggtcacagccaaagaagagttacttcctactgcagaaacgaaagcttctttctttaatttaagaagcccttacaatagccatatgggaaataatgcttctcgcccacacagcgcaaatggagaagtttatggacttctgggaagcgtgctaacgataaagaaagaatcagaataaaatgtacctgccatccagttttggatctttttaaaactaatgagtatgaacttgagatctgtataaataagagcatgatttgaaaaaagcatggtataattgaaacttttttcattttgaaaagtattggttactggtgatgttgaaatatgcatactaatttttgcttaacattagatgtcatgaggaaactactgaactagcaattggttgtttaacacttctgtatgcgtcagataacaactgtgagtagcctatgaatgaaattcttttataaatattaggcataaattaaaatgtaaaactccattcatagtggattaatgcattttgctgcctttattagggtactttattttgcttttcagaagtcagcctacataacacatttttaaagtctaaactgttaaacaactctttaaaggataattatccaataaaaaaaaacctagtgctgattcacagcttattatccaattcaaaaataaattagaaaaatatatgcttacatttttcacttttgctaaaaagaaaaaaaaaggtgtttatttttaactcttggaagaggttttgtggttcccaatgtgtctgtcccaccctgagccttttcaatatatatttctttaaaccttgtgctacttagtaaaaattgattacaattgagggaagtttgatagatcctttaaaaaaaaggcagatttccattttttgtattttaactactttactaaattaatactcctccttttacaaattagaaaagttaacatttatctttaggtggtttcctgaaaagttgaatatttaagaaattgtttttaacagaagcaaaatggcttttctttggacagttttcaccatctcttgtaaaagttaattctcaccattcctgtggtacctgcgagtgttatgaccaggattccttaaacctgaactcagaccacttgcattagaaccatctggagcacttgttttaaaatgcagattcataggcagcatctcagatctacagaacaagaatctctgctaagtggacctggaatcttccatctgcatcttaacatgctctctaggtgtttcttgtgtttgagaaccatgacttatgactttcctcagaacatgagactgtaaaacaaaaacaaaaaactatgtgatgcctctattttccccaatacagtcacacatcagctcaaaatttgcaatattgtagttatatattaccgttatatctttggaaatccgggttcagaacactttttatgacaaaaattgggtggaggggataactttcatatctggctcaacatctcaggaaaatctgtgattatttgtgtgttctaatgagtaacatctacttagttagccttagggatggaaaaacagggccacttaccaaactcaggtgattccaggatggtttggaaacttctcctgaatgcatccttaacctttattaaaaccattgtcctaagaacaatgccaacaaagcttacaacatttagtttaaacccaagaaggacactaaactagattgactaataaaagtacaaggcacatatacgtgacagaattggtactcaatcactccattggatcttttactttaaagtagtgatgaaaagtacatgttgatactgtcttagaagaaattaatatattagtgaagccacatggggtttcagttgcgaaacaggtctgtttttatgttcagtttgtacaatccacaattcattcaccagatattttgttcttaattgtgttccaggttagcaaatgacctatcaaaaattattctataatcactactagttaggatattgatttaaaattgttctacttgaagtggtttctaagatttttatatttaaaaataggtgtgatttcctaatatgatctaaaaccctaaatggttatttttcctcagaatgatttgtaaatagctactggaaatattatacagtaataggagtgggtattatgcaacatcatggagagtgaaggcataggcttattctgacataaaattccactggccagttgaatatattctattccatgtccatactctgacaatcttattgtcaacactatataaataagcttttaaacaagtcatttttcttgatcgttgtggaaggtttggagccttagaggtatgtcagaaaaaatatgttggtattctcccttgggtagggggaaatgacctttttacaagagagatgaaatttaggtcagggaaaagaccaagggccagcatgctacttttgtgtgtgtgtgtgtgggttttgttttgttttttttggttggctggttgttttcattattattaacaaaggaatgagaatatgtaatacttaaataaacatgaccacgaagaatgctgttctgatttactagagaatgttcccaatttgaatttagggtgattttaaagaacagtgagaaagggcatacatccacagattcactttgtttatgcatatgtagatacaaggatgcacatatacacattttcaaggactattttagatatctagacaatttcttctaataaagtcatttgtgaaagggtactacagcttattgacatcagtaaggtagcattcattacctgtttattctctgctgcatcttacagaagagtaaactggtgagagtatatattttatatatatatatatatataatatgtatatatatatatattgacttgttacatgaagatgttaaaatcggtttttaaaggtgatgtaaatagtgatttccttaatgaaaaatacatattttgtattgttctaatgcaacagaaaagccttttaatctctttggttcctgtatattccatgtataagtgtaaatataatcagacaggtttaaaagttgtgcatgtatgtatacagttgcaagtctggacaaatgtatagaataaaccttttatttaagttgtgattacctgctgcatgaaaagtggcatgggggaccctgtgcatctgtgcatttggcaaaatgtcttaacaaatcagatcagatgttcatcctaacatgacagtattccatttctggacatgacgtctgtggtttaagctttgtgaaagaatgtgctttgattcgaagggtcttaaagaatttttttaatcgtcaaccacttttaaacataaagaattcacacaactactttcatgaattttttaatcccattgcaaacattattccaagagtatcccagtattagcaatactggaatataggcacattaccattcatagtaagaattctggtgtttacacaaccaaatttgatgcgatctgctcagtaatataatttgccatttttattagaaatttaatttcttcatgtgatgtcatgaaactgtacatactgcagtgtgaatttttttgttttgttttttaatcttttagtgtttacttcctgcagtgaatttgaataaatgagaaaaaatgcaaaaaaaaaaaaaaaaaaaaa

SEQ ID NO: 916 - DNA, 6911 bp, Homo sapiens
  ref <308>: DATABASE ACCESSION NUMBER: NM_003494
  ref <309>: DATABASE ENTRY DATE: 2001-06-18
tcgaccgcccagccaggtgcaaaatgccgtgtcattgggagactccgcagccggagcattagattacagctcgacggagctcgggaagggcggcgggggtggaagatgagcagaagcccctgttctcggaacgccggctgacaagcggggtgagcgcaggcggggcggggacccagcctagcccactggagcagccgggggtggcccgttcccctttaagagcaactgctctaagccaggagccagagattcgagccggcctcgcccagccagccctctccagcgaggggacccacaagcggcgcctcggccctcccgacctttccgagccctctttgcgccctgggcgcacggggccctacacgcgccaagcatgctgagggtcttcatcctctatgccgagaacgtccacacacccgacaccgacatcagcgatgcctactgctccgcggtgtttgcaggggtgaagaagagaaccaaagtcatcaagaacagcgtgaaccctgtatggaatgagggatttgaatgggacctcaagggcatccccctggaccagggctctgagcttcatgtggtggtcaaagaccatgagacgatggggaggaacaggttcctgggggaagccaaggtcccactccgagaggtcctcgccacccctagtctgtccgccagcttcaatgcccccctgctggacaccaagaagcagcccacaggggcctcgctggtcctgcaggtgtcctacacaccgctgcctggagctgtgcccctgttcccgccccctactcctctggagccctccccgactctgcctgacctggatgtagtggcagacacaggaggagaggaagacacagaggaccagggactcactggagatgaggcggagccattcctggatcaaagcggaggcccgggggctcccaccaccccaaggaaactaccttcacgtcctccgccccactaccccgggatcaaaagaaagcgaagtgcgcctacatctagaaagctgctgtcagacaaaccgcaggatttccagatcagggtccaggtgatcgaggggcgccagctgccgggggtgaacatcaagcctgtggtcaaggttaccgctgcagggcagaccaagcggacgcggatccacaagggaaacagcccactcttcaatgagactcttttcttcaacttgtttgactctcctggggagctgtttgatgagcccatctttatcacggtggtagactctcgttctctcaggacagatgctctcctcggggagttccggatggacgtgggcaccatttacagagagccccggcacgcctatctcaggaagtggctgctgctctcagaccctgatgacttctctgctggggccagaggctacctgaaaacaagcctttgtgtgctggggcctggggacgaagcgcctctggagagaaaagacccctctgaagacaaggaggacattgaaagcaacctgctccggcccacaggcgtagccctgcgaggagcccacttctgcctgaaggtcttccgggccgaggacttgccgcagatggacgatgccgtgatggacaacgtgaaacagatctttggcttcgagagtaacaagaagaacttggtggacccctttgtggaggtcagctttgcggggaaaatgctgtgcagcaagatcttggagaagacggccaaccctcagtggaaccagaacatcacactgcctgccatgtttccctccatgtgcgaaaaaatgaggattcgtatcatagactgggaccgcctgactcacaatgacatcgtggctaccacctacctgagtatgtcgaaaatctctgcccctggaggagaaatagaagaggagcctgcaggtgctgtcaagccttcgaaagcctcagacttggatgactacctgggcttcctccccacttttgggccctgctacatcaacctctatggcagtcccagagagttcacaggcttcccagacccctacacagagctcaacacaggcaagggggaaggtgtggcttatcgtggccggcttctgctctccctggagaccaagctggtggagcacagtgaacagaaggtggaggaccttcctgcggatgacatcctccgggtggagaagtaccttaggaggcgcaagtactccctgtttgcggccttctactcagccaccatgctgcaggatgtggatgatgccatccagtttgaggtcagcatcgggaactacgggaacaagttcgacatgacctgcctgccgctggcctccaccactcagtacagccgtgcagtctttgacgggtgccactactactacctaccctggggtaacgtgaaacctgtggtggtgctgtcatcctactgggaggacatcagccatagaatcgagactcagaaccagctgcttgggattgctgaccggctggaagctggcctggagcaggtccacctggccctgaaggcgcagtgctccacggaggacgtggactcgctggtggctcagctgacggatgagctcatcgcaggctgcagccagcctctgggtgacatccatgagacaccctctgccacccacctggaccagtacctgtaccagctgcgcacccatcacctgagccaaatcactgaggctgccctggccctgaagctcggccacagtgagctccctgcagctctggagcaggcggaggactggctcctgcgtctgcgtgccctggcagaggagccccagaacagcctgccggacatcgtcatctggatgctgcagggagacaagcgtgtggcataccagcgggtgcccgcccaccaagtcctcttctcccggcggggtgccaactactgtggcaagaattgtgggaagctacagacaatctttctgaaatatccgatggagaaggtgcctggcgcccggatgccagtgcagatacgggtcaagctgtggtttgggctctctgtggatgagaaggagttcaaccagtttgctgaggggaagctgtctgtctttgctgaaacctatgagaacgagactaagttggcccttgttgggaactggggcacaacgggcctcacctaccccaagttttctgacgtcacgggcaagatcaagctacccaaggacagcttccgcccctcggccggctggacctgggctggagattggttcgtgtgtccggagaagactctgctccatgacatggacgccggtcacctgagcttcgtggaagaggtgtttgagaaccagacccggcttcccggaggccagtggatctacatgagtgacaactacaccgatgtgaacggggagaaggtgcttcccaaggatgacattgagtgcccactgggctggaagtgggaagatgaggaatggtccacagacctcaaccgggctgtcgatgagcaaggctgggagtatagcatcaccatccccccggagcggaagccgaagcactgggtccctgctgagaagatgtactacacacaccgacggcggcgctgggtgcgcctgcgcaggagggatctcagccaaatggaagcactgaaaaggcacaggcaggcggaggcggagggcgagggctgggagtacgcctctctttttggctggaagttccacctcgagtaccgcaagacagatgccttccgccgccgccgctggcgccgtcgcatggagccactggagaagacggggcctgcagctgtgtttgcccttgagggggccctgggcggcgtgatggatgacaagagtgaagattccatgtccgtctccaccttgagcttcggtgtgaacagacccacgatttcctgcatattcgactatgggaaccgctaccatctacgctgctacatgtaccaggcccgggacctggctgcgatggacaaggactctttttctgatccctatgccatcgtctccttcctgcaccagagccagaagacggtggtggtgaagaacacccttaaccccacctgggaccagacgctcatcttctacgagatcgagatctttggcgagccggccacagttgctgagcaaccgcccagcattgtggtggagctgtacgaccatgacacttatggtgcagacgagtttatgggtcgctgcatctgtcaaccgagtctggaacggatgccacggctggcctggttcccactgacgaggggcagccagccgtcgggggagctgctggcctcttttgagctcatccagagagagaagccggccatccaccatattcctggttttgaggtgcaggagacatcaaggatcctggatgagtctgaggacacagacctgccctacccaccaccccagagggaggccaacatctacatggttcctcagaacatcaagccagcgctccagcgtaccgccatcgagatcctggcatggggcctgcggaacatgaagagttaccagctggccaacatctcctcccccagcctcgtggtagagtgtgggggccagacggtgcagtcctgtgtcatcaggaacctccggaagaaccccaactttgacatctgcaccctcttcatggaagtgatgctgcccagggaggagctctactgcccccccatcaccgtcaaggtcatcgataaccgccagtttggccgccggcctgtggtgggccagtgtaccatccgctccctggagagcttcctgtgtgacccctactcggcggagagtccatccccacagggtggcccagacgatgtgagcctactcagtcctggggaagacgtgctcatcgacattgatgacaaggagcccctcatccccatccaggaggaagagttcatcgattggtggagcaaattctttgcctccataggggagagggaaaagtgcggctcctacctggagaaggattttgacaccctgaaggtctatgacacacagctggagaatgtggaggcctttgagggcctgtctgacttttgtaacaccttcaagctgtaccggggcaagacgcaggaggagacagaagatccatctgtgattggtgaatttaagggcctcttcaaaatttatcccctcccagaagacccagccatccccatgcccccaagacagttccaccagctggccgcccagggaccccaggagtgcttggtccgtatctacattgtccgagcatttggcctgcagcccaaggaccccaatggaaagtgtgatccttacatcaagatctccatagggaagaaatcagtgagtgaccaggataactacatcccctgcacgctggagcccgtatttggaaagatgttcgagctgacctgcactctgcctctggagaaggacctaaagatcactctctatgactatgacctcctctccaaggacgaaaagatcggtgagacggtcgtcgacctggagaacaggctgctgtccaagtttggggctcgctgtggactcccacagacctactgtgtctctggaccgaaccagtggcgggaccagctccgcccctcccagctcctccacctcttctgccagcagcatagagtcaaggcacctgtgtaccggacagaccgtgtaatgtttcaggataaagaatattccattgaagagatagaggctggcaggatcccaaacccacacctgggcccagtggaggagcgtctggctctgcatgtgcttcagcagcagggcctggtcccggagcacgtggagtcacggcccctctacagccccctgcagccagacatcgagcaggggaagctgcagatgtgggtcgacctatttccgaaggccctggggcggcctggacctcccttcaacatcaccccacggagagccagaaggtttttcctgcgttgtattatctggaataccagagatgtgatcctggatgacctgagcctcacgggggagaagatgagcgacatttatgtgaaaggttggatgattggctttgaagaacacaagcaaaagacagacgtgcattatcgttccctgggaggtgaaggcaacttcaactggaggttcattttccccttcgactacctgccagctgagcaagtctgtaccattgccaagaaggatgccttctggaggctggacaagactgagagcaaaatcccagcacgagtggtgttccagatctgggacaatgacaagttctcctttgatgattttctgggctccctgcagctcgatctcaaccgcatgcccaagccagccaagacagccaagaagtgctccttggaccagctggatgatgctttccacccagaatggtttgtgtccctttttgagcagaaaacagtgaagggctggtggccctgtgtagcagaagagggtgagaagaaaatactggcgggcaagctggaaatgaccttggagattgtagcagagagtgagcatgaggagcggcctgctggccagggccgggatgagcccaacatgaaccctaagcttgaggacccaaggcgccccgacacctccttcctgtggtttacctccccatacaagaccatgaagttcatcctgtggcggcgtttccggtgggccatcatcctcttcatcatcctcttcatcctgctgctgttcctggccatcttcatctacgccttcccgaactatgctgccatgaagctggtgaagcccttcagctgaggactctcctgccctgtagaaggggccgtggggtcccctccagcatgggactggcctgcctcctccgcccagctcggcgagctcctccagacctcctaggcctgattgtcctgccagggtgggcagacagacagatggaccggcccacactcccagagttgctaacatggagctctgagatcaccccacttccatcatttccttctcccccaacccaacgcttttttggatcagctcagacatatttcagtataaaacagttggaaccacaaaaaaaaaaaaaaaaaaaaaaaaa

SEQ ID NO: 917 - DNA, 798 bp, Homo sapiens
  ref <308>: DATABASE ACCESSION NUMBER: NM_003498
  ref <309>: DATABASE ENTRY DATE: 2001-06-18
gcggagccgggcccgcggggctgctgcggggcgatcgggccgggccgctgccgcgccatggactcccgtgtccagcctgagttccagcctcactgagtggccacccccaaagtgctgccagccgaggaagcccccagcactgaccatgtctattatggaccacagccccaccacgggcgtggtcacagtcatcgtcatcctcattgccatcgcggccctgggggccttgatcctgggctgctggtgctacctgcggctgcagcgcatcagccagtcagaggacgaggagagcatcgtgggggatggggagaccaaggaacccttcctgctggtgcagtattcggccaagggaccgtgcgtggagagaaaggccaagctgatgactcccaacggcccggaagtccacggctgagccaggatgcaaggctcctggtcctgtttgcagccggccaagaggcgctgggaggggcaaaaccatacggatgcgctgctgtctgagaggaagggctgacacttgctggcatggcctctgcgggcttcgtcatcgcatgcactgatgcccggggacctggctgtcctgggcttcccctcggcctccaggtgaggctgcccattgcaggcactgggcaggcctgaccttgctggggctcatggccctgtagcgcttttgttacttgaatgtctagctgagcctgtttttgatggagctactactgtaatgcgtgaactaacaaacctgtgaactgtaaataggcccctggaagcacgtgcttaagcccttttgctgatttttaaaaa

SEQ ID NO: 918 - DNA, 2225 bp, Homo sapiens
  ref <308>: DATABASE ACCESSION NUMBER: NM_003500
  ref <309>: DATABASE ENTRY DATE: 2001-06-18
ggttctttgcactgaccaatgctgagagcagaccctcggagcagccgggttggaagtgtctctccacagtcaccagacagatccaggataggatgggcagcccagtgcaccgagtgtcattgggggatacctggagcaggcaaatgcaccccgacatagagagcgagaggtatatgcagtcctttgacgtggaacggctcaccaacatccttgatggaggtgcccagaacactgcactccgcaggaaagttgagagcatcatccacagttacccggagtttagctgtaaggacaattatttcatgacccagaatgagcgttataaggctgccatgcggagggcattccacatccggttgatagctcggcgcctgggttggttagaagatggtcgtgaattaggctacgcttacagagccctttctggagacgtggccttaaatatacacagagtcttcgtgagagccctcaggagcctgggctcagaggagcagattgccaaatgggacccactctgcaaaaacatccagatcatcgcaacgtatgcacagacagagttgggacatgggacatatcttcagggcctggagactgaagccacctatgacgcagccacccaggagtttgtgatacacagccccacgctgactgccaccaaatggtggcctggagacttgggacggtcagccacccatgccctggtccaggcccagctgatctgctcaggagccaggcggggcatgcacgcttttattgtgccaatccggagtcttcaggaccacaccccactgccaggaatcatcattggggacatcggacccaagatggactttgatcaaacagacaatggcttcctgcagctgaaccatgtgcgggtccccagggagaacatgctgagtcgctttgcacaggtcttgccagatggcacctacgtcaaactcggtacagcacagagcaactaccttcccatggtggtggtgcgggtggagctgctgtcaggggagatcctccctatactgcagaaggcctgtgtcatcgccatgcgctactcggtcatccgccgccaatcccggctccggcccagtgacccagaggcaaaggtcctggactaccagacacaacagcagaaactctttcctcagctggccatcagttatgccttccatttcctggcagtcagcctcttggagttcttccagcactcctacactgccattctgaaccaagacttcagcttcctgcctgagctccacgcgctgagcacgggcatgaaggccatgatgtcagaattctgcacccagggagctgagatgtgccgcagggcctgtggcggacatggctactcaaagctgagtggcctgccatcactggtcaccaaattgtcggcctcctgcacctacgagggtgagaacacagtgctctacctgcaggtggccaggttcctggtgaagagctacctgcagactcagatgtcccctggctccacgccacagagatctctctctccatctgtcgcatatctcaccgcacctgacctggccaggtgtccagcccagagggcagccgacttcctctgcccggagctctacaccacggcctgggcacatgtggcagtaaggctcataaaggactcagtgcagcatttacagaccctgacgcaatccggagctgaccagcacgaggcttggaaccagaccactgtcatacacctccaggctgctaaggtgcactgctactatgtcactgtgaagggttttacagaagctctggagaaactagaaaatgaaccagcgattcagcaggtgctcaagcgcctctgtgacctccatgccatacatggaatcttgactaactcgggtgactttctccatgacgccttcctgtctggtgcccaagtggacatggcaagaacagcctacctggacctgctccgcctgatccggaaggatgccatcctgttaactgatgcttttgacttcaccgatcagtgtttaaattcagcccttggctgttatgatggaaacgtctacgaacgcctgttccagtgggctcagaagtcaccaaccaatactcaggagaaccctgcctatgaggaatatataagaccacttttacaaagttggagatccaagctatgaaataaccaacagtattcaagaagcaaccagcaccatcatgtgataatggtactatggcatatatgcaacattaaaattttaaattag

SEQ ID NO: 919 - DNA, 1865 bp, Homo sapiens
  ref <308>: DATABASE ACCESSION NUMBER: NM_003504
  ref <309>: DATABASE ENTRY DATE: 2001-06-18
gccaggcgtccggccgccgtggctatgttcgtgtccgatttccgcaaagagttctacgaggtggtccagagccagagggtccttctcttcgtggcctcggacgtggatgctctgtgtgcgtgcaagatccttcaggccttgttccagtgtgaccacgtgcaatatacgctggttccagtttctgggtggcaagaacttgaaactgcatttcttgagcataaagaacagtttcattattttattctcataaactgtggagctaatgtagacctattggatattcttcaacctgatgaagacactatattctttgtgtgtgacacccataggccagtcaatgtcgtcaatgtatacaacgatacccagatcaaattactcattaaacaagatgatgaccttgaagttcccgcctatgaagacatcttcagggatgaagaggaggatgaagagcattcaggaaatgacagtgatgggtcagagccttctgagaagcgcacacggttagaagaggagatagtggagcaaaccatgcggaggaggcagcggcgagagtgggaggcccggagaagagacatcctctttgactacgagcagtatgaatatcatgggacatcgtcagccatggtgatgtttgagctggcttggatgctgtccaaggacctgaatgacatgctgtggtgggccatcgttggactaacagaccagtgggtgcaagacaagatcactcaaatgaaatacgtgactgatgttggtgtcctgcagcgccacgtttcccgccacaaccaccggaacgaggatgaggagaacacactctccgtggactgcacacggatctcctttgagtatgacctccgcctggtgctctaccagcactggtccctccatgacagcctgtgcaacaccagctataccgcagccaggttcaagctgtggtctgtgcatggacagaagcggctccaggagttccttgcagacatgggtcttcccctgaagcaggtgaagcagaagttccaggccatggacatctccttgaaggagaatttgcgggaaatgattgaagagtctgcaaataaatttgggatgaaggacatgcgcgtgcagactttcagcattcattttgggttcaagcacaagtttctggccagcgacgtggtctttgccaccatgtctttgatggagagccccgagaaggatggctcagggacagatcacttcatccaggctctggacagcctctccaggagtaacctggacaagctgtaccatggcctggaactcgccaagaagcagctgcgagccacccagcagaccattgccagctgcctttgcaccaacctcgtcatctcccaggggcctttcctgtactgctctctcatggagggcactccagatgtcatgctgttctctaggccggcatccctaagcctgctcagcaaacacctgctcaagtcctttgtgtgttcgacaaagaaccggcgctgcaaactgctgcccctggtgatggctgcccccctgagcatggagcatggcacagtgaccgtggtgggcatccccccagagaccgacagctcggacaggaagaacttttttgggagggcgtttgagaaggcagcggaaagcaccagctcccggatgctgcacaaccattttgacctctcagtaattgagctgaaagctgaggatcggagcaagtttctggacgcacttatttccctcctgtcctaggaatttgattcttccagaatgaccttcttatttatgtaactggctttcatttagattgtaagttatggacatgatttgagatgtagaagccattttttattaaataaaatgcttattttagaaaaaaaaaaaaaaaaaaa

SEQ ID NO: 920 - DNA, 2184 bp, Homo sapiens
  ref <308>: DATABASE ACCESSION NUMBER: NM_003508
  ref <309>: DATABASE ENTRY DATE: 2001-06-18
ccgccttcggcccgggcctcccgggatggccgtggcgcctctgcggggggcgctgctgctgtggcagctgctggcggcgggcggcgcggcactggagatcggccgcttcgacccggagcgcgggcgcggggctgcgccgtgccaggcggtggagatccccatgtgccgcggcatcggctacaacctgacccgcatgcccaacctgctgggccacacgtcgcagggcgaggcggctgccgagctagcggagttcgcgccgctggtgcagtacggctgccacagccacctgcgcttcttcctgtgctcgctctacgcgcccatgtgcaccgaccaggtctcgacgcccattcccgcctgccggcccatgtgcgagcaggcgcgcctgcgctgcgcgcccatcatggagcagttcaacttcggctggccggactcgctcgactgcgcccggctgcccacgcgcaacgacccgcacgcgctgtgcatggaggcgcccgagaacgccacggccggccccgcggagccccacaagggcctgggcatgctgcccgtggcgccgcggcccgcgcgccctcccggagacctgggcccgggcgcgggcggcagtggcacctgcgagaaccccgagaagttccagtacgtggagaagagccgctcgtgcgcaccgcgctgcgggcccggcgtcgaggtgttctggtcccggcgcgacaaggacttcgcgctggtctggatggccgtgtggtcggcgctgtgcttcttctccaccgccttcactgtgctcaccttcttgctggagccccaccgcttccagtaccccgagcgccccatcatcttcctctccatgtgctacaacgtctactcgctggccttcctgatccgtgcggtggccggagcgcagagcgtggcctgtgaccaggaggcgggcgcgctctacgtgatccaggagggcctggagaacacgggctgcacgctggtcttcctactgctctactacttcggcatggccagctcgctctggtgggtggtcctgacgctcacctggttcctggctgccgggaagaaatggggccacgaggccatcgaggcccacggcagctatttccacatggctgcctggggcctgcccgcgctcaagaccatcgtcatcctgaccctgcgcaaggtggcgggtgatgagctgactgggctttgctacgtggccagcacggatgcagcagcgctcacgggcttcgtgctggtgcccctctctggctacctggtgctgggcagtagtttcctcctgaccggcttcgtggccctcttccacatccgcaagatcatgaagacgggcggcaccaacacagagaagctggagaagctcatggtcaagatcggggtcttctccatcctctacacggtgcccgccacctgcgtcatcgtttgctatgtctacgaacgcctcaacatggacttctggcgccttcgggccacagagcagccatgcgcagcggccgcggggcccggaggccggagggactgctcgctgccagggggctcggtgcccaccgtggcggtcttcatgctcaaaattttcatgtcactggtggtggggatcaccagcggcgtctgggtgtggagctccaagactttccagacctggcagagcctgtgctaccgcaagatagcagctggccgggcccgggccaaggcctgccgcgcccccgggagctacggacgtggcacgcactgccactataaggctcccaccgtggtcttgcacatgactaagacggacccctctttggagaaccccacacacctctagccacacaggcctggcgcggggtggctgctgccccctccttgccctccacgccctgccccctgcatcccctagagacagctgactagcagctgcccagctgtcaaggtcaggcaagtgagcaccggggactgaggatcagggcgggaccccgtgaggctcattaggggagatgggggtctcccctaatgcgggggctggaccaggctgagtccccacagggtcctagtggaggatgtggaggggcggggcagaggggtccagccggagtttatttaatgatgtaatttattgttgcgttcctctggaagctgtgactggaataaacccccgcgtggcactgctgatcctctctggctgggaagggggaaggtaggaggtgaggc

SEQ ID NO: 921 - DNA, 393 bp, Homo sapiens
  ref <308>: DATABASE ACCESSION NUMBER: NM_003510
  ref <309>: DATABASE ENTRY DATE: 2001-06-18
atgtcgggacgtggcaagcagggcggcaaagctcgcgccaaggctaagacccgttcttcaagggcgggtcttcagttcccagtgggccgagtgcaccgactgctccgcaagggcaactacgctgagcgggtcggtgccggagcgccggtgtacctggcggcggtgttggagtacctaaccgccgagatcctggaactggctggcaacgcggcccgcgacaacaagaagacccgcatcatcccgcgccacttgcagctggccatccgcaacgacgaggagctcaacaagctgcttggtaaagtgaccatcgcccagggtggtgtcctgcccaatatccaggccgtgctgctgcctaagaaaactgagagccaccacaaggccaagggcaagtag

SEQ ID NO: 922 - DNA, 1666 bp, Homo sapiens
  ref <308>: DATABASE ACCESSION NUMBER: NM_003512
  ref <309>: DATABASE ENTRY DATE: 2001-06-18
acgcgtccgaaagcggccatgttttacatatttcttgattttgtttgttttctcgtgagcttaggccgctggttttggtgatttttgtctgattgcaatgtctggacgtggtaagcaaggaggcaaagctcgcgccaaagcgaaatcccgctcttctcgcgctggtctccagttcccggtgggccgagtgcaccgcctgctccgtaaaggcaactacgcagagcgggttggggcaggcgcgccggtgtacctggcggcggtgttagagtacctgaccgccgagatcctggagctggccggcaacgcggctcgcgacaacaagaagactcgcatcatcccgcgccacttgcagctggccatccgcaacgacgaggagctcaacaaactgctaggccgggtgaccattgctcagggcggcgtccttcctaacatccaggccgtgcttctgcctaagaagaccgagagtcaccacaaggccaagggcaagtgatttgacaggtatctgagctcccggaaacgctatcaaacccaaaggctcttttcagagcccccctaccgtttcaaaggaagagctaacctcactgcttgtaggtagaaggaaaaaagcactaaggttgcaaaagcttctcatttcagagagatgccaggatcctaagtgcctgccaaacttaccaattctaaggaataagtggatggatggcattactgattcctacattactgattgattctgcatccacaaattgttttattaaaaacattctacatcatgtgtggggagataaggaggataaaatgaagagaaagaatattattgaggggaagttcttctgaatacaaaatgtgtttaattttttaaataagtattacattcacagggttcaaactatttgaagtaaagagattatataaagaatccatccctcaacttacccaggtggtcacttttctttttcttgtgtatctgcccagtattcattcctgctgatatcagtcaataatgaatgatacgtgttttcttcacttttttcattcttgtcaggtagcagactgtgtagacttttctgcacttgcccttttcataacaatctatcttggagaactttccctatgagaacatacagagcttcctgtacacagttgcatgtactgcattatgcaaatgcattatattttatgtaacctgtccactgttggtaggcacttgagttgttttagtcttttgctatcaaacagttctgggatgattaaccctgatttactgcaaaattgaaattgctctgctattctgctggaatggtggtaagtgaactgaaaattccagtcactcttgggctagactcaacgttcttaaaaactatgtggccatcaccaaattagttattttgaaccttaatttcttcacctctaaaatggaggtaatacttaccttaagtggctatgagaatgaagatcatgtgtatgaattgttggtgctctaaagaacagcacaaataaaattattttcaaatttaattttaattgaactatgtgtaatttcttaattttgaaataattttatttgtaatgtgcataatcttatttaatgtataatgtatacattgtaatagaaacagatttcccaaattccagcctggcatgaggtaataaaaggtaatgcaaaaaa

SEQ ID NO: 923 - DNA, 2223 bp, Homo sapiens
  ref <308>: DATABASE ACCESSION NUMBER: NM_003528
  ref <309>: DATABASE ENTRY DATE: 2001-06-18
acttcttttcttggctaagccgcgtttgtactgtgtcttaccatgcctgaaccggcaaaatccgctccggcgcctaaaaagggctccaagaaagccgtcaccaaagcccagaagaaagacggcaagaagcgcaagcgcagccgcaaagagagctactccatctacgtgtacaaggtgctgaagcaggtccaccccgacaccggcatctcgtccaaggccatgggcatcatgaactccttcgtcaacgacatcttcgagcgcatcgcgggagaggcttcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctccaagtgagtccctgccgggcactggcgctcgctcgctcgagtcgccggctgcttgactccaaaggctcttttcagagccacccacctaatcactagaaaagagcttgttcacttattcccttagtttcttttcataaagtaagttattttagtgtgaaggtcatgggaaatggcatacgtagctttttaactatttggaactcgaggtccccagtgcgtcattggatttgcttttgaatctagagcgtgtctttactcattgtgctgcttagccttcccaggagtcggttctcaattaggctgttgggaatccgcctctttacccgcccccactcccgccccacacgcgccctggtggctccttgggtttgtttcattctaaaacgaagtggctgagttcggctgtcatttaagagaactccaggacacaattcagcccgggttccgcaaacactgcgtgacagctctgtatgactgacgcttggcagcagcttttgtgtccggtcaccagttctgccgtgcgatggggcctcctgtggataccagccgttctgtgtattttggacgaaggcggcagccgggtcccagccttgtcctgattgggcgacaagaatattcaaaattctgcgcctttttctaatttgtagatttcagtttccgtcgttcactttgagactttgaaattcctatttctcattttgttgataatttctgcatttaatggtctgtgctttaaatggtaacgctacggccccaggtcactgcgaggcacttaccatgtagatacgggctcaaaagtcacctctcagagacctacgtcatccactcaggaattcgcgcctctcatacttgcctgtctcattttatcttccttctagcagctgtctgaaattggttcgtctgttttcttgtttatggtattctcaagcccttgacagaccggctagtgtggttttcccgtgcatcttcagcctggcacattatggacacttaaatactacgtattgatctaatattgttgggttaatttttccatcccacccttttcttaatcgcttccgtggatggatgaagggtgctgttcatttccattagatgtatgtgaaggcacagtgaaaatggaaatgttcttggagctacttcctcaaaatgtatccttagtcacctcagtgcaacagctgggagggggccgtgttaagattttttttgctacaaagaggaggtggcaatggtagatccacccttatgcttgctcagtttagcataacctcttatggattttcatcaaattcagcgtgttggtcactggaaagagccttttccttctccttttcttactctcccctcatggtgttcccctcttaaaggaggaggagcttttaatttacacttaccacctcatttgcttttctggaggccatgcaatataggcgggactacagagttaatctcctttttacaaatgaggccaagagaagcctcattggttcacagtcatgcagctcatactgtccacccttgtattctcagatgcaggacaattgcattttagttttattttgtggaggtgcagaatatttactctttctgtccaacccttgattctgccgaggaagacactgatggtttgatgagtgattcagctgtttttggctaagggcttttggagctgatggcaggggtttgatgaatccaaatgagctctagacattatcacagactgaatagatcttaactgtctcctacatgtgtgttttcaaatgtgtatagatgctattgttattaataaagttaccaattaatttaa

SEQ ID NO: 924 - DNA, 312 bp, Homo sapiens
  ref <308>: DATABASE ACCESSION NUMBER: NM_003544
  ref <309>: DATABASE ENTRY DATE: 2001-06-18
atgtctggtcgcggcaaaggcggtaaaggtttgggtaagggaggtgccaagcgtcaccgaaaagtgctgcgggataacatccaaggcatcaccaaaccggccattcggcgccttgctaggcgtggtggggttaagcgaatttccggtttgatttatgaggagactcgtggcgttctcaaggtgtttctggagaacgtgatccgggacgccgtgacctacacggagcacgccaagcgcaagactgtcactgccatggatgtggtttacgcgctcaagcgtcaaggacgcactctgtacggcttcggcggttaa

SEQ ID NO: 925 - DNA, 1020 bp, Homo sapiens
  ref <308>: DATABASE ACCESSION NUMBER: NM_003561
  ref <309>: DATABASE ENTRY DATE: 2001-06-18
ggccttccaaagtgctgggattacaggcgtgagtcaccgcgcccggccaaataaaataaaatgttaaagcaaattcaggactacccctcctccaagtcttctgttccctttgggcgcccaggtgagcgggggaggggctgggggagtaataacatcaaaagagcgccttttcctcccttattccgaggagacttccctgggcctgactcccggtcctgtccccagcgccccgcggcctctggagccccttcagtgaccaagatacagagatcaggacgcctttgcgccgccccaggtgcccgcccctagctggctctgcttgggccgcgagggaaggtgaggtcgggggcggagccggggcgtgacagccggggtgtgtgtccgccgggcttggtgcctccggtggccctgcagcaccgtcccacctctgccaccctccgatggggccgctacctgtgtgcctgccaatcatgctgctcctgctactgccgtcgctgctgctgctgctgcttctacctggccccgggtccggcgaggcctccaggatattacgtgtgcaccggcgtgggatcctggaactggcaggaactgtgggttgtgttggtccccgaacccccatcgcctatatgaaatatggttgcttttgtggcttgggaggccatggccagccccgcgatgccattgactggtgctgccatggccacgactgttgttacactcgagctgaggaggccggctgcagccccaagacagagcgctactcctggcagtgcgtcaatcagagcgtcctgtgcggaccggcagagaacaaatgccaagaactgttgtgcaagtgtgaccaggagattgctaactgcttagcccaaactgagtacaacttaaagtacctcttctacccccagttcctatgtgagccggactcgcccaagtgtgactgactaccttgacttgaaatgctcttttgcacaaggaaataaagcgtcctctcagtaatgaaaaaaaaaaaaaaaaaaaaaaaaa

SEQ ID NO: 926 - DNA, 1642 bp, Homo sapiens
  ref <308>: DATABASE ACCESSION NUMBER: NM_003563
  ref <309>: DATABASE ENTRY DATE: 2001-06-18
gaatcggcggtcccgcaggtcccggatgttgcggacagtatgaggcaagcgcagggggacggggaccagcagctgtcgccgccgctctcagggtgaagagggaacagaaatctttgccccctgactttggaaatctcgtttaaccttcaaactggcgatgtcaagggttccaagtcctccacctccggcagaaatgtcgagtggccccgtagctgagagttggtgctacacacagatcaaggtagtgaaattctcctacatgtggaccatcaataactttagcttttgccgggaggaaatgggtgaagtcattaaaagttctacattttcatcaggagcaaatgataaactgaaatggtgtttgcgagtaaaccccaaagggttagatgaagaaagcaaagattacctgtcactttacctgttactggtcagctgtccaaagagtgaagttcgggcaaaattcaaattctccatcctgaatgccaagggagaagaaaccaaagctatggagagtcaacgggcatataggtttgtgcaaggcaaagactggggattcaagaaattcatccgtagagattttcttttggatgaggccaacgggcttctccctgatgacaagcttaccctcttctgcgaggtgagtgttgtgcaagattctgtcaacatttctggccagaataccatgaacatggtaaaggttcctgagtgccggctggcagatgagttaggaggactgtgggagaattcccggttcacagactgctgcttgtgtgttgccggccaggaattccaggctcacaaggctatcttagcagctcgttctccggtttttagtgccatgtttgaacatgaaatggaggagagcaaaaagaatcgagttgaaatcaatgatgtggagcctgaagtttttaaggaaatgatgtgcttcatttacacggggaaggctccaaacctcgacaaaatggctgatgatttgctggcagctgctgacaagtatgccctggagcgcttaaaggtcatgtgtgaggatgccctctgcagtaacctgtccgtggagaacgctgcagaaattctcatcctggccgacctccacagtgcagatcagttgaaaactcaggcagtggatttcatcaactatcatgcttcggatgtcttggagacctctgggtggaagtcaatggtggtgtcacatccccacttggtggctgaggcataccgctctctggcttcagcacagtgcccttttctgggacccccacgcaaacgcctgaagcaatcctaagatcctgcttgttgtaagactccgtttaatttccagaagcagcagccactgttgctgccactgaccaccaggtagacagcgcaatctgtggagcttttactctgttgtgaggggaagagactgcattgtggccccagacttttaaaacagcactaaataacttgggggaaacggggggagggaaaatgaaatgaaaaccctgttgctgcgtcactgtgttccctttggcctgtctgagtttgatactgtggggattcagtttaggcgctggcccgaggatatcccagcggtggtacttcggagacacctgtctgcatctgactgagcagaacaaatcgtcaggtgcctggagcaaaaagg

SEQ ID NO: 927 - DNA, 1772 bp, Homo sapiens
  ref <308>: DATABASE ACCESSION NUMBER: NM_003568
  ref <309>: DATABASE ENTRY DATE: 2001-06-18
cgctgagaggctgagtggagttcactcacatggattgaggcccagttcctgggagaagagatgctgggcaggaaggtgtctgcatgtgggactctgtacagcccggtcctctcccacatctgggaggggccagagtcagacaactgctgggttcgtccctaagagaggtcatctgactggctgttcagcctaggctgcacacacccccactttcctctaccaggccacaccggagcagtgctcacacaggcaatctaccaggccacaacaacgacacccacctcacctctggcacctctgagcatccacgtacttgcaagaactcttgctcacatcagctaagagattgcacctgctgacctagagattccggcctgtgctcctgtgctgctgagcagggcaaccagtagcaccatgtctgtgactggcggggaagatggcaccgtccctcacccaggagatcctcagccacctgggcctggccagcaagactgcagcgtgggggaccctgggcaccctcaggaccttcttgaacttcagcgtggacaaggatgcgcagaggctactgagggccattactggccaaggcgtggaccgcagtgccattgtggacgtgctgaccaaccggagcagagagcaaaggcagctcatctcacgaaacttccaggagcgcacccaacaggacctgatgaagtctctacaggcagcactttccggcaacctggagaggattgtgatggctctgctgcagcccacagcccagtttgacgcccaggaattgaggacagctctgaaggcctcagattctgctgtggacgtggccattgaaattcttgccactcgaaccccaccccagctgcaggagtgcctggcagtctacaaacacaatttccaggtggaggctgtggatggcatcacatctgagaccagtggcatcttgcaggacctgctgttggccctggccaaggggggccgtgacagctactctggaatcattgactataatctggcagaacaagatgtccaggcactgcagcgggcagaaggacctagcagagaggaaacatgggtcccagtcttcacccagcgaaatcctgaacacctcatccgagtgtttgatcagtaccagcggagcactgggcaagagctggaggaggctgtccagaaccgtttccatggagatgctcaggtggctctgctcggcctagcttcggtgatcaagaacacaccgctgtactttgctgacaaacttcatcaagccctccaggaaactgagcccaattaccaagtcctgattcgcatccttatctctcgatgtgagactgaccttctgagtatcagagctgagttcaggaagaaatttgggaagtccctctactcttctctccaggatgcagtgaaaggggattgccagtcagccctcctggccttgtgcagggctgaagacatgtgagacttccctgccccaccccacatgacatccgaggatctgagatttccgtgtttggctgaacctgggagaccagctgggcctccaagtaggataacccctcactgagcaccacattctctagcttcttgttgaggctggaactgtttctttaaaatcccttaattttcccatctcaaaattatatctgtacctgggtcatccagctccttcttgggtgtggggaaatgagttttctttgatagtttctgcctcactcatccctcctgtaccctggccagaacatctcactgatactcgaattcttttggcaaaaaaaaaa

SEQ ID NO: 928 - DNA, 2607 bp, Homo sapiens
  ref <308>: DATABASE ACCESSION NUMBER: NM_003579
  ref <309>: DATABASE ENTRY DATE: 2001-06-18
gaattcgggcagattagaccctggtcctacactcttagccgctgcctgcttttgacctttggctcatgggtacttgacgttttaaactcctaggcccaggatgaggaggagcttggctcccagccagctggccaagagaaaacctgaaggcaggtcctgtgatgatgaagactggcaacctggcctagtgactcctaggaaacggaaatccagcagtgagacccagatccaggagtgtttcctgtctccttttcggaaacctttgagtcagctaaccaatcaaccaccttgtctggacagcagtcagcatgaagcatttattcgaagcattttgtcaaagcctttcaaagtccccattccaaattatcaaggtcctctgggctctcgagcattgggcctgaaaagggctggggtccgccgggccctccatgaccccctggaaaaagatgccttggttctgtatgagcctcccccgctgagcgctcatgaccagctgaagcttgacaaggagaaactccctgtccatgtggttgttgaccctattctcagtaaggttttgcggcctcatcagagagagggagtgaaattcctgtgggagtgtgtcaccagtcggcgcatccctggcagccatggctgcatcatggctgatgagatgggcctaggaaagacgctgcagtgcatcacattgatgtggacacttttacgccagagtccagagtgcaagccagaaattgacaaggcagtggtggtgtcgccttccagcctggtgaagaactggtacaatgaggttgggaaatggctcggagggaggatccaacctctggccatcgatggaggatctaaggatgaaatagaccaaaagctggaaggattcatgaaccagcgtggagccagggtgtcttctcccatcctcatcatttcctatgagaccttccgccttcatgttggagtcctccagaaaggaagtgttggtctggtcatatgtgacgagggacacaggctcaagaactctgagaatcagacttaccaagccctggacagcttgaacaccagccggcgggtgctcatctccggaactcccatccagaatgatctgcttgagtatttcagcttggtacattttgttaattccggcatcctagggactgcccatgaattcaagaagcattttgaattgccaattttgaagggtcgagacgctgctgctagtgaggcagacaggcagctaggagaggagcggctgcgggagctcaccagcattgtgaatagatgcctgatacggaggacttctgatatcctttctaaatatctgcctgtgaagattgagcaggtcgtttgttgtaggctgacaccccttcagactgagttatacaagaggtttctgagacaagccaaaccggcagaagaattgcttgagggcaagatgagtgtgtcttccctttcttccatcacctcgctaaagaagctttgtaatcatccagctctaatctatgataagtgtgtggaagaggaggatggctttgtgggtgccttggacctcttccctcctggttacagctctaaggccctggagccccagctgtcaggtaagatgctggtcctggattatattctggcggtgacccgaagccgtagcagtgacaaagtagtgctggtgtcgaattacacccagactttggatctctttgagaagctgtgccgtgcccgaaggtacttatacgtccgcctggatggcacgatgtccattaagaagcgagccaaggttgtagaacgcttcaatagtccatcgagccctgactttgtcttcatgctgagcagcaaagctgggggctgtggcctcaatctcattggggctaaccggctggtcatgtttgaccctgactggaacccagccaatgatgaacaagccatggcccgggtctggcgagatggtcaaaagaagacttgctatatctaccgcctgctgtctgcagggaccattgaggagaagatcttccagcgtcagagccacaagaaggcactgagcagctgtgtggtggatgaggagcaggatgtagagcgccacttctctctgggcgagttgaaggagctgtttatcctggatgaagctagcctcagtgacacacatgacaggttgcactgccgacgttgtgtcaacagccgtcagatccggccaccccctgatggttctgactgcacttcagacctggcagggtggaaccactgcactgataagtgggggctccgggatgaggtactccaggctgcctgggatgctgcctccactgctatcaccttcgtcttccaccagcattctcatgaggaacagcggggcctccgctgataaccagctggtctgggtgtagctcttagaggaaggagatagggaaaaggggctccttgctccacagggccctgttgaattttgttctctgggagaaaatcatcaagaagggctgcatgatgtttgcccaaaatttattttataagaaaaacttttttggttaaaaaaaagaataaaggtatgaaagggctggtgacagtcagggatgcccccggcacacagggactaggtctagtgagaacatcaggagcagccagggatcc

SEQ ID NO: 929 - DNA, 2253 bp, Homo sapiens
  ref <308>: DATABASE ACCESSION NUMBER: NM_003600
  ref <309>: DATABASE ENTRY DATE: 2001-06-18
ggaagacttgggtccttgggtcgcaggtgggagccgacgggtgggtagaccgtgggggatatctcagtggcggacgaggacggcggggacaaggggcggctggtcggagtggcggagcgtcaagtcccctgtcggttcctccgtccctgagtgtccttggcgctgccttgtgcccgcccagcgcctttgcatccgctcctgggcaccgaggcgccctgtaggatactgcttgttacttattacagctagaggcatcatggaccgatctaaagaaaactgcatttcaggacctgttaaggctacagctccagttggaggtccaaaacgtgttctcgtgactcagcaaattccttgtcagaatccattacctgtaaatagtggccaggctcagcgggtcttgtgtccttcaaattcttcccagcgcgttcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcggcacctgaaaataatcctgaggaggaactggcatcaaaacagaaaaatgaagaatcaaaaaagaggcagtgggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctacttatataacagaattggcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatatttgttttactcagcaggtgtgccttaacctccctattcagaaagctccacatcaataaacatgacactctgaagtgaaagtagccacgagaattgtgctacttatactggttcataatctggaggcaaggttcgactgcagccgccccgtcagcctgtgctaggcatggtgtcttcacaggaggcaaatccagagcctggctgtggggaaagtgaccactctgccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgcaaataaataagtatctatgtctaaaaaaaaaaaaaaaa

SEQ ID NO: 930 - DNA, 2785 bp, Homo sapiens
  ref <308>: DATABASE ACCESSION NUMBER: NM_003607
  ref <309>: DATABASE ENTRY DATE: 2001-06-18
tccgcaagcctccgcctctgtgcgcgggactggaggagcctcgctgagcccagggcgcgacggcgagaggagagggaaggcgggggagggctggaagggagaggaagggagtggttgggagccgggctgccgcagcctctagtctcctcagccgcggaagcacccctcctcctgcgccgcggccgcctccctcctcgctgtggaaagatgcccttagcccaggggtgtgaagaagggggagaagtagctgccagagccgcccgcgccgccgccgcagctgctgctcgttgtgtcctttgaattcagagaagcacccccccgcctggggcgtcgggagcctccgggcggcggccgcggtgcggtgtcggggagaccgggctctctgcccgcgcggcgcggcgcggctcggcccacgagcgaccaccgacatggagtgggctcgggcggccaagtagccgcttctccggagccggtgccagtgccgcccgcagcccgccttccacccccggccgcgccgccggtcaggccctagggtgaagccgggaggaaaatgaagagttttcacccggaatccgttgaaaataggactgactgcaaagccttaaagaaagaaggacctcgggaggagaaacgaaaagccgcctccgggcaagacttggcgtgctccgagccgaggggctgcttcagggacctcgccccctccctttcccgctggagaaattgccgctgatgcattatccaagtggtggttgggaggatttgcagcaacatttttggttttccctcccccttctatgcattctgtttttttcctcccttttctgtttttcttcttcccgggaagtgaattgctgatgcaaatcggactttattcattaatgatgcaaccggattcgtttcaggattacgttgcacgagttgaattttgaatgaaggagaagagtttttttttttttttaaagaagtgttgactctctagttcgttgtacttttaattattattttatttaaatatacgacttaattgtattcttttaaaaatgcattaagtatatattttatggtaatttaccctcaaaatatatgtatatgggtgaaattgaagacgccttcagttaagtgaggttactggtgtgttggatgtttaattcagcaccagcattgcatgacagttgtttgaataacaagtggtttatttttaaaaccataccttttaaaatttaggttcagataatagtaaaagtcatcataataatttaaaggaaaaccagcagaaatcgaagcaaacatgtctggagaagtgcgtttgaggcagttggagcagtttattttggacgggcccgctcagaccaatgggcagtacttcagtgtggagacattactggatatactcatctgcctttatgatgaatgcaataattctccattgagaagagagaagaacattctcgaatacctagaatgggctaaaccatttacttctaaagtgaaacaaatgcgattacatagagaagactttgaaatattaaaggtgattggtcgaggagcttttggggaggttgctgtagtaaaactaaaaaatgcagataaagtgtttgccatgaaaatattgaataaatgggaaatgctgaaaagagctgagacagcatgttttcgtgaagaaagggatgtattagtgaatggagacaataaatggattacaaccttgcactatgctttccaggatgacaataacttatacctggttatggattattatgttggtggggatttgcttactctactcagcaaatttgaagatagattgcctgaagatatggctagattttacttggctgagatggtgatagcaattgactcagttcatcagctacattatgtacacagagacattaaacctgacaatatactgatggatatgaatggacatattcggttagcagattttggttcttgtctgaagctgatggaagatggaacggttcagtcctcagtggctgtaggaactccagattatatctctcctgaaatccttcaagccatggaagatggaaaagggagatatggacctgaatgtgactggtggtctttgggggtctgtatgtatgaaatgctttacggagaaacaccattttatgcagaatcgctggtggagacatacggaaaaatcatgaaccacaaagagaggtttcagtttccagcccaagtgactgatgtgtctgaaaatgctaaggatcttattcgaaggctcatttgtagcagagaacatcgacttggtcaaaatggaatagaagactttaagaaacacccatttttcagtggaattgattgggataatattcggaactgtgaagcaccttatattccagaagttagtagcccaacagatacatcgaattttgatgtagatgatgattgtttaaaaaattctgaaacgatgcccccaccaacacatactgcattttctggccaccatctgccatttgttggttttacatatactagtagctgtgtactttctgatcggagctgtttaagagttacggctggtcccacctcactggatcttgatgttaatgttcagaggactctagacaacaacttagcaactgaagcttatgaaagaagaattaagcgccttgagcaagaaaaacttgaactcagtagaaaacttcaagagtcaacacagactgtccaagctctgcagtattcaactgttgatggtccactaacagcaagcaaagatttagaaataaaaaacttaaaagaagaaatttgaaaaaaa

SEQ ID NO: 931 - DNA, 3238 bp, Homo sapiens
  ref <308>: DATABASE ACCESSION NUMBER: NM_003615
  ref <309>: DATABASE ENTRY DATE: 2001-06-18
ccttggagactagaaagaaactgctagatggctgtaacacagttcatccatttccgtgaagagatcatggggaatatgttcttcatcatcatcttcagtaccaaggataaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtgggttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccggataaaattatttggaatgcctgctaagcatcagcctgatttgatatacctccggtatgtgccgctctggaaggtccatattttcacagtcattcagcttacttgcttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagacgatgatgatactgtgcaccttccatttgaagggggaagtctcttgcaaattccagtcaaggccctaaaatatagtggtgatccctcaattggtaacatatcagatgaaatggccaaaactgcacagtggaaggcactttccatgaatactgagaatgccaaagtaaccagatctaacatgagtcctgataaacctgtgagtgtgaaataagtttgagatgaaccaagaaagaaatacgtggagctgaaacttcatatagaatggaaccaagaggcatatacatatagatatatacatatgtaagggtgcgatcatggcactatatatagaatatggaggcaaggcgggtaaggggggactaacc

SEQ ID NO: 932 - DNA, 2326 bp, Homo sapiens
  ref <308>: DATABASE ACCESSION NUMBER: NM_003627
  ref <309>: DATABASE ENTRY DATE: 2001-06-18
ccggggctggaggggggcaagcgggttccgaggtgcaaagcctggtgccccgagccctgcggagctcggggccagcatggcccccacgctgcaacaggcgtaccggaggcgctggtggatggcctgcacggctgtgctggagaacctcttcttctctgctgtactcctgggctggggctccctgttgatcattctgaagaacgagggcttctattccagcacgtgcccagctgagagcagcaccaacaccacccaggatgagcagcgcaggtggccaggctgtgaccagcaggacgagatgctcaacctgggcttcaccattggttccttcgtgctcagcgccaccaccctgccactggggatcctcatggaccgctttggcccccgacccgtgcggctggttggcagtgcctgcttcactgcgtcctgcaccctcatggccctggcctcccgggacgtggaagctctgtctccgttgatattcctggcgctgtccctgaatggctttggtggcatctgcctaacgttcacttcactcacgctgcccaacatgtttgggaacctgcgctccacgttaatggccctcatgattggctcttacgcctcttctgccattacgttcccaggaatcaagctgatctacgatgccggtgtggccttcgtggtcatcatgttcacctggtctggcctggcctgccttatctttctgaactgcaccctcaactggcccatcgaagcctttcctgcccctgaggaagtcaattacacgaagaagatcaagctgagtgggctggccctggaccacaaggtgacaggtgacctcttctacacccatgtgaccaccatgggccagaggctcagccagaaggcccccagcctggaggacggttcggatgccttcatgtcaccccaggatgttcggggcacctcagaaaaccttcctgagaggtctgtccccttacgcaagagcctctgctcccccactttcctgtggagcctcctcaccatgggcatgacccagctgcggatcatcttctacatggctgctgtgaacaagatgctggagtaccttgtgactggtggccaggagcatgagacaaatgaacagcaacaaaaggtggcagagacagttgggttctactcctccgtcttcggggccatgcagctgttgtgccttctcacctgccccctcattggctacatcatggactggcggatcaaggactgcgtggacgccccaactcagggcactgtcctcggagatgccagggacggggttgctaccaaatccatcagaccacgctactgcaagatccaaaagctcaccaatgccatcagtgccttcaccctgaccaacctgctgcttgtgggttttggcatcacctgtctcatcaacaacttacacctccagtttgtgacctttgtcctgcacaccattgttcgaggtttcttccactcagcctgtgggagtctctatgctgcagtgttcccatccaaccactttgggacgctgacaggcctgcagtccctcatcagtgctgtgttcgccttgcttcagcagccacttttcatggcgatggtgggacccctgaaaggagagcccttctgggtgaatctgggcctcctgctattctcactcctgggattcctgttgccttcctacctcttctattaccgtgcccggctccagcaggagtacgccgccaatgggatgggcccactgaaggtgcttagcggctctgaggtgaccgcatagacttctcagaccaagggacctggatgacaggcaatcaaggcctgagcaaccaaaaggagtgccccatatggcttttctacctgtaacatgcacatagagccatggccgtagatttataaataccaagagaagttctatttttgtaaagactgcaaaaaggaggaaaaaaaaccttcaaaaacgccccctaagtcaacgctccattgactgaagacagtccctatcctagaggggttgagctttcttcctccttgggttggaggagaccagggtgcctcttatctccttctagcggtctgcctcctggtacctcttggggggatcggcaaacaggctacccctgaggtcccatgtgccatgagtgtgcacaacatgcaatgtgtctgtgtatgtgtgaatgtgagaaaaacacagccctcctttcagaaggaaaggggcctgaggtgccagctgtgtcctgggttaggggttgggggtcggccccttccagggccaggaaggcaggttccctctctggtgctgctgcttgcaagtcttagaggaaataaaaagggaagtgagaaaaaaaaa

SEQ ID NO: 933 - DNA, 4827 bp, Homo sapiens
  ref <308>: DATABASE ACCESSION NUMBER: NM_003633
  ref <309>: DATABASE ENTRY DATE: 2001-06-18
gcggtggcgctgcggagacccggtccagacgcctggcggccgccggcacacaaggcgctttctagctccctcccccgagcgcacagcccgcctccttccgcggcgcctgcagtggcaggcttgctctgccctaccgtgacgcgctccggagacgctctgcgggtcctggacaccgggtccgcggcgtggggacgacagacggaggcgaacgccatcggtagccggtccgcgagccatcgttcggggcgcagtcctctccccggctggccctcctttctccggggcattcgccaccgcttccctgggctgagacgaccggttcgtcgcctccttgcccgtgaccgtcgctagaactcagttgtgcgttgcggccagtcgccactgctgagtggaagcaaaatgtcagtcagtgtgcatgagaaccgcaagtccagggccagcagcggctccattaacatctatctgtttcacaagtcctcctacgctgacagcgtcctcactcacctgaatcttttacgccagcagcgtctcttcactgacgtccttctccatgccggaaataggaccttcccttgccaccgggcagtgctggctgcatgcagtcgctactttgaggccatgttcagtggtggcctgaaagagagccaggacagtgaggtcaactttgacaattccatccacccagaagtcttggagctgctgcttgactatgcgtactcctcccgggtcatcatcaatgaagaaaatgcagaatcgctcctggaagctggtgacatgctggagtttcaagacatccgggatgcatgtgcagagttcctggaaaagaacctgcatcccaccaactgcctgggcatgctgctgctgtctgatgcacaccagtgcaccaagctgtacgaactatcttggagaatgtgtctcagcaacttccaaaccatcaggaagaatgaagatttcctccagctgccccaggacatggtagtgcaactcttgtccagtgaagagctggagacagaggatgaaaggcttgtgtacgagtctgcaattaactggatcagctatgacctgaagaagcgctattgctacctcccagaactgttgcagacagtaaggctggcacttctgccagccatctatctcatggagaatgtggccatggaggaactcatcaccaagcagagaaagagtaaggaaattgtggaagaggccatcaggtgcaaactgaaaatcctgcagaatgacggtgtggtaaccagcctctgtgcccgacctcggaaaactggccatgccctcttccttctgggaggacagactttcatgtgtgacaagttgtatctggtagaccagaaggccaaagaaatcattcccaaggctgacattcccagcccaagaaaagagtttagtgcatgtgcgattggctgcaaagtgtacattactggggggcgggggtctgaaaatggggtctcgaaagatgtctgggtttatgataccctgcacgaggagtggtccaaggctgcccccatgctggtggccaggtttggccatggctctgctgaactgaagcactgcctgtatgtggttggggggcacacggccgcaactggctgcctcccggcctccccctcagtctctctaaagcaggtagaacattatgaccccacaatcaacaaatggaccatggtggccccactccgagaaggcgttagcaacgccgcagtagtgagtgccaaacttaagttatttgctttcggaggtaccagtgtcagtcatgacaagctccccaaagttcagtgttacgatcagtgtgaaaacaggtggactgtaccggccacctgtccccagccctggcgttacacagcagcagctgtgctggggaaccagatttttattatggggggtgatacagaattctctgcctgctctgcttataaattcaacagtgagacttaccagtggaccaaagtgggagatgtgacagcaaagcgcatgagctgccatgctgtggcctctggaaacaaactctacgtggttggaggatactttggcattcagcgatgcaagactttggactgctacgatccaacattagacgtgtggaacagcatcaccactgtcccgtactcgctgattcctactgcatttgtcagcacctggaaacatctgccttcttaaatgcagtacattctaaagagagtgagcatgagctcactccatcactcgatgagataatatgagatttctacttcggagaggccaagtctaatgaagagaaaaaaaggaaaagaagttgcaagactcgaataaaatctgctgcaccttgtaaatgctctaactggacatgaaggaaaggggcgagggaggggggtgggatttttggtgcaagtagcacatggtttaaatatgaatgaacaaacctgtgatctagtccttgtcttgtaattgtggattaatgtcaatgttaatcagcccctcaaagggagagaaaagctggaccttttcccttgctgtaccatattcagcatttgatttccatgggccccaccatttatgtgtagaatttgaaatggttgtcacctctctctgaggacagagcttgaagcctccacaccagctgctgctggagattcaaagcccaactgtgggtccgagagggaagctggctgggctggctgaagaatgaagaccactggactctccgttaatctctaaggggtctgctccccaggaacgtttctgaacaatggggactttgttggtagccatttggtagatgttcttttctatttataagtgactttaaactttcccttggctgttaagaagtttgttatagatttagctatttattgttcgatgcctgcatgctgaaacaatgcctacagctgtcttcacatgtatggacgtgtgtgaatggttgtacgttttgcacattttgtggctgttgagatgtgctttgctgcacaaacatgaaaatttttgagttacaatttggagcataactggagggtgggctggggaggggtggatttttaaaatgtcaagacagggaaggatgacaaaatggaaatttaaatgacatcctagaggtagagaaaccgtggagatcgcttttctcagactcaccaacttttaatgggatttcatggggtttggttgtgctgatagggtaaggggaggctgctttctgcccttctccccactcccatctgatttacttaattcagtctcagctgctgaaatttggaaaggaccaaattgctttacagtttttttctttgtgtagtatcttgaaatcctggaaaattctatggaatagttctgtatatagggcacaagtaaaggcattgtccaaagtttatttatttatttattaccctaagaatgctttgccataaccacatttaatgggaaaaacggcatgtatcacagatgtaaattaactcaccagatttactgggcctgaactcattctcttcttgctatatgatttagcaagttctagaaggtctccaagacaataattacattggcacaatgtatacttcagtgctcacccgtagcaaatctctttttaaaaaactctttggtgcacaagtaacacatttggccacaaaacaccaaagaattgtaggcagtggcccctattgagaagttttccggtagagttggaaatcagttgtgaatacattctttgctagttggagtgcttgtttactaagcatgtgccgtcgtaggtattagtgctagtctcaaataggtgcttcccctgaggtgcaggggaagaccaaagtttgcaactcgaactgctttcgtccatgtttctcacattgctgtattttagaaaataggggttaagactgataacaaccttttacattgtgactgtgtttgcattgtctaatgacagataaatccttaacatttctctccaccttagtactttagactaattgtgtttgtccgtccatgccatgaatgagtgggctgtagttgggcctaaataaatgagctgttggaagaaaagaatcacagtactttccagcagtcagtccctggttcctagatgtgttctaagcaatgcaaatgtctaattgtcccccagtgggcatagtcagtgtcgtttatattgtagcagttacagctctgtagtttatgatgcaaatctgccaagagagatgtatgtgtcactgcatggcttctgaaagcaggatgaattttctgcagctgtttcaaagttggggtctgttcttgaatcctctattaattactgtgtgtgagccagagggagctgtggtaagggttgggcccccagcctgtagggaactttctggactcccactctttgaatcgatataggcatttggtctcactacttgaccattctcaccctgtgaaacgtcccacactttgaagcaaatacaattcacagcacagtacacacaaaaaccttggcataagacagagaaggttcttcttattttgtgggctggttgctgtagaaacatataacaaagggcagccctccacttctggtataattgtgtagccccttttctttgggcttgacacctgtcttgaataagagtgattagagctgcataatgtccctctcttggctattgaccatgtggttcacgtacaaaactctgtataagttgaaggaaaatgttcatgttcatatgtacttgtttgctatgactacattttgaggttttgtaaaactgttatttttttttttttcacaatgtgaaactgaaggtcaataaattattagagattttctcttcaaaaaaaaaaaaaaaaaaaaaaaaaaaaaaaaaaaaaaaaaaa

SEQ ID NO: 934 - DNA, 647 bp, Homo sapiens
  ref <308>: DATABASE ACCESSION NUMBER: NM_003641
  ref <309>: DATABASE ENTRY DATE: 2001-06-18
gctcactgagcaccgtcccagcatccggacaccacagcggcccttcgctccacgcagaaaaccacacttctcataccttcactcaacacttccttccccaaagccagaagatgcacaaggaggaacatgaggtggctgtgctgggggcaccccccagcaccatccttccaaggtccaccgtgattaacatccacagcgagacctccgtgcccgaccatgtcgtctggtccctgttcaacaccctcttcttgaactggtgctgtctgggcttcatagcattcgcctactccgtaaagtctagggacaggaagatggttggcgacgtgaccggggcccaggcctatgcctccaccgccaagtgcctgaacatctgggccctgattctgggcatcctcatgaccattggattcatcctgttactggtattcggctctgtaacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtga

SEQ ID NO: 935 - DNA, 2362 bp, Homo sapiens
  ref <308>: DATABASE ACCESSION NUMBER: NM_003645
  ref <309>: DATABASE ENTRY DATE: 2001-06-18
ggaattccaaaaaaaaaaaatacgactacacctgctccggagcccgcggcggtacctgcagcggaggagctctgtcttccccttcatctcacgcgagcccggcgtcccgccgcgtgcgccccggcgcagcccgccagtccgcccggagcccgcccagtcgccgcgctgcacgcccggggtgaaccctctgccctcgctgggacagagggccccgcagccgtcatgctttccgccatctacacagtcctggcgggactgctgttcctgccgctcctggtgaacctctgctgcccatacttcttccaggacataggctacttcttgaaggtggccgccgtgggccggagggtgcgcagctacgggcagcggcggccggcgcgcaccatcctgcgggcgttcctggagaaagcgcgccagacgccacacaagccttttctgctcttccgcgacgagactctcacctacgcgcaggtggaccggcgcagcaatcaagtggcccgggcgctgcacgaccacctcggcctgcgccagggagactgcgtggcgctccttatgggtaacgagccggcctacgtgtggctgtggctggggctggtgaagctgggctgtgccatggcgtgcctcaattacaacatccgcgcgaagtccctgctgcactgcttccagtgctgcggggcgaaggtgctgctggtgtcgccagaactacaagcagctgtcgaagagatactgccaagccttaaaaaagatgatgtgtccatctattatgtgagcagaacttctaacacagatgggattgactctttcctggacaaagtggatgaagtatcaactgaacctatcccagagtcatggaggtctgaagtcactttttccactcctgccttatacatttatacttctggaaccacaggtcttccaaaagcagccatgatcactcatcagcgcatatggtatggaactggcctcacttttgtaagcggattgaaggcagatgatgtcatctatatcactctgcccttttaccacagtgctgcactactgattggcattcacggatgtattgtggctggtgctactcttgccttgcggactaaattttcagccagccagttttgggatgactgcagaaaatacaacgtcactgtcattcagtatatcggtgaactgcttcggtatttatgcaactcaccacagaaaccaaatgaccgtgatcataaagtgagactggcactgggaaatggcttacgaggagatgtgtggagacaatttgtcaagagatttggggacatatgcatctatgagttctatgctgccactgaaggcaatattggatttatgaattatgcgagaaaagttggtgctgttggaagagtaaactacctacagaaaaaaatcataacttatgacctgattaaatatgatgtggagaaagatgaacctgtccgagatgaaaatggatattgcgtcagagttcccaaaggtgaagttggacttctggtttgcaaaatcacacaacttacaccatttaatggctatgctggagcaaaggctcagacagagaagaaaaaactgagagatgtctttaagaaaggagacctctatttcaacagtggagatctcttaatggttgaccatgaaaatttcatctatttccacgacagagttggagatacattccggtggaaaggggaaaatgtggccaccactgaagttgctgatacagttggactggttgattttgtccaagaagtaaatgtttatggagtgcatgtgccagatcatgagggtcgcattggcatggcctccatcaaaatgaaagaaaaccatgaatttgatggaaagaaactctttcagcacattgctgattacctacctagttatgcaaggccccggtttctaagaatacaggacaccattgagatcactggaacttttaaacaccgcaaaatgaccctggtggaggagggctttaaccctgctgtcatcaaagatgccttgtatttcttggatgacacagcaaaaatgtatgtgcctatgactgaggacatctataatgccataagtgctaaaaccctgaaactctgaatattcccaggaggataactcaacatttccagaaagaaactgaatggacagccacttgatataatccaactttaatttgattgaagattgtgaggaaattttgtaggaaatttgcatacccgtaaagggagacttttttaaataacagttgagtctttgcaagtaaaaagatttagagattattatttttcagtgtgcacctactgtttgtatttgcaaactgagcttgttggagggaaggcattattttttaaaatacttagtaaattaaatgaac

SEQ ID NO: 936 - DNA, 1392 bp, Homo sapiens
  ref <308>: DATABASE ACCESSION NUMBER: NM_003651
  ref <309>: DATABASE ENTRY DATE: 2001-06-18
gaattccggcacgaagctcgagccgcctccgccgcgcgaccccacctcggccgccgccgcctgcgccgcgagatccgccccggcctccccgagagcgagccccggccgccgcgaccaccagccgcgctaaccgccgaccaaccgccaccgaggcgcctgagcgagagcagaggaggaggaggcatgagtgaggcgggcgaggccaccaccaccaccaccaccaccctcccgcaggctccgacggaggcggccgccgcggctccccaggaccccgcgcccaagagcccggtgggcagcggtgcgccccaggccgcggccccggcgcccgccgcccacgtcgcaggaaaccccggtggggacgcggcccccgcagccacgggcaccgcggccgccgcctctttagccaccgccgccggcagcgaagacgcggagaaaaaagttctcgccaccaaagtccttggcactgtcaaatggttcaacgtcagaaatggatatggatttataaatcgaaatgacaccaaagaagatgtatttgtacatcagactgccatcaagaagaataacccacggaaatatctgcgcagtgtaggagatggagaaactgtagagtttgatgtggttgaaggagagaagggtgcagaagctgccaatgtgactggcccggatggagttcctgtggaagggagtcgttacgctgcagatcggcgccgttacagacgtggctactatggaaggcgccgtggccctccccggaattacgctggggaggaggaggaggaagggagcggcagcagtgaaggatttgacccccctgccactgataggcagttctctggggcccggaatcagctgcgccgcccccagtatcgccctcagtaccggcagcggcggttcccgccttaccacgtgggacagacctttgaccgtcgctcacgggtcttaccccatcccaacagaatacaggctggtgagattggagagatgaaggatggagtcccagagggagcacaacttcagggaccggttcatcgaaatccaacttaccgcccaaggtaccgtagcaggggacctcctcgcccacgacctgccccagcagttggagaggctgaagataaagaaaatcagcaagccaccagtggtccaaaccagccgtctgttcgccgtggataccggcgtccctacaattaccggcgtcgcccgcgtcctcctaacgctccttcacaagatggcaaagaggccaaggcaggtgaagcaccaactgagaaccctgctccacccacccagcagagcagtgctgagtaacaccaggctcctcaggcaccttcaccatcggcaggtgacctaaagaattaatgaccattcagaaataaagcaaaaagcaggccggaattc

SEQ ID NO: 937 - DNA, 2813 bp, Homo sapiens
  ref <308>: DATABASE ACCESSION NUMBER: NM_003657
  ref <309>: DATABASE ENTRY DATE: 2001-06-18
ctccaccgacagccaggcactgggcagcacgcactggagacccaggaccctgtgcaggagcagctccgggtgacacgaggggactgaagatactcccacaggggctcagcaggagcaatgggtaaccaaatgagtgttccccaaagagttgaagaccaagagaatgaaccagaagcagagacttaccaggacaacgcgtctgctctgaacggggttccagtggtggtgtcgacccacacagttcagcacttagaggaagtcgacttgggaataagtgtcaagacggataatgtggccacttcttcccccgagacaacggagataagtgctgttgcggatgccaacggaaagaatcttgggaaagaggccaaacccgaggcaccagctgctaaatctcgttttttcttgatgctctctcggcctgtaccaggacgtaccggagaccaagccgcagattcatcccttggatcagtgaagcttgatgtcagctccaataaagctccagcgaacaaagacccaagtgagagctggacacttccggtggcagctggaccggggcaggacacagataaaaccccagggcacgccccggcccaagacaaggtcctctctgccgccagggatcccacgcttctcccacctgagacagggggagcaggaggagaagctccctccaagcccaaggactccagcttttttgacaaattcttcaagctggacaagggacaggaaaaggtgccaggtgacagccaacaggaagccaagagggcagagcatcaagacaaggtggatgaggttcctggcttatcagggcagtccgatgatgtccctgcagggaaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtttcacctaacaaagctgaaacaaaaaaggacccagaagacacgggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaagtcagttaaagaggactcagtccccacaggtgcggaggagaatgtggtgtgtgagtcaccagtagagattataaagtccaaggaagtagaatcagccttacaaacagtggacctcaacgaaggagatgctgcacctgaacccacagaagcgaaactcaaaagagaagaaagcaaaccaagaacctctctgatggcgtttctcagacaaatgtcagtgaaaggggatggagggatcacccactcagaagaaataaatgggaaagactccagctgccaaacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaacccaagtaaacaaatcagcacggttcccaccaggttctcctgccaccaagatgtgttctccttactccatctcctccccaaacacgctccatgtatatattcttctgatggccagcaaatgaaattctgcctagaaattaagcccgagctgttgtatattgaggtgtattatttacgtctctggtccagtcttttctggcaaataacagtaaagatggtttagcaggtcacctagttgggtcagaagagtcgatgatcaccaagcaggaaagggagggaatagaggaatgtgttcgggttaagtgatgaaaatggcagtggtggccgggcgtggtggctctcgcctgtaatctcagcactttgggaggccgaggcaggtggatcacctgaggtcaggagttcaagactagcctggccaacatcatgaaaccccgtctctactaaaaatacaaaaattagccaggcatggtggcacacacctgtagtcccagctactcgggagcccaacgcacgagaaccgcttgtacccaggaggtggaggttgcagtgagccgaagttgcaccattgcactccaccctgggcgacagagcaagattctatcaaaaaaaaaaggcagtggcaagtaagttatagaagagaaatgctgctagaaggaattaagcgttgtagtaaacgcgtgctcatcctctaagcttgaagaagggagacgaaaatccatttgtttaaattcacatctcaaggagggagaacccgggctgtgttgggtggttgccaatttcctagaacggaatgtgtggggtatagaaaaaggaatgaataagcgttgtttttcaaatagggtccttgtaagttattgatgagagggaaaagattgactggggagggcttaaaatgatttgggaaaacaattgcttttgaggctcagtgacaacggcaaagattacaactt

SEQ ID NO: 938 - DNA, 1318 bp, Homo sapiens
  ref <308>: DATABASE ACCESSION NUMBER: NM_003662
  ref <309>: DATABASE ENTRY DATE: 2001-06-18
ctcctctaggccgccggccgcgaagcgctgagtcacggtgaggcgactggacccacactctcttaacctgccctccctgcactcgctcccggcggctcttcgcgtcacccccgccgctaaggctccaggtgccgctaccgcagcgtgagtacctggggctcctgcaggggtccactagccctccatcctctacagctcagcatcagaacactctctttttagactccgatatggggtcctccaagaaagttactctctcagtgctcagccgggagcagtcggaaggggttggagcgagggtccggagaagcattggcagacccgagttaaaaaatctggatccgtttttactgtttgatgaatttaaaggaggtagaccaggaggatttcctgatcatccacatcgaggttttgaaacagtatcctacctcctggaagggggcagcatggcccatgaagacttctgtggacacactggtaaaatgaacccaggagatttgcagtggatgactgcgggccggggcattctgcacgctgagatgccttgctcagaggagccagcccatggcctacaactgtgggttaatttgaggagctcagagaagatggtggagcctcagtaccaggaactgaaaagtgaagaaatccctaaacccagtaaggatggtgtgacagttgctgtcatttctggagaagccctgggaataaagtccaaggtttacactcgcacaccaaccttatatttggacttcaaattggacccaggagccaaacattcccaacctatccctaaagggtggacaagcttcatttacacgatatctggagatgtgtatattgggcccgatgatgcacaacaaaaaatagaacctcatcacacagcagtgcttggagaaggtgacagtgtccaggtggagaacaaggatcccaagagaagccactttgtcttaattgctggggagccattaagagaaccagttatccaacatggtccatttgtgatgaacaccaatgaagagatttctcaagctattcttgatttcagaaacgcaaaaaatgggtttgaaagggccaaaacctggaaatcaaagattgggaactagtggaaagcggaagagcaggtcttgatgtgtcctagaattttgccatttctgagattgagccattgaaggcattccatttctaaagcttatttagccggtgcttctaaagaattccacactaacgtgataacatggtttttgtaacaataaatgtaggatatttcctggcacatgcaaataaacctaatcattgtttctttaaaaaaaaaaaaaaa

SEQ ID NO: 939 - DNA, 2922 bp, Homo sapiens
  ref <308>: DATABASE ACCESSION NUMBER: NM_003670
  ref <309>: DATABASE ENTRY DATE: 2001-06-18
ggacaccgggccatgcacgcccccaactgaagctgcatctcaaagccgaagattccagcagcccaggggatttcaaagagctcagactcagaggaacatctgcggagagacccccgaagccctctccagggcagtcctcatccagacgctccgctagtgcagacaggagcgcgcagtggccccggctcgccgcgccatggagcggatccccagcgcgcaaccaccccccgcctgcctgcccaaagcaccgggactggagcacggagacctaccagggatgtaccctgcccacatgtaccaagtgtacaagtcaagacggggaataaagcggagcgaggacagcaaggagacctacaaattgccgcaccggctcatcgagaaaaagagacgtgaccggattaacgagtgcatcgcccagctgaaggatctcctacccgaacatctcaaacttacaactttgggtcacttggaaaaagcagtggttcttgaacttaccttgaagcatgtgaaagcactaacaaacctaattgatcagcagcagcagaaaatcattgccctgcagagtggtttacaagctggtgagctgtcagggagaaatgtcgaaacaggtcaagagatgttctgctcaggtttccagacatgtgcccgggaggtgcttcagtatctggccaagcacgagaacactcgggacctgaagtcttcgcagcttgtcacccacctccaccgggtggtctcggagctgctgcagggtggtacctccaggaagccatcagacccagctcccaaagtgatggacttcaaggaaaaacccagctctccggccaaaggttcggaaggtcctgggaaaaactgcgtgccagtcatccagcggactttcgctcactcgagtggggagcagagcggcagcgacacggacacagacagtggctatggaggagaatcggagaagggcgacttgcgcagtgagcagccgtgcttcaaaagtgaccacggacgcaggttcacgatgggagaaaggatcggcgcaattaagcaagagtccgaagaaccccccacaaaaaagaaccggatgcagctttcggatgatgaaggccatttcactagcagtgacctgatcagctccccgttcctgggcccacacccacaccagcctcctttctgcctgcccttctacctgatcccaccttcagcgactgcctacctgcccatgctggagaagtgctggtatcccacctcagtgccagtgctatacccaggcctcaacgcctctgccgcagccctctctagcttcatgaacccagacaagatctcggctcccttgctcatgccccagagactcccttctcccttgccagctcatccgtccgtcgactcttctgtcttgctccaagctctgaagccaatcccccctttaaacttagaaaccaaagactaaactctctaggggatcctgctgctttgctttccttcctcgctacttcctaaaaagcaacaaaaaagtttttgtgaatgctgcaagattgttgcattgtgtatactgagataatctgaggcatggagagcagattcagggtgtgtgtgtgtgtgtgtgtgtgtgtgtgtatgtgcgtgtgcgtgcacatgtgtgcctgcgtgttggtataggactttaaagctccttttggcatagggaagtcacgaaggattgcttgacatcaggagacttgggggggattgtagcagacgtctgggcttttccccacccagagaatagcccccttcgatacacatcagctggattttcaaaagcttcaaagtcttggtctgtgagtcactcttcagtttgggagctgggtctgtggctttgatcagaaggtactttcaaaagagggctttccagggctcagctcccaaccagctgttaggaccccacccttttgcctttattgtcgacgtgactcaccagacgtcggggagagagagcagtcagaccgagctttctgctaacatggggaggtagcaggcactggcatagcacggtagtggtttggggaggtttccgcaggtctgctccccacccctgcctcggaagaataaagagaatgtagttccctactcaggctttcgtagtgattagcttactaaggaactgaaaatgggccccttgtacaagctgagctgccccggagggagggaggagttccctgggcttctggcacctgtttctaggcctaaccattagtacttactgtgcagggaaccaaaccaaggtctgagaaatgcggacaccccgagcgagcaccccaaagtgcacaaagctgagtaaaaagctgcccccttcaaacagaactagactcagttttcaattccatcctaaaactccttttaaccaagcttagcttctcaaaggcctaaccaagccttggcaccgccagatcctttctgtaggctaattcctcttgcccaacggcatatggagtgtccttattgctaaaaaggattccgtctccttcaaagaagttttatttttggtccagagtacttgttttcccgatgtgtccagccagctccgcagcagcttttcaagatgcactatgcctgattgctgatcgtgttttaactttttcttttcctgtttttattttggtattaagtcgttgcctttatttgtaaagctgttataaatatatattatataaatatattaaaaaggaaaatgtttcagatgtttatttgtataattacttgattcacacagtgagaaaaaatgaatgtattcctgtttttgaagagaagaataatttttttttctctagggagaggtacagtgtttatattttggagccttcctgaaggtgtaaaattgtaaatatttttatctatgagtaaatgttaagtagttgttttaaaatacttaataaaataattcttttcctgtggaag

SEQ ID NO: 940 - DNA, 1450 bp, Homo sapiens
  ref <308>: DATABASE ACCESSION NUMBER: NM_003675
  ref <309>: DATABASE ENTRY DATE: 2001-06-18
cggccgccggcccagtgaggctgggttcgaggagctggagcgggaaactggagcttaaattctggcggcgagatggacattctgaaatcagagatccttcggaagcggcagctggtggaggacaggaacctgctggtggaaaataaaaaatatttcaagcgtagtgagctcgccaaaaaagaagaggaagcatattttgaaagatgtggctacaagatacagccaaaagaggaggaccagaaaccattaacttcatcgaatccagtgttagaacttgaactggcagaggaaaaattacctatgacgctttctaggcaagaggtcatcagaagattgagagaaagaggagaaccaatcagactatttggagagactgattatgatgcttttcaacgtttaaggaaaatagagatcctcacaccagaagttaacaagggattgaggaatgatttgaaagcagccttggataagattgatcagcagtacctcaatgaaatcgtcggcggtcaggagcctggagaggaagacacacagaatgatctgaaagttcatgaggaaaacaccacaattgaagagttagaggcgcttggagagtccttagggaaaggcgatgatcataaagacatggacatcatcaccaaattcctgaagtttcttcttggcgtttgggctaaagaattgaatgccagagaagattatgtgaaacgcagtgtgcagggtaaactgaacagtgcgacccagaaacagaccgagtcctacctaagaccactttttagaaagctacggaaaaggaatcttcctgctgatattaaagaatcaataacggatattattaaattcatgttgcagagagaatacgtgaaggcaaatgatgcttatcttcagatggccattggaaatgcgccttggcccatcggtgtcactatggttggtatccatgccagaactggcagagaaaagattttttccaagcatgttgcacatgttttaaatgacgaaactcagcggaaatatattcagggattgaagaggttaatgaccatttgccagaaacactttcctacagacccatccaaatgtgtggagtacaatgcactgtgagatctgtgtatggtgtgttaataacaataagaaacttagggaagcaggctgtggacttctggaattaccaacaggaatgaggaaagaagaaaactggagtttccagtctctgagttctacctgatgtaactcttgattggttttaagaactttgttggccttcatttcatatctgactgcaagctgatttttctttcttgctttcattttaattagtccaaaattaagttttaaagatttttcctcacaatttaaatccatagacaacagaagggggtttaaaatgacctttttttcagttgacccgaaagttgtggttagatgattaaaaagaaacatttgaaaaaaa

SEQ ID NO: 941 - DNA, 1375 bp, Homo sapiens
  Modified_base 1 ... 1375: n = a,c,g, or t
  ref <308>: DATABASE ACCESSION NUMBER: NM_003676
  ref <309>: DATABASE ENTRY DATE: 2001-06-18
gccgccgccacctctgagcagccggctgggagcgagagccgacagctagtctgcaagccaccgctgtcgccatggggagccgcgtctcgcgggaagacttcgagtgggtctacaccgaccagccgcacgccgaccggcgccgggagatcctggcaaagtatccagagataaagtccttgatgaaacctgatcccaatttgatatggattataattatgatggttctcacccagttgggtgcattttacatagtaaaagacttggactggaaatgggtcatatttggggcctatgcgtttggcagttgcattaaccactcaatgactctggctattcatgagattgcccacaatgctgcctttggcaactgcaaagcaatgtggaatcgctggtttggaatgtttgctaatcttcctattgggattccatattcaatttcctttaagaggtatcacatggatcatcatcggtaccttggagctgatggcgtcgatgtagatattcctaccgattttgagggctggttcttctgtaccgctttcagaaagtttatatgggttattcttcagcctctcttttatgcctttcgacctctgttcatcaaccccaaaccaattacgtatctggaagttatcaataccgtggcacaggtcacttttgacattttaatttattactttttgggaattaaatccttagtctacatgttggcagcatctttacttggcctgggtttgcacccaatttctggacattttatagctgagcattacatgttcttaaagggtcatgaaacttactcatattatgggcctctgaatttacttaccttcaatgtgggttatcataatgaacatcatgatttccccaacattcctggaaaaagtcttccactggtgaggaaaatagcagctgaatactatgacaacctccctcactacaattcctggataaaagtactgtatgattttgtgatggatgatacaataagtccctactcaagaatgaagaggcaccaaaaaggagagatggtgctggagtaaatatcattagtgccaaagggattcttctccaaaactttagatgataaaattagccgggcgtggcggcacatgcctgtaatcccagctacatgggaggctgaggtgggagaattgcttgaacccaggaggcggaggcagaggctgcagtgacccaagattgtgccactgcactccaccctgggcaacagagcaagaccccatcntcgagagatnagatgagatatatataaaaaataaaaagctatttctagtttatttcactataaagttttgctttattaaaaagctaataaacagctattaatcacaaaaaaaaaaaaaaaaaaaaaaaa

SEQ ID NO: 942 - DNA, 960 bp, Homo sapiens
  ref <308>: DATABASE ACCESSION NUMBER: NM_003681
  ref <309>: DATABASE ENTRY DATE: 2001-06-18
cccggcatggaggaggagtgccgggtgctctccatacagagccacgtcatccgcggctacgtgggcaaccgggcggccacgttcccgctgcaggttttgggatttgagattgacgcggtgaactctgtccagttttcaaaccacacaggctatgcccactggaagggccaagtgctgaattcagatgagctccaggagttgtacgaaggcctgaggctgaacaacatgaataaatatgactacgtgctcacaggttatacgagggacaagtcgttcctggccatggtggtggacattgtgcaggagctgaagcagcagaaccccaggctggtgtacgtgtgtgatccagtcttgggtgacaagtgggacggcgaaggctcgatgtacgtcccggaggacctccttcccgtctacaaagaaaaagtggtgccgcttgcagacattatcacgcccaaccagtttgaggccgagttactgagtggccggaagatccacagccaggaggaagccttgcgggtgatggacatgctgcactctatgggccccgacaccgtggtcatcaccagctccgacctgccctccccgcagggcagcaactacctgattgtgctggggagtcagaggaggaggaatcccgctggctccgtggtgatggaacgcatccggatggacattcgcaaagtggacgccgtctttgtgggcactggggacctgtttgctgccatgctcctggcgtggacacacaagcaccccaataacctcaaggtggcctgtgagaagaccgtgtctaccttgcaccacgttctgcagaggaccatccagtgtgcaaaagcccaggccggggaaggagtgaggcccagccccatgcagctggagctgcggatggtgcagagcaaaagggacatcgaggacccagagatcgtcgtccaggccacggtgctgtgagggccccgccgcttg

SEQ ID NO: 943 - DNA, 1771 bp, Homo sapiens
  ref <308>: DATABASE ACCESSION NUMBER: NM_003683
  ref <309>: DATABASE ENTRY DATE: 2001-06-18
ggcgactccgggaacagggggtctcggccgtcggcgtcatggtttcgcgcgtgcagctcccgcctgagatccagctggctcagcgcctggcggggaatgagcaggtgacccgggaccgggcggtgaggaagctccggaaatacatcgtcgccaggactcagcgggccgcaggtggttttacgcacgacgagctgctgaaggtgtggaaaggactgttttattgcatgtggatgcaggacaagccactcctccaggaagaattaggaaggactatttcccagctcgttcatgcttttcagaccacggaggcgcagcacctgttccttcaggccttctggcagaccatgaatcgcgagtggacgggcattgacaggctgcgcctggataaattctacatgctcatgcggatggtcctgaacgagtccttgaaggttctgaagatgcaaggctgggaagaaagacagatcgaggagctgctagagctgctgatgactgagatcctgcaccccagcagccaggcccccaacggtgtgaagagccacttcatcgagatcttcctggaggagctgaccaaagtgggcgccgaggagcttacggcagaccagaacctgaagttcatcgaccccttctgcagaattgctgcccggaccaaggattccttggttttgaacaacatcactcgaggcatctttgagacgattgtggagcaggccccgcttgccattgaagacctcctgaatgaactggacacacaggatgaggaggtggcgtcggacagtgatgagtcctctgagggtggtgagcgtggagacgcgctgtcccagaagaggtctgagaagccgcccgcaggctccatctgcagggctgaacctgaggctggtgaggagcaggcaggtgacgacagggacagtggcggccccgttctccagtttgactacgaggcagttgctaacagactgtttgaaatggccagccgccagagcaccccttctcagaacagaaagcgtctctacaaagtgatccggaagctgcaggacctggcaggaggcattttccctgaagatgagatcccagagaaggcctgcaggcgcctgcttgaagggaggcggcagaagaagacgaagaagcagaagcgtctgctcaggttgcagcaggagagagggaaaggtgagaaggagcccccgagcccgggcatggagaggaagaggagcaggaggaggggtgtaggggccgaccccgaggcgcgggcagaggctggtgagcagccaggcacagctgagcgggccctgctccgagatcagcccaggggccgtggccagagaggggctcgccagagaaggaggacacctcggcccctgaccagtgcccgagcaaaggcggccaatgtccaggagccggagaagaagaagaaacgcagggagtgatgtggccgggccaaggacaggcagggagggaggccaggacctcgcttgcaccgcgggacgaggctgaccgggctgttctgtagactcaggaccgtggctccagaactctgtgccaggcgggagggaagggcggcactggagagatgggcccatcattaggggccagcatcccaggaactggacctttccccagagcctccgcctgtggctgtgatgaccttgggccagaaggtcaaactccgaagactgaaactctgcctgcagcaggactggccgcccctgctgtggggggttcagaaaataaaatgccgcgcaggccttgcaagggaaaaaaaaaaaaaaaaaaa

SEQ ID NO: 944 - DNA, 2921 bp, Homo sapiens
  ref <308>: DATABASE ACCESSION NUMBER: NM_003686
  ref <309>: DATABASE ENTRY DATE: 2001-06-18
gcacgaggtgccacatgcgatctctgagatatgtacacagtcattcttactatcgcactcagccattcttactacgctaaagaagaaataattattcgaggatatttgcctggcccagaagaaacttatgtaaatttcatgaactattatatccgttttcctcggagtgagagaaaactctttttagatatcatctgagaggtagttaatttggcaccatggggatacagggattgctacaatttatcaaagaagcttcagaacccatccatgtgaggaagtataaagggcaggtagtagctgtggatacatattgctggcttcacaaaggagctattgcttgtgctgaaaaactagccaaaggtgaacctactgataggtatgtaggattttgtatgaaatttgtaaatatgttactatctcatgggatcaagcctattctcgtatttgatggatgtactttaccttctaaaaaggaagtagagagatctagaagagaaagacgacaagccaatcttcttaagggaaagcaacttcttcgtgaggggaaagtctcggaagctcgagagtgtttcacccggtctatcaatatcacacatgccatggcccacaaagtaattaaagctgcccggtctcagggggtagattgcctcgtggctccctatgaagctgatgcgcagttggcctatcttaacaaagcgggaattgtgcaagccataattacagaggactcggatctcctagcttttggctgtaaaaaggtaattttaaagatggaccagtttggaaatggacttgaaattgatcaagctcggctaggaatgtgcagacagcttggggatgtattcacggaagagaagtttcgttacatgtgtattctttcaggttgtgactacctgtcatcactgcgtgggattggattagcaaaggcatgcaaagtcctaagactagccaataatccagatatagtaaaggttatcaagaaaattggacattatctcaagatgaatatcacggtaccagaggattacatcaacgggtttattcgggccaacaataccttcctctatcagctagtttttgatcccatcaaaaggaaacttattcctctgaacgcctatgaagatgatgttgatcctgaaacactaagctacgctgggcaatatgttgatgattccatagctcttcaaatagcacttggaaataaagatataaatacttttgaacagatcgatgactacaatccagacactgctatgcctgcccattcaagaagtcgtagttgggatgacaaaacatgtcaaaagtcagctaatgttagcagcatttggcataggaattactctcccagaccagagtcgggtactgtttcagatgccccacaattgaaggaaaatccaagtactgtgggagtggaacgagtgattagtactaaagggttaaatctcccaaggaaatcatccattgtgaaaagaccaagaagtgcagagctgtcagaagatgacctgttgagtcagtattctctttcatttacgaagaagaccaagaaaaatagctctgaaggcaataaatcattgagcttttctgaagtgtttgtgcctgacctggtaaatggacctactaacaaaaagagtgtaagcactccacctaggacgagaaataaatttgcaacatttttacaaaggaaaaatgaagaaagtggtgcagttgtggttccagggaccagaagcaggtttttttgcagttcagattctactgactgtgtatcaaacaaagtgagcatccagcctctggatgaaactgctgtcacagataaagagaacaatctgcatgaatcagagtatggagaccaagaaggcaagagactggttgacacagatgtagcacgtaattcaagtgatgacattccgaataatcatattccaggtgatcatattccagacaaggcaacagtgtttacagatgaagagtcctactcttttaagagcagcaaatttacaaggaccatttcaccacccactttgggaacactaagaagttgttttagttggtctggaggtcttggagatttttcaagaacgccgagcccctctccaagcacagcattgcagcagttccgaagaaagagcgattcccccacctctttgcctgagaataatatgtctgatgtgtcgcagttaaagagcgaggagtccagtgacgatgagtctcatcccttacgagaaggggcatgttcttcacagtcccaggaaagtggagaattctcactgcagagttcaaatgcatcaaagctttctcagtgctctagtaaggactctgattcagaggaatctgattgcaatattaagttacttgacagtcaaagtgaccagacctccaagctatgtttatctcatttctcaaaaaaagacacacctctaaggaacaaggttcctgggctatataagtccagttctgcagactctctttctacaaccaagatcaaacctctaggacctgccagagccagtgggctgagcaagaagccggcaagcatccagaagagaaagcatcataatgccgagaacaagccggggttacagatcaaactcaatgagctctggaaaaactttggatttaaaaaattctgaaaagcttcctccttgtaagaaacccctgtccccagtcagagataacatccaactaactccagaagcggaagaggatatatttaacaaacctgaatgtggccgtgttcaaagagcaatattccagtaaatgcagactgctgcaaagcttttgcctgcaagagaatctgatcaatttgaagtccctgtttgggaatgaggcacttatcagcatgaagaattttttctcattctgtgccattttaaaaatagaatacattttgtatattaactttaaaaaaaaaaaaaaaaaaa

SEQ ID NO: 945 - DNA, 1331 bp, Homo sapiens
  ref <308>: DATABASE ACCESSION NUMBER: NM_003689
  ref <309>: DATABASE ENTRY DATE: 2001-06-18
ccgcgtctcgcgtagtctcccgcgccgccgtccactgcgcgcttcgctctccgccgcccgaggcccgcgcgctcgccatgtcccggccaccgccaccgcgggtcgcctcggtgctgggcaccatggagatggggcgccgcatggacgcgcccgccagcgccgcggccgtgcgcgcctttctggagcgcggccacaccgaactggacacggccttcatgtacagcgacggccagtccgagaccatcctgggcggcctggggctcgggctgggcggtggcgactgcagagtgaaaattgccaccaaggccaacccttgggatggaaaatcactaaagcctgacagtgtccggtcccagctggagacgtcattgaagaggctgcagtgtccccaagtggacctcttctacctacacacacctgaccacggcaccccggtggaagagacgctgcatgcctgccagcggctgcaccaggagggcaagttcgtggagcttggcctctccaactatgctagctgggaagtggccgagatctgtaccctctgcaagagcaatggctggatcctgcccactgtgtaccagggcatgtacaacgccaccacccggcaggtggaaacggagctcttcccctgcctcaggcactttggactgaggttctatgcctacaaccctctggctgggggcctgctgactggcaagtacaagtatgaggacaaggacgggaaacagcctgtgggccgcttctttgggaatagctgggctgagacctacaggaatcgcttctggaaggagcaccacttcgaggccattgcgttggtggagaaggccctgcaggccgcatatggcgccagcgcccccagtgtgacctcggctgccctccggtggatgtaccaccactcacagctgcagggtgcccacggggacgcggtcatcctgggcatgtccagcctggagcagctggagcagaacttggcagcaacagaggaagggcccctggagccggctgtcgtggatgcctttaatcaagcctggcatttggttgctcacgaatgtcccaactacttccgctaggcccatcatggctcaggctgcccaaggcttttctgtcacctcttttgttctctcacactgaccagtcttggccttaagctgacttagaagggtttttctgaattgtctagatccatgcattatttttctagcttcctgccttgctccctattcactttacactgtgaaaggtggggggtgagtcccacttgagcgcttcctgttgaataaagcaggcacttgacctggctgtagcctaggtcttgagtgaaccccaaaaaa

SEQ ID NO: 946 - DNA, 2380 bp, Homo sapiens
  ref <308>: DATABASE ACCESSION NUMBER: NM_003714
  ref <309>: DATABASE ENTRY DATE: 2001-06-18
gaggaggagggaaaaggcgagcaaaaaggaagagtgggaggaggaggggaagcggcgaaggaggaagaggaggaggaggaagaggggagcacaaaggatccaggtctcccgacgggaggttaataccaagaaccatgtgtgccgagcggctgggccagttcatgaccctggctttggtgttggccacctttgacccggcgcgggggaccgacgccaccaacccacccgagggtccccaagacaggagctcccagcagaaaggccgcctgtccctgcagaatacagcggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccagggcaagtcattcatcaaagacgccttgaaatgtaaggcccacgctctgcggcacaggttcggctgcataagccggaagtgcccggccatcagggaaatggtgtcccagttgcagcgggaatgctacctcaagcacgacctgtgcgcggctgcccaggagaacacccgggtgatagtggagatgatccatttcaaggacttgctgctgcacgaaccctacgtggacctcgtgaacttgctgctgacctgtggggaggaggtgaaggaggccatcacccacagcgtgcaggttcagtgtgagcagaactggggaagcctgtgctccatcttgagcttctgcacctcggccatccagaagcctcccacggcgccccccgagcgccagccccaggtggacagaaccaagctctccagggcccaccacggggaagcaggacatcacctcccagagcccagcagtagggagactggccgaggtgccaagggtgagcgaggtagcaagagccacccaaacgcccatgcccgaggcagagtcgggggccttggggctcagggaccttccggaagcagcgagtgggaagacgaacagtctgagtattctgatatccggaggtgaaatgaaaggcctggccacgaaatctttcctccacgccgtccattttcttatctatggacattccaaaacatttaccattagagaggggggatgtcacacgcaggattctgtggggactgtggacttcatcgaggtgtgtgttcgcggaacggacaggtgagatggagacccctggggccgtggggtctcaggggtgcctggtgaattctgcacttacacgtactcaagggagcgcgcccgcgttatcctcgtacctttgtcttctttccatctgtggagtcagtgggtgtcggccgctctgttgtgggggaggtgaaccagggaggggcagggcaaggcagggcccccagagctgggccacacagtgggtgctgggcctcgccccgaagcttctggtgcagcagcctctggtgctgtctccgcggaagtcagggcggctggattccaggacaggagtgaatgtaaaaataaatatcgcttagaatgcaggagaagggtggagaggaggcaggggccgagggggtgcttggtgccaaactgaaattcagtttcttgtgtggggccttgcggttcagagctcttggcgagggtggagggaggagtgtcatttctatgtgtaatttctgagccattgtactgtctgggctgggggggacactgtccaagggagtggcccctatgagtttatattttaaccactgcttcaaatctcgatttcactttttttatttatccagttatatctacatatctgtcatctaaataaatggctttcaaacaaagcaactgggtcattaaaaccagctcaaagggggtttaaaaaaaaaaaaaccagcccatcctttgaggctgatttttcttttttttaagttctattttaaaagctatcaaacagcgacatagccatacatctgactgcctgacatggactcctgcccacttgggggaaaccttatacccagaggaaaatacacacctggggagtacatttgacaaatttcccttaggatttcgttatctcaccttgaccctcagccaagattggtaaagctgcgtcctggcgattccaggagacccagctggaaacctggcttctccatgtgaggggatgggaaaggaaagaagagaatgaagactacttagtaattcccatcaggaaatgctgaccttttacataaaatcaaggagactgctgaaaatctctaagggacaggattttccagatcctaattggaaatttagcaataaggagaggagtccaaggggacaaataaaggcagagagagagagagagagagggagaggaagaaaagagagagagaaaagagcctcgtgcc

SEQ ID NO: 947 - DNA, 1080 bp, Homo sapiens
  ref <308>: DATABASE ACCESSION NUMBER: NM_003720
  ref <309>: DATABASE ENTRY DATE: 2001-06-18
ctcgcgcaagcggcgtgcggtcccgcggcgctgcagttgtgtccagccggtcacggggcggctatggcggccacgttcttcggagaggtggtgaaggcgccgtgccgagctgggactgaggacgaagaggaggaggaggaggggcggagggagacgcccgaggacagggaggtgcgtctgcagctggcgcggaagagggaagtgcggctccttcgaagacaaacaaaaacatctttggaagtttctttgctagaaaaatatccgtgctccaagtttataattgctataggaaataatgcagtagcatttctgtcatcatttgttatgaattcaggagtctgggaggaagttggttgtgccaaactctggaatgaatggtgtagaacaacagacactacacatctgtcctccacagaggctttttgtgtgttttatcatctaaaatccaatccctcggtttttctctgtcagtgcagttgctatgttgcagaagatcaacagtatcagtggctggaaaaggtttttggctcttgtccaaggaagaacatgcagataactattctcacatgtcgacatgttaccgattataaaacctcagaatccaccggcagccttccttctcctttcctgagagccctaaaaacacagaatttcaaagactcggcgtgttgtccattgctagaacaaccgaatatagtacacgaccttcctgcagcagttctaagctactgtcaagtatggaaaatcccagcaattctgtacttgtgttatactgatgtgatgaaattagacctaatcacagtggaagcttttaagcctatactttctaccagaagcttgaagggtttggttaagaatattccccaaagcactgagatactaaagaaattgatgacaacaaatgagattcagagtaacatttatacatgatcttaaacattgttttgtagtgtatattacttgtccattcctttaaggggagcagcctgcactcttttgtagattacttttgggggatatattttgagaatgatgaaacggaataaaattgtaaaaaactaaaaaaaaaaaaaaaaaaaa

SEQ ID NO: 948 - DNA, 1524 bp, Homo sapiens
  ref <308>: DATABASE ACCESSION NUMBER: NM_003726
  ref <309>: DATABASE ENTRY DATE: 2001-06-18
gtcgccttccagcccgtccgcctcccgaccagggcccgcgccccgtcccgcctctctcccgcccagccaaatgcaggccgccgccctccctgaggagatccgttggctcctggaagatgctgaagagtttctggcagaaggtttgcggaatgagaacctcagcgctgttgcaagggatcacagagaccatattctacggggctttcagcaaatcaaagccaggtactattgggattttcagccccaagggggagacattggacaggacagctctgatgataatcacagcgggactcttggcctgtccctcacatccgatgcaccctttttgtcagattatcaggatgagggaatggaagacatcgtaaaaggagctcaagaacttgataacgtaatcaagcaaggatacttggagaagaaaagcaaagatcatagtttctttggatcggagtggcagaagcgatggtgtgttgtcagcagaggtctcttctactactatgctaatgagaagagcaagcagcccaaagggaccttcctcattaagggctacagtgtacggatggccccccacctgcgaagagattccaagaaagaatcctgctttgaactgacctcccaggataggcgcacgtatgagtttacagctactagtccagcagaagccagagactgggtggatcaaataagtttcttgttaaaggatctgagctccttaaccattccatatgaagaggatgaggaggaagaagaaaaagaagagacatatgatgatattgatggttttgactccccaagttgtggttcccagtgcagacccactatcttgcctgggagtgtggggataaaagagcctacagaggagaaagaagaagaagatatttatgaagtcttgccagatgaagagcatgatctagaagaggatgagagtggcactcgacgaaaaggagtagactatgccagttactaccagggcctatgggattgccatggtgaccagccagatgaactgtccttccaacggggtgacctcatccgtattctgagcaaggagtataacatgtatggctggtgggtgggagaactgaacagcctcgttgggattgttccaaaggagtatctcaccactgcctttgaagtggaagaaagatgaaacccaggaaatatattcttccctctctcctcctttatgaggaaactgatcatcaaaagttcccactccctacttctgcacccaccaacgcctgactcctctctttgctgaagagacccaagtctcttgacacctcagagtgactgtaagctaccagtaagacaagtgggaagaggcacgttcatcaaacctgttactaaaccagcctagtcatagctcatccccatgtgtaaatgtgtccacacaaccacatctgccttttccacaagcttttcacaaagaaggtgagagagaaggaaaccttgggaggaggacattactggttgttctggctggtttgaaaagcacaaataaacttgggatgtggttccttg

SEQ ID NO: 949 - DNA, 1539 bp, Homo sapiens
  ref <308>: DATABASE ACCESSION NUMBER: NM_003729
  ref <309>: DATABASE ENTRY DATE: 2001-06-18
gctgactccagtgtcccgagaggcgccgcttcttccgctttctcgtcaggctcctgcaaccccaggcatgaaccaaggtttctgaactactgggcgggagccaacgtctcttctttctcccgctctggcggaggctttgtcgctgcgggctgggccccagggtgtcccccatggcggggccgcgggtggaggtcgatggcagcatcatggaagggggcggccagatcctgagagtctctacggccttgagctgtctcctaggcctccccttgcgggtgcagaagatccgagccggccggagcacgccaggcctgaggcctcaacatttatctggactggaaatgattcgagatttgtgtgatgggcaactggagggggcagaaattggctcaacagaaataacctttacaccagagaagatcaaaggtggaatccacacagcagataccaagacagcagggagtgtgtgcctcttgatgcaggtctcaatgccgtgtgttctctttgctgcttctccatcagaacttcatttgaaaggtggaactaatgctgaaatggcaccacagatcgattatacagtgatggtcttcaagccaattgttgaaaaatttggtttcatatttaattgtgacattaaaacaaggggatattacccaaaagggggtggtgaagtgattgttcgaatgtcaccagttaaacaattgaaccctataaatttaactgagcgtggctgtgtgactaagatatatggaagagctttcgttgctggtgttttgccatttaaagtagcaaaagatatggcagcggcagcagttagatgcatcagaaaggagatccgggatttgtatgttaacatccagcctgttcaagaacctaaagaccaagcatttggcaatggaaatggaataataattattgctgagacctccactggctgtttgtttgctggatcatcgcttggtaaacgaggtgtaaatgcagacaaagttggaattgaagctgccgaaatgctattagcaaatcttagacatggtggtactgtggatgagtatctgcaagaccagctgattgttttcatggcattagccaatggagtttccagaataaaaacaggaccagttacactccatacgcaaaccgcgatacattttgctgaacaaatagcaaaggctaaatttattgtgaagaaatcagaagatgaagaagacgccgctaaagatacttatattattgaatgccaaggaattgggatgacaaatccaaatctatagagtatttgcctcttaaatgatacctcattgatatattgcactatttcataaatactataaaataatgactaggaagtaacttattaaaggctatgacttaaatttgaagatgaagtacagtgttctaggtttgctgagaaggcttcattaaattaatctcactttgaatatctcctgagagatggacaatgaaatatcagttggtggatatgtgtgatagctgatttcaatattgaagtattgaaataaaatattctttacacctgag

SEQ ID NO: 950 - DNA, 3514 bp, Homo sapiens
  ref <308>: DATABASE ACCESSION NUMBER: NM_003740
  ref <309>: DATABASE ENTRY DATE: 2001-06-18
agcgacgcgtggagaagcggcccacgtgtctgcccagagtcaagtcctgtgttcttcccgctccttacgcatccgcggtccagggcgccctttcagccccgctggtgttcgcccaccccgggccgcgtgagtggggccccacgcagctccccgcactccgtgggccaacttggccaagcaactctgtccggggagcggtgcttgcggggggtgagtaccgggcactgcgcatgcggagctccaaattcaaacagctgttttcagaggctggagggcgggcggactggtagcagctggggctaggagaggctttctctaggaggcggccgctcgagagccatggtggaccggggccctctgctcacctcggccatcatcttctacctggccatcggggcggcgatcttcgaagtgctggaggagccacactggaaggaggccaagaaaaactactacacacagaagctgcatctgctcaaggagttcccgtgcctgggtcaggagggcctggacaagatcctagaggtggtatctgatgctgcaggacagggtgtggccatcacagggaaccagaccttcaacaactggaactggcccaatgcaatgatttttgcagcgaccgtcattaccaccattggatatggcaatgtggctcccaagacccccgccggtcgcctcttctgtgttttctatggtctcttcggggtgccgctctgcctgacgtggatcagtgccctgggcaagttcttcgggggacgtgccaagagactagggcagttccttaccaagagaggtgtgagtctgcggaaggcgcagatcacgtgcacagtcatcttcatcgtgtggggcgtcctagtccacctggtgatcccacccttcgtattcatggtgactgaggggtggaactacatcgagggcctctactactccttcatcaccatctccaccatcggcttcggtgactttgtggccggtgtgaaccccagcgccaactaccacgccctgtaccgctacttcgtggagctctggatctacttggggctggcctggctgtccctttttgtcaactggaaggtgagcatgtttgtggaagtccacaaagccattaagaagcggcggcggcgacggaaggagtcctttgagagctccccacactcccggaaggccctgcaggtgaaggggagcacagcctccaaggacgtcaacatcttcagctttctttccaagaaggaagagacctacaacgacctcatcaagcagatcgggaagaaggccatgaagacaagcgggggtggggagacgggcccgggcccagggctggggcctcaaggcggtgggctcccagcactgcccccttccctggtgcccctggtagtctactccaagaaccgggtgcccaccttggaagaggtgtcacagacactgaggagcaaaggccacgtatcaaggtccccagatgaggaggctgtggcacgggcccctgaagacagctcccctgcccccgaggtgttcatgaaccagctggaccgcatcagcgaggaatgcgagccatgggacgcccaggactaccacccactcatcttccaggacgccagcatcaccttcgtgaacacggaggctggcctctcagacgaggagacctccaagtcctcgctagaggacaacttggcaggggaggagagcccccagcagggggctgaagccaaggcgcccctgaacatgggcgagttcccctcctcctccgagtccaccttcaccagcactgagtctgagctctctgtgccttacgaacagctgatgaatgagtacaacaaggctaacagccccaagggcacatgaggcagggccggctccccaccccacctttgatggcctcttcccccctcaccctagggtgtcccgagatgaccgggacgcctggcccctggtggggggggcagcctcggaactgggagtggggggccaggggccttcctaaccttccatcatcctcagctagatgtatgcccgggacagggcctctgttctccagctgaaccataccctggctgtgggggcatctgtcctgagcttggctggtgtatctcacaatgcaaagacatgctggctggcgggacaggtgggcaggactgaccctgaggaggccttgcctgcagggtctttgtctcaccatttggtggagtatcacacggttctctgaggtctggggcctcagctgtttaagtttaccggtattactgagctcggcatttggagagggagctctgaagtgtctggggaggtaccgctgtgcgtggggtcaggtgtttccgtaccacagcaggagcagggcccgcccgcatcccagctgtgggcctgccggtcaggtcgggcacctactacaaaccgtagtggggtggaggctgctggaggtgggagtgaggagatgagggcagggtctcaaacagtcctgactcacagggcctggaaacaagtcctatgtgggcctggggcctggggtcctcatcctccttgttggtctactcaggcccagcccagagctgtgttccctgtctcaggtcaagcagtggcagacgcaaggctttctgtgggcccccaagtggtaggagggagagtagcagagcatgggttactggaagccgggactgctagggctggtggccagggagctgcaagagtgaggctcagctctggctggttctgcccttacccctcctgcccgcctgagaactgcacaccctgcccgctggccccaggacctgcactcccaatcctgctgtcttctccttccctgtgccctgaacaaggacctcactgcccgccttcccctcccaccagccccctggggctggcccactgtgtcctgaatgtttttgttattttttgttttattttttaaacaaactgctgtttttatatacctggaatctgttgttggcttcagagccagtggttaaagagcagggtcccaaggattgggagatctagtgtctgccctcctgccctgcaactcaattgggcctttttcggtgacctcatccaaggccatgatgtcaagggccatgtccccaagcagaggtggagaaggggacactgaggtgagcaaaagcaggaaggggcatccactgcgggtgactggaggccgggcaggaagcaagtcatcagagccgctcagctccgttcactctctgccttctgccccactactgtggggcagtggggccagagcccacctccccaacatgtgaagacagtgatgggcacgtgcccacacccccacttctctagccgtttgcagaggccgccacccagcacgggcctgaaaaggagcagcctcgtatttttctgtgaaatgttttaatgaaccatgttgttgctggttgtcctggcatcccgcacactgtatgtacatactggcaacgatgtcaaatgtaatttattttaacatttttacaataaaacatgaggtggacaggcaaaaaaaaaaaaaaaaaaaaaaaaaaaaaaaaaaaaa

SEQ ID NO: 951 - DNA, 3134 bp, Homo sapiens
  ref <308>: DATABASE ACCESSION NUMBER: NM_003748
  ref <309>: DATABASE ENTRY DATE: 2001-06-18
tccagcgaacagccccgcttctaacccgagatgctgctgccggcgcccgcgctccgccgcgccctgctgtcccgcccctggaccggggccggcctgcggtggaagcacacctcctccctgaaggtggccaacgagcccgtcttagccttcacgcagggcagccctgagcgagatgccctgcaaaaggccttgaaggacctgaagggccggatggaagccatcccatgcgtgatgggggatgaggaggtgtggacgtcggacgtgcagtaccaagtgtcgccttttaaccatggacataaggtggccaagttctgttatgcagacaagagcctgctcaacaaagccattgaggctgccctggctgcccggaaagagtgggacctgaagcctattgcagaccgggcccagatcttcctgaaggcggcagacatgctgagtgggccgcgcagggctgagatcctcgccaagaccatggtgggacagggtaagaccgtgatccaagcggagattgacgctgcagcggaactcatcgacttcttccggttcaatgccaagtatgcggtggagctggaggggcagcagcccatcagcgtgcccccgagcaccaacagcacggtgtaccggggtctggagggcttcgtggcggccatctcgccctttaacttcactgcaatcggcggcaacctggcgggggcaccggccctgatgggcaacgtggtcctatggaagcccagtgacactgccatgctggccagctatgctgtctaccgcatccttcgggaggctggcctgccccccaacatcatccagtttgtgccagctgatgggcccctatttggggacactgtcaccagctcagagcacctctgtggcatcaacttcacaggcagtgtgcccaccttcaaacacctgtggaagcaggtggcccagaacctggaccggttccacaccttcccacgcctggctggagagtgcggcggaaagaacttccacttcgtgcaccgctcggccgacgtggagagcgtggtgagcgggaccctccgctcagccttcgagtacggtggccagaagtgttccgcctgctcgcgtctctacgtgccgcactcgctgtggccgcagatcaaagggcggctgctggaggagcacagtcggatcaaagtgggcgaccctgcagaggattttgggaccttcttctctgcagtgattgatgccaagtcctttgcccgtatcaagaagtggctggagcacgcgcgctcctcgcccagcctcaccatcctggctgggggcaagtgtgatgactccgtgggctactttgtggagccctgcatcgtggagagcaaggaccctcaggagcccatcatgaaggaggagatcttcgggcctgtactgtctgtgtacgtctacccggacgacaagtacaaggagacgctgcagctggttgacagcaccaccagctatggcctcacgggggcagtgttctcccaggataaggacgtcgtgcaggaggccacaaaggtgctgaggaatgctgccggcaacttctacatcaacgacaagtccactggctcgatagtgggccagcagccctttgggggggcccgagcctctggaaccaatgacaagccagggggcccacactacatcctgcgctggacgtcgccgcaggtcatcaaggagacacataagcccctgggggactggagctacgcgtacatgcagtgagcccctctcgggctccaccgtccagctgtctgtccgtccaggtggccgacctcactgcacagaccccactccagcccctccaccccttcttcatgcacagctgcctttctataatccgggcttgactcccttcttaccactgtattctggcctctcccatgcctcaggctctggtttgagatcgtgctggggaggaacatggccactaccccttatcccatcggccatgtgggaggtatgaccctggtgcctggcaggttctccctctgccctccactgggcccagtggctcagggacctggggaaaggagatggagcagctcttgggatcctttggggaaaaggaggccattctgggccccttggcaaacctcaccactcacagaggctcctggccttgatccctgcccctccaggtgtccagggtaaagtgtaactcagactgacctgtggggcacagggggcaccagctggccttgccctctctggtctgggctgtctaccttcctcactgtatctttgcccagacccacctgggccagtaggcctgtccccagccacacaccttagatgctggcatgccttactccaggtgcctgtgtttggccgaggcctgtgtgattcccggtctgcaccacatggcggggttggggggccgctggaggccacctgccaaggcgtgggatgggatggtcctgccggtttaggccgtgattctggaaaaccttggatgggccttcgtcctatgtcagccttccctttgatcctcaggccctacctgtagagacctccactcctagagccagtctcagggtctgggatttccctgcaggagctcagccaccactgtgccatggtgacacaggccaaggcagacattggccctcccttctcccagcccccagaggcctggccttgggttcgtcagcatgggccgaggacgttgcctgtagaatcctcctctgcctgggagtggctctgtgtggaccagtccctcactggcccattctttttttgacgcagccaatctgtgaccacgattcctcccacagatgcctcctgcttggattctgagtggtcagagatctgtaaagcatgactttcaaggatggttcttaggggactgtgtaaagtgttgggtcttcctccaggatgcctgcatgggaccccacccggagctggtgtggccattccccgaagtgccactggcccatggatgggggtgggtgctggtgcacctgggctgggtgtgggttctgtgtccttccaggatctgtgtcatttcccatgaggggccggggcaggtggctgggtgggggcacaggctggagtattcttagttctactggttctacactgtgaggtggcaatgggatttgctcagatgccacccaataaaatgcctgttactt

SEQ ID NO: 952 - DNA, 2889 bp, Homo sapiens
  ref <308>: DATABASE ACCESSION NUMBER: NM_003772
  ref <309>: DATABASE ENTRY DATE: 2001-06-18
ccacgcgtccgataataaagaaacttgaagacggaggttcttccaaacaactggcagtgatttatggaattggtgaaacaacagttcgggatataagaaaaaataaggaaaagattataacttatgcaagcagttctgattccacaagtcttttggccaagaggaaatctatgaagccatccatgtatgaggaattggacagggcaatgctggaatggttcaaccagcaaagagcaaaagggaatcccatatctggaccaatttgtgcaaaaagggcagagttcttcttttatgctttgggaatggatggtgattttaacccctctgccggttggctaactcgttttaagcagcggcacagcattagagagattaacattagaaatgaaagattaaatggagatgagactgcggtggaagatttttgtaataactttcgagattttattgaacgagagaatttacagcctgaacaaatctacaatgcagatgaaactggactcttttggaagtgcttgccttctaggatttcagtaatcaaaggtaaatgcactgtccctgggcacaaatcaattgaagaaagagtcacaatcatgtgttgtgccaatgcaacaggtttacacaaacttaaactttgtgttgtggggaaagcaaagaaacctcgctcctttaaatcaactgacaccttaaacctgccagtctcttatttcagccaaaaaggtgcatggatggatctttccattttccgacaatggtttgataaaatttttgtgccgcaagttcgagagtatttaagatctaaaggcttgcaggaaaaggctgtgctcttgttggataattcaccaacacatccaaatgaaaatgtcctaaggtcagatgatggccaaatatttgctaaatatttaccacctaatgtggcctcattgattcagccttcagatcagggagtcatagcaacgatgaagagaaattatcgtgcaggtcttctccagaacaacttggaagaaggtaatgacctgaaatcattctggaagaagctaactctgttggatgcactttatgaaatagcaatggcatggaacttagtaaaaccagttaccattagcagagcatggaagaagattctccctatggtagaggagaaagagagcctggactttgatgttgaagatatttctgtggctactgtggctgccattttacaacacaccaaaggattggaaaatgtgactactgagaaccttgaaaaatggcttgaagtagacagtactgaaccaggctatgaagtgttaactgatagcgaaatcatcagaagagcacaaggccaggcagatgaatccagtgaaaatgaggaggaggaaatagaactaattccagagaaacatattaatcatgcagctgccctccagtggactgaaaatttattggattatctagaacaacaaggtgatatgattctacctgatagactggtaatacgtaaacttcgagccaccatcagaaataaacagaagatgacaaagtcaagtcaataatgtcatttcaattttattgttctgctcattgtgtttgtgacaaactctttgcaatatggcttaattttctttgtgttctgaattctcagacttggtcctgtgaaatacaggcacaaaatgtatctgaagtggtttgaggattatgtgttttcatcatctgtgtcttttgtccttttatttgtacagataatcagaagatgatactgaatagatataaattacatgtacacatgtattcactttttagaatctgcaattataccttctgtaacagtggcattcccttaattttctagtgaaagttagagataactgaacagactgaagcacttttctgaaatcttttgcttgatttatgaaggctgccatagttatcttttcttgtgttaaccatcttaaatgatgttttgtatattttatagactgataggatgagaaagatttatattattagatttcaggatgatttataataattcaaaaatgaaattcaataatggggaaataattatgaattatagaaattatgccttcattctcttacatttgtgtgggttgcaagagggggagattattctggaaatgaagtaaatatgggaagttattgccaaatgagagagaaactatgggaaagctgatctataaagaggcattctgatcaattcatttgtaggaaactgggaaataaaaacctggggaactttaggttatttatacaaagggaataaataggctgattttaatttggtaagttgatctttttattatgaatttggtaatagtataggtttattatttattcatctaattttatagtacaggttttgtaatgttacatgtgatgatatgagctcccaccttatatgggggaacatcttgggaatttgagatttaataagttttttttttttttttttagtgtttttactgcatactcacaaatgttgtctataatttgaaaaatattgtcatatctggccctttgatgagaaaaggaaattacaataataaagttttatgattttaaataagtcatatgtttgtatcctgttttatgaagaaagcagaaataattactgaaagtgccagacactaaggaatattattgtttattattttaatacatataaaaagggattaatctgctaaaatgtaatctaaatcagaattttgataaattttttttgtaaactaagtatgtttattcaagacattgaaactactttgcacatatgaatattaatgtaacttgtaatttaaaagtaaagtgtttccatgctatttcatgttttggccaaaaatttttaaaaaataaattacaattgttctctattagtaaaaaaaaaaaaaaaaa

SEQ ID NO: 953 - DNA, 4338 bp, Homo sapiens
  ref <308>: DATABASE ACCESSION NUMBER: NM_003791
  ref <309>: DATABASE ENTRY DATE: 2001-06-18
cagggcacgctgggtcggcggagctgaggctcccagctgtgggcctcgctggcccggtcgcccagtctcgcgagagttgggagtaaacagccccgaatggagtgcccaggcgtgttcgccgcggaggcgccgttatcccgggcccgccggccctgagctcccggcggcgcagattggctcacagtggttgattgatcaaccccattggacgttggttctgtggtacaaatggagtacaggactcagtcgtcacggcctgagtgagagaagccttatttccaagatggagaagaagcggagaaagaaatgaaagcctctcttcaggctgaaccacaaaaggccatgggatttaacttttatttatgttgggcaagactgtaagatggctgatcagtaatgttgcagcttttagctgaaacaaaaattcacttttaatcaagaagaaaaaagtgtgatttgaatatatgcaattttatgatcatattcgcttgtgaccatgaagcttgtcaacatctggctgcttctgctcgtggttttgctctgtgggaagaaacatctgggcgacagactggaaaagaaatcttttgaaaaggccccatgccctggctgttcccacctgactttgaaggtggaattctcatcaacagttgtggaatatgaatatattgtggctttcaatggatactttacagccaaagctagaaattcatttatttcaagtgccctgaagagcagtgaagtagacaattggagaattatacctcgaaacaatccatccagtgactaccctagtgattttgaggtgattcagataaaagaaaaacagaaagcggggctgctaacacttgaagatcatccaaacatcaaacgggtcacgccccaacgaaaagtctttcgttccctcaagtatgctgaatctgaccccacagtaccctgcaatgaaacccggtggagccagaagtggcaatcatcacgtcccctgcgaagagccagcctctccctgggctctggcttctggcatgctacgggaaggcattcgagcagacggctgctgagagccatcccgcgccaggttgcccagacactgcaggcagatgtgctctggcagatgggatatacaggtgctaatgtaagagttgctgtttttgacactgggctgagcgagaagcatccccacttcaaaaatgtgaaggagagaaccaactggaccaacgagcgaacgctggacgatgggttgggccatggcacattcgtggcaggtgtgatagccagcatgagggagtgccaaggatttgctccagatgcagaacttcacattttcagggtctttaccaataatcaggtatcttacacatcttggtttttggacgccttcaactatgccattttaaagaagatcgacgtgttaaacctcagcatcggcggcccggacttcatggatcatccgtttgttgacaaggtgtgggaattaacagctaacaatgtaatcatggtttctgctattggcaatgacggacctctttatggcactctgaataaccctgctgatcaaatggatgtgattggagtaggcggcattgactttgaagataacatcgcccgcttttcttcaaggggaatgactacctgggagctaccaggaggctacggtcgcatgaaacctgacattgtcacctatggtgctggcgtgcggggttctggcgtgaaaggggggtgccgggccctctcagggaccagtgttgcttctccagtggttgcaggtgctgtcaccttgttagtgagcacagtccagaagcgtgagctggtgaatcccgccagtatgaagcaggccctgatcgcgtcagcccggaggctccccggggtcaacatgtttgagcaaggccacggcaagctcgatctgctcagagcctatcagatcctcaacagctacaagccacaggcaagtttgagccccagctacatagatctgactgagtgtccctacatgtggccctactgctcccagcccatctactatggaggaatgccgacagttgttaatgtcaccatcctcaacggcatgggagtcacaggaagaattgtagataagcctgactggcagccctatttgccacagaacggagacaacattgaagttgccttctcctactcctcggtcttatggccttggtcgggctacctggccatctccatttctgtgaccaagaaagcggcttcctgggaaggcattgctcagggccatgtcatgatcactgtggcttccccagcagagacagagtcaaaaaatggtgcagaacagacttcaacagtaaagctccccattaaggtgaagataattcctactcccccgcgaagcaagagagttctctgggatcagtaccacaacctccgctatccacctggctatttccccagggataatttaaggatgaagaatgaccctttagactggaatggtgatcacatccacaccaatttcagggatatgtaccagcatctgagaagcatgggctactttgtagaggtcctcggggcccccttcacgtgttttgatgccagtcagtatggcactttgctgatggtggacagtgaggaggagtacttccctgaagagatcgccaagctccggagggacgtggacaacggcctctcgctcgtcatcttcagtgactggtacaacacttctgttatgagaaaagtgaagttttatgatgaaaacacaaggcagtggtggatgccggataccggaggagctaacatcccagctctgaatgagctgctgtctgtgtggaacatggggttcagcgatggcctgtatgaaggggagttcaccctggccaaccatgacatgtattatgcgtcagggtgcagcatcgcgaagtttccagaagatggcgtcgtgataacacagactttcaaggaccaaggattggaggttttaaagcaggaaacagcagttgttgaaaacgtccccattttgggactttatcagattccagctgagggtggaggccggattgtactgtatggggactccaattgcttggatgacagtcaccgacagaaggactgcttttggcttctggatgccctcctccagtacacatcgtatggggtgacaccgcctagcctcagtcactctgggaaccgccagcgccctcccagtggagcaggctcagtcactccagagaggatggaaggaaaccatcttcatcggtactccaaggttctggaggcccatttgggagacccaaaacctcggcctctaccagcctgtccacgcttgtcttgggccaagccacagcctttaaacgagacggcgcccagtaacctttggaaacatcagaagctactctccattgacctggacaaggtggtgttacccaactttcgatcgaatcgccctcaagtgaggcccttgtcccctggagagagcggcgcctgggacattcctggagggatcatgcctggccgctacaaccaggaggtgggccagaccattcctgtctttgccttcctgggagccatggtggtcctggccttctttgtggtacaaatcaacaaggccaagagcaggccgaagcggaggaagcccagggtgaagcgcccgcagctcatgcagcaggttcacccgccaaagaccccttcggtgtgaccggcagcctggctgaccgtgagggccagagagagccttcacggacggcgctggtgggtgagccgagctgtggtggcggctggtttaaaagggatccagtttccagctgcaggtttgttagagtctgttctacatgggcctgccctcctgtgatgggcagaggctcctggtacatcgagaagattcctgtggatcccgtcaggagggacttagtggctctgccgccagtgagacttcccgccggcagctgtgcgcaccaaagactcgggagaactggaaaggctgtctggggtcttctgactgcaggggaaggatgtactttccaaacaaatgatacaaccctgaccaagctaaaagacgcttgttaaaggctattttctatatttattgttgggaaaagtcactttaaagacttgtgctatttggaagcaaagctattttttttgtcagtggaatgcagtttttttactattccatcatgaggaacaacatagattccatgatctttttaatgacagtacagactgagatttgaaggaaacatgcacaaatctgtaaaacatagaccttcgctttatttttgtaagtatcacctgccaccatgttttgtaatttgaggtcttgatttcaccattgtcggtgaagaaaattttcaataaatatgtattacccgtctgaagctt

SEQ ID NO: 954 - DNA, 2039 bp, Homo sapiens
  ref <308>: DATABASE ACCESSION NUMBER: NM_003793
  ref <309>: DATABASE ENTRY DATE: 2001-06-18
ggaggactcaggccccgctggccgcgggctcggtacccggtgggtcggtggagcgtctgttgggtccgggccgccggcttcgccctcgccatggcgccctggctgcagctcctgtcgctgctggggctgctcccgggcgcagtggccgcccccgcccagccccgagccgccagctttcaggcctgggggccgccgtccccggagctgctggcgcctacccgcttcgcgctggagatgttcaaccgcggccgggctgcggggacgcgggccgtgctgggccttgtgcgcggccgcgtccgccgggcgggccaagggtcgctgtactccctggaggccaccctggaggagccaccctgcaacgaccccatggtgtgccggctccccgtgtccaagaaaaccctgctctgcagcttccaagtcctggatgagctcggaagacacgtgctgctgcggaaggactgtggcccagtggacaccaaggttccaggtgctggggagcccaagtcagccttcactcagggctcagccatgatttcttctctgtcccaaaaccatccagacaacagaaacgagactttcagctcagtcatttccctgttgaatgaggatcccctgtcccaggacttgcctgtgaagatggcttcaatcttcaagaactttgtcattacctataaccggacatatgagtcaaaggaagaagcccggtggcgcctgtccgtctttgtcaataacatggtgcgagcacagaagatccaggccctggaccgtggcacagctcagtatggagtcaccaagttcagtgatctcacagaggaggagttccgcactatctacctgaatactctcctgagaaaagagcctggcaacaagatgaagcaagccaagtctgtgggtgacctcgccccacctgaatgggactggaggagtaagggggctgtcacaaaagtcaaagaccagggcatgtgtggctcctgctgggccttctcagtcacaggcaatgtggagggccagtggtttctcaaccaggggaccctgctctccctctctgaacaggagctcttggactgtgacaagatggacaaggcctgcatgggcggcttgccctccaatgcctactcggccataaagaatttgggagggctggagacagaggatgactacagctaccagggtcacatgcagtcctgcaacttctcagcagagaaggccaaggtctacatcaatgactccgtggagctgagccagaacgagcagaagctggcagcctggctggccaagagaggcccaatctccgtggccatcaatgcctttggcatgcagttttaccgccacgggatctcccgccctctccggcccctctgcagcccttggctcattgaccatgcggtgttgcttgtgggctacggcaaccgctctgacgttcccttttgggccatcaagaacagctggggcactgactggggtgagaagggttactactacttgcatcgcgggtccggggcctgtggcgtgaacaccatggccagctcggcggtggtggactgaagaggggcccccagctcgggacctggtgctgatcagagtggctgctgccccagcctgacatgtgtccaggcccctccccgggaggtacagctggcagagggaaaggcactgggtacctcagggtgagcagagggcactgggctggggcacagcccctgcttccctgcaccccattcccaccctgaagttctgcacctgcacctttgttgaattgtggtagcttaggaggatgtcggggtgaagggtggtatcttggcagttgaagctggggcaagaactctgggcttgggtaatgagcaggaagaaaattttctgatcttaagcccagctctgttctgcccccgctttcctctgtttgatactataaattttctggttcccttggatttagggatagtgtccctctccatgtccaggaaacttgtaaccacccttttctaacagcaataaagaggtgtccttgtaaaaaaaaaaaaaaaaaaaaaaaaaaaaaa

SEQ ID NO: 955 - DNA, 1201 bp, Homo sapiens
  ref <308>: DATABASE ACCESSION NUMBER: NM_003795
  ref <309>: DATABASE ENTRY DATE: 2001-06-18
gggcgaggagggagcccgcggcggcggcagcagctacagcgaaatggcggagaccgtggctgacacccggcggctgatcaccaagccgcagaacctgaatgacgcctacggaccccccagcaacttcctcgagatcgatgtgagcaacccgcaaacggtgggggtcggccggggccgcttcaccacttacgaaatcagggtcaagacaaatcttcctattttcaagctgaaagaatctactgttagaagaagatacagtgactttgaatggctgcgaagtgaattagaaagagagagcaaggtcgtagttcccccgctccctgggaaagcgtttttgcgtcagcttccttttagaggagatgatggaatatttgatgacaattttattgaggaaagaaaacaagggctggagcagtttataaacaaggtcgctggtcatcctctggcacagaacgaacgttgtcttcacatgtttttacaagatgaaataatagataaaagctatactccatctaaaataagacatgcctgaaatttggcaagaaggggcaaaaacgtgactattaatgattgataagcaccagtgaagaagttctaacttttagcatgctgcacagaaactggtataacatgccttcagtatactaacactcatatgctcagttttgttttgttttggcagttgacaagaagttaatttgctttagtaaaaatccctcattccagcctttctatataaatagctctttcttgctgttttaatgtggtgcacactatagcctcacaaacctgttattccagtgtaatctgcagtgtcgtaactaaagttactggcttggtcttatttgcacagtttttgcgtcttgtttgcttcttgcatctgattaactagaatatttctctttcccccttttaatttgtgatgtcacttgaccccatttatgtgtaggagcactacaccattggtttccaatactgcacacataagatacatacttgtgtgcagaaagtatcttcctccaggcttgtaatacccttcacatggaagattaatgagggaaatctttatattctgtataaaaacaaaagcaaatttatatactaaaatcatttgtctaaaaatttaagttgttttcaaataaaaattaaaatgcatttctgatatgcaaaaaaaaaaaaaaaaaaaaaaaaaaaaaaaaaa

SEQ ID NO: 956 - DNA, 716 bp, Homo sapiens
  ref <308>: DATABASE ACCESSION NUMBER: NM_003806
  ref <309>: DATABASE ENTRY DATE: 2001-06-18
gaaacttggtgtccaggggaggcccccggcggctggagcgcggcggcagcgggcgcagaggccggagggagaggaggcgaggggcggcccgagcgcggggcgggagcgaggccagcggtcatgtgcccgtgccccctgcaccgcggccgcggccccccggccgtgtgcgcctgcagcgcgggtcgcctggggctgcgctcgtccgccgcgcagctcaccgccgcccggctcaaggcgctaggcgacgagctgcaccagcgcaccatgtggcggcgccgcgcgcggagccggagggcgccggcgcccggcgcgctccccacctactggccttggctgtgcgcggccgcgcaggtggcggcgctggcggcctggctgctcggcaggcggaacttgtaggaacgcggggcttcttggtggggccggagccgagacccagccggagcgagcaacaggttggtgaaaaccctgtgtccttggagaaagctggttcccgttttccagagggggagcccagagcttgaaaggccgcggttggcacttcgagaaggaagtggagagtaaagacagcgcctggagcgatcgtagaaacacagaatgggactggggaagccctttggaaatccagctgcagaaacagacaccccaatgctatttacatacagctctatatatataaaaaaagaaaatatgaatattaaaaaaaaaaaaaaaaaaaa

SEQ ID NO: 957 - DNA, 1623 bp, Homo sapiens
  ref <308>: DATABASE ACCESSION NUMBER: NM_003821
  ref <309>: DATABASE ENTRY DATE: 2001-06-18
atgaacggggaggccatctgcagcgccctgcccaccattccctaccacaaactcgccgacctgcgctacctgagccgcggcgcctctggcactgtgtcgtccgcccgccacgcagactggcgcgtccaggtggccgtgaagcacctgcacatccacactccgctgctcgacagtgaaagaaaggatgtcttaagagaagctgaaattttacacaaagctagatttagttacattcttccaattttgggaatttgcaatgagcctgaatttttgggaatagttactgaatacatgccaaatggatcattaaatgaactcctacataggaaaactgaatatcctgatgttgcttggccattgagatttcgcatcctgcatgaaattgcccttggtgtaaattacctgcacaatatgactcctcctttacttcatcatgacttgaagactcagaatatcttattggacaatgaatttcatgttaagattgcagattttggtttatcaaagtggcgcatgatgtccctctcacagtcacgaagtagcaaatctgcaccagaaggagggacaattatctatatgccacctgaaaactatgaacctggacaaaaatcaagggccagtatcaagcacgatatatatagctatgcagttatcacatgggaagtgttatccagaaaacagccttttgaagatgtcaccaatcctttgcagataatgtatagtgtgtcacaaggacatcgacctgttattaatgaagaaagtttgccatatgatatacctcaccgagcacgtatgatctctctaatagaaagtggatgggcacaaaatccagatgaaagaccatctttcttaaaatgtttaatagaacttgaaccagttttgagaacatttgaagagataacttttcttgaagctgttattcagctaaagaaaacaaagttacagagtgtttcaagtgccattcacctatgtgacaagaagaaaatggaattatctctgaacatacctgtaaatcatggtccacaagaggaatcatgtggatcctctcagctccatgaaaatagtggttctcctgaaacttcaaggtccctgccagctcctcaagacaatgattttttatctagaaaagctcaagactgttattttatgaagctgcatcactgtcctggaaatcacagttgggacagcaccatttctggatctcaaagggctgcattctgtgatcacaagaccactccatgctcttcagcaataataaatccactctcaactgcaggaaactcagaacgtctgcagcctggtatagcccagcagtggatccagagcaaaagggaagacattgtgaaccaaatgacagaagcctgccttaaccagtcgctagatgcccttctgtccagggacttgatcatgaaagaggactatgaacttgttagtaccaagcctacaaggacctcaaaagtcagacaattactagacactactgacatccaaggagaagaatttgccaaagttatagtacaaaaattgaaagataacaaacaaatgggtcttcagccttacccggaaatacttgtggtttctagatcaccatctttaaatttacttcaaaataaaagcatgtaa

SEQ ID NO: 958 - DNA, 6582 bp, Homo sapiens
  ref <308>: DATABASE ACCESSION NUMBER: NM_003829
  ref <309>: DATABASE ENTRY DATE: 2001-06-18
tgctgctgttaatcatttcagagaagaacactgaactttgaaaaaaatgttggaagccattgacaaaaatcgggccctgcatgcagcagagcgcttgcaaaccaagctgcgagaacgtggggatgtagcaaatgaagacaaactgagccttctgaagtcagtcctgcagagccctctcttcagtcagattctgagccttcagacttctgtacagcagctgaaagaccaggtaaatattgcaacttcagcaacttcaaatattgaatatgcccacgttcctcatctcagcccagctgtgattcctactctgcaaaatgaatcgtttttattatccccaaacaatgggaatctggaagcacttacaggacctggtattccacacattaatgggaaacctgcttgtgatgaatttgatcagcttatcaaaaatatggcccagggtcgccatgtagaagtttttgagctcctcaaacctccatctggaggccttgggtttagtgttgtgggactaagaagtgaaaacagaggagagctgggaatatttgttcaagagatacaagagggcagtgtggcccatagagatggaagattgaaagaaactgatcaaattcttgctatcaatggacaggctcttgatcagacaattacacatcagcaggctatcagcatcctgcagaaagccaaagatactgtccagctagttattgccagaggctcattgcctcagcttgtcagccccatagtttcccgttctccatctgcagccagcacaatttcagctcactctaatccggttcactggcaacacatggaaacgattgaattggtgaatgatggatctggtttgggatttggcatcataggaggaaaagcaactggtgtgatagtaaaaaccattctgcctggaggagtagctgatcagcatgggcgtttatgcagtggagaccacattctaaagattggtgacacagatctagcaggaatgagcagtgagcaagtagcacaagtccttaggcaatgtggaaatagagttaagttgatgattgcaagaggtgccatagaagaacgtacagcacccactgctttgggcatcaccctctcctcatccccaacttcaacaccagagttgcgggttgatgcttctactcagaaaggtgaagaaagtgagacatttgatgtagaactcactaaaaatgtccaaggattaggaattaccattgctggctacattggagataaaaaattggaaccttcaggaatctttgtaaagagcattacaaaaagcagtgccgttgagcatgatggaagaatccaaattggagaccaaattatagcagtagatggcacaaaccttcagggttttactaatcagcaagcagtagaggtattgcgacatacaggacaaactgtgctcctgacactaatgaggagaggaatgaagcaggaagccgagctcatgtcaagggaagacgtcacaaaagatgcagatttgtctcctgttaatgccagcataatcaaagaaaattatgaaaaagatgaagattttttatcttcgacgagaaacaccaacatattaccaactgaagaagaagggtatccattactgtcagctgagatagaagaaatagaagatgcacaaaaacaagaagctgctctgctgacaaaatggcaaaggattatgggaattaactatgaaatagtggtggcccatgtgagcaagtttagtgagaacagtggattggggataagcctggaagcgacagtgggacatcattttatccgatctgttctaccagagggtcctgttggacacagcgggaagctcttcagtggagacgagctattggaagtaaatggcataactttacttggggaaaatcaccaagatgtggtgaatatcttaaaagaactgcctatagaagtgacaatggtgtgctgtcgtcgaactgtgccacccaccacccaatcagaattggatagcctggacttatgtgatattgagctaacagaaaagcctcacgtagatctaggtgagttcatcgggtcatcagagacagaggatccagtgctggcgatgactgatgcgggtcagagtacagaagaggttcaagcacctttggccatgtgggaggctggcattcagcacatagagctggagaaagggagcaaaggacttggttttagcattttagattatcaggatccaattgatccagcaagcactgtgattataattcgttctttggtgcctggcggcattgctgaaaaggatggacgacttcttcctggtgaccgactcatgtttgtaaacgatgttaacttggaaaacagcagtcttgaggaagctgtagaagcactgaagggagcaccgtcagggactgtgagaataggagttgctaagcctttacccctttcaccagaagaaggttatgtttctgctaaggaggattcctttctctacccaccacactcctgtgaggaagcagggctggctgacaaacccctcttcagggctgacttggctctggtgggcacaaatgatgctgacttagtagatgaatccacatttgagtctccatactctcctgaaaatgacagcatctactctactcaagcctctattttatctcttcatggcagttcttgtggtgatggcctgaactatggttcttcccttccatcatctcctcctaaggatgttattgaaaattcttgtgatccagtacttgatctgcatatgtctctggaggaactatatacccagaatctcctgcaaagacaggatgagaatacaccttcggtggacataagtatggggcctgcttctggctttactataaatgactacacacctgcaaatgctattgaacaacaatatgaatgtgaaaacacaatagtgtggactgaatctcatttaccaagtgaagttatatcaagtgcagaacttccttctgtgctacccgattcagctggaaagggctctgagtacctgcttgaacagagctccctggcctgtaatgctgagtgtgtcatgcttcaaaatgtatctaaagaatcttttgaaaggactattaatatagcaaaaggcaattctagcctaggaatgacagttagtgctaataaagatggcttggggatgatcgttcgaagcattattcatggaggtgccattagtcgagatggccggattgccattggggactgcatcttgtccattaatgaagagtctaccatcagtgtaaccaatgcccaggcacgagctatgttgagaagacattctctcattggccctgacataaaaattacttatgtgcctgcagaacatttggaagagttcaaaataagcttgggacaacaatctggaagagtaatggcactggatattttttcttcatacactggcagagacattccagaattaccagagcgagaagagggagagggtgaagaaagcgaacttcaaaacacagcatatagcaattggaatcagcccaggcgggtggaactctggagagaaccaagcaaatccttaggcatcagcattgttggtggacgagggatggggagtcggctaagcaatggagaagtgatgaggggcattttcatcaaacatgttctggaagatagtccagctggcaaaaatggaaccttgaaacctggagatagaatcgtagaggtggatggaatggacctcagagatgcaagccatgaacaagctgtggaagccattcggaaagcaggcaaccctgtagtctttatggtacagagcattataaacagaccaaggaaatcccctttgccttccttgctgcacaacctttaccctaagtacaacttcagcagcactaacccatttgctgactctctacaaatcaacgccgacaaggcacccagtcagtcagagtcagagccagagaaggctccattgtgcagtgtgcccccaccccctccttcagcctttgccgaaatgggtagtgatcacacacagtcatctgcaagcaaaatctcacaagatgtggacaaagaggatgagtttggttacagctggaaaaatatcagagagcgttatggaaccctaacaggcgagctgcatatgattgaactggagaaaggtcatagtggtttgggcctaagtcttgctgggaacaaagaccgatccaggatgagtgtcttcatagtggggattgatccaaatggagctgcaggaaaagatggtcgattgcaaattgcagatgagcttctagagatcaatggtcagattttatatggaagaagtcatcagaatgcctcatcaatcattaaatgtgccccttctaaagtgaaaataatttttatcagaaataaagatgcagtgaatcagatggccgtatgtcctggaaatgcagtagaacctttgccttctaactcagaaaatcttcaaaataaggagacagagccaactgttactacttctgatgcagctgtggacctcagttcatttaaaaatgtgcaacatctggagcttcccaaggatcaggggggtttgggtattgctatcagcgaagaagatacactcagtggagtcatcataaagagcttaacagagcatggggtagcagccacggatggacgactcaaagtcggagatcagatactggctgtagatgatgaaattgttgttggttaccctattgaaaagtttattagccttctgaagacagcaaagatgacagtaaaacttaccatccatgctgagaatccagattcccaggctgttccttcagcagctggtgcagccagtggagaaaaaaagaacagctcccagtctctgatggtcccacagtctggctccccagaaccggagtccatccgaaatacaagcagatcatcaacaccagcaatttttgcttctgatcctgcaacctgccccattatccctggctgcgaaacaaccatcgagatttccaaagggcgaacagggctgggcctgagcatcgttgggggttcagacacgctgctgggtgccattattatccatgaagtttatgaagaaggagcagcatgtaaagatggaagactctgggctggagatcagatcttagaggtgaatggaattgacttgagaaaggccacacatgatgaagcaatcaatgtcctgagacagacgccacagagagtgcgcctgacactctacagagatgaggccccatacaaagaggaggaagtgtgtgacaccctcactattgagctgcagaagaagccgggaaaaggcctaggattaagtattgttggtaaaagaaacgatactggagtatttgtgtcagacattgtcaaaggaggaattgcagatgccgatggaagactgatgcagggagaccagatattaatggtgaatggggaagacgttcgtaatgccacccaagaagcggttgccgctttgctaaagtgttccctaggcacagtaaccttggaagttggaagaatcaaagctggatccagtacatctgagtcactggaaagtagctcaaagaagaatgcattggcatctgaaatacagggattaagaacagtcgaaatgaaaaagggccctactgactcactgggaatcagcatcgctggaggagtaggcagcccacttggtgatgtgcctatatttattgcaatgatgcacccaactggagttgcagcacagacccaaaaactcagagttggggataggattgtcaccatctgtggcacatccactgagggcatgactcacacccaagcagttaacctactgaaaaatgcatctggctccattgaaatgcaggtggttgctggaggagacgtgagtgtggtcacaggtcatcagcaggagcctgcaagttccagtctttctttcactgggctgacgtcaagcagtatatttcaggatgatttaggacctcctcaatgtaagtctattacactagagcgaggaccagatggcttaggcttcagtatagttggaggatatggcagccctcatggagacttacccatttatgttaaaacagtgtttgcaaagggagcagcctctgaagacggacgtctgaaaaggggcgatcagatcattgctgtcaatgggcagagtctagaaggagtcacccatgaagaagctgttgccatccttaaacggacaaaaggcactgtcactttgatggttctctcttgaattggctgccagaattgaaccaacccaacccctagctcacctcctactgtaaagagaatgcactggtcctgacaatttttatgctgtgttcagccgggtcttcaaaactgtaggggggaaataacacttaagtttctttttctcatctagaaatgctttccttactgacaacctaacatcatttttcttttcttcttgcattttgtgaacttaaagagaaggaatatttgtgtaggtgaatctcgtttttatttgtggagatatctaatgttttgtagtcacatgggcaagaattattacatgctaagctggttagtataaagaaagataattctaaagctaaccaaagaaaatggcttcagtaagttaggatgaaaaatgaaaatataaaaaaaaaaaaaaaaaaa

SEQ ID NO: 959 - DNA, 2856 bp, Homo sapiens
  ref <308>: DATABASE ACCESSION NUMBER: NM_003831
  ref <309>: DATABASE ENTRY DATE: 2001-06-18
gaattcgcggccgccccgcctgtgtcctcggcggagcctgctgcccgtcctgccacctctctgctctgttcttgtctctgccttcattcccgaatggatctggtaggagtggcatcgcctgagcccgggacggcagcggcctggggacccagcaagtgtccatgggctattcctcaaaatacaatatcttgttctttggctgatgtaatgagtgaacagctggccaaagaattgcagttagaagaagaagctgccgtttttcctgaagttgctgttgctgaaggaccatttattactggagaaaacattgatacttccagtgaccttatgctggctcagatgctacagatggaatatgacagagaatatgatgcacagcttaggcgtgaagaaaaaaaattcaatggagatagcaaagtttccatttcctttgaaaattatcgaaaagtgcatccttatgaagacagcgatagctctgaagatgaggttgactggcaggatactcgtgatgatccctacagaccagcaaaaccggttcccactcctaaaaagggctttattggaaaaggaaaagatatcaccaccaaacatgatgaagtagtatgtgggagaaagaacacagcaagaatggaaaattttgcacctgagtttcaggtaggagatggaattggaatggatttaaaactatcaaaccatgttttcaatgctttaaaacaacatgcctactcagaagaacgtcgaagtgcccgcctacatgagaaaaaggagcattctacagcagaaaaagcagttgatcctaagacacgtttacttatgtataaaatggtcaactctggaatgttggagacaatcactggctgtattagtacaggaaaggagtctgttgtctttcatgcatatggagggagcatggaggatgaaaaggaagatagtaaagttatacctacagaatgtgccatcaaggtatttaaaacaacccttaatgaatttaagaatcgtgacaaatatattaaagatgatttcaggtttaaagatcgcttcagtaaactaaatccacgtaagatccaccgcatgtgggcagaaaaagaaatgcacaatctcgcaagaatgcagagagctggaattccttgtccaacagttgtactactgaagaaacacattttagttatgtcttttattggccatgatcaagttccagcccctaaattaaaagaagtaaagctcaatagtgaagaaatgaaagaagcctactatcaaactcttcatttgatgcggcagttatatcatgaatgtacgcttgtccatgctgacctcagtgagtataacatgctgtggcatgctggaaaggtctggttgatcgatgtcagtcagtcagtagaacctacccaccctcacggcctggagttcttgttccgggactgcaggaatgtctcgcagtttttccagaaaggaggagtcaaggaagcccttagtgaacgagaactcttcaatgctgtttcaggcttaaacatcacagcagataatgaagctgattttttagctgagatagaagctttggagaaaatgaatgaagatcacgttcagaagaatggaaggaaagctgcttcatttttgaaagatgatggagacccaccactactatatgatgaatagcactaatacccactgcttcagtgttaacacagcagtgattgtcagctgccaatagcaaatgaagttatgggtgacttgaaataccaaaacctgaggagtgggcaatggtgcttctgtgcttttcccccttgtaacccatgtgccagatgtgtggaatttttagctcagcattgagagaataaaatgtcactacctctcatcttatgaacaggataatataattctttaacagctataggttatctggctgaagtagacctaattttatgtgacttgtggtgtaaaatgtcttgatgataatttttaaaacttgggtaacacttccaaatatgggaggaaaggacagatgtgtttacaagggaggattttacaacatacttgctttattcacctccctgttttgtgttgcgtctttccttgaatattttattggcccagagttagcctttctcaattatgtttccagactgtggccgtgattctaaaggaaaatgtgtgctctttagtgggtagaacaaatggaaatttggtttcagaatggctgacagaaatcgacataagtcatgtaatttttgttgatatatcatgaaaatgaacagaattctttttccatacttatatctaagaaaaggcatcataggtttctgaaagagataactatataacagctttttaactatccagtcaactttcagcttttctacatttaggtaaaatggttaggatataactcatggtgtggctaatctacatttatcaataaaatgtaaattatctgaaaggacagaatataagatttaaccatgtttgacatattttaatttagttaatgaagcaaaattcagtttatatttcactagaactgtgtacttgattgattttcagagaaatatcacaaattagaaatattaaatctaaggatgaaaggtatatataaaacaatttgggggccaggcacgatggctcaaacctgtaatcccagcactttgggagaccaaggcgggtggatcacttgaggtcaggagttcaagaccagcctgggcaacatggcgaaaccctgtctctactaaaaatacaaaaattagccgggtgtggtggcacttctctgtaatctcagcttctcaggaggctgagacaggagaatcgcttgaacccgggaggcagaggttgcagtgagctgagatcatgcgcggccgcgaattc

SEQ ID NO: 960 - DNA, 1546 bp, Homo sapiens
  ref <308>: DATABASE ACCESSION NUMBER: NM_003862
  ref <309>: DATABASE ENTRY DATE: 2001-06-18
cacggccggagagacgcggaggaggagacatgagccggcgggcgcccagacggagcggccgtgacgctttcgcgctgcagccgcgcgccccgaccccggagcgctgacccctggccccacgcagctccgcgcccgggccggagagcgcaactcggcttccagacccgccgcgcatgctgtccccggactgagccgggcagccagcctcccacggacgcccggacggccggccggccagcagtgagcgagcttccccgcaccggccaggcgcctcctgcacagcggctgccgccccgcagcccctgcgccagcccggagggcgcagcgctcgggaggagccgcgcggggcgctgatgccgcagggcgcgccgcggagcgccccggagcagcagagtctgcagcagcagcagccggcgaggagggagcagcagcagcggcggcggcggcggcggcggcggcggaggcgcccggtcccggccgcgcggagcggacatgtgcaggctgggctaggagccgccgcctccctcccgcccagcgatgtattcagcgccctccgcctgcacttgcctgtgtttacacttcctgctgctgtgcttccaggtacaggtgctggttgccgaggagaacgtggacttccgcatccacgtggagaaccagacgcgggctcgggacgatgtgagccgtaagcagctgcggctgtaccagctctacagccggaccagtgggaaacacatccaggtcctgggccgcaggatcagtgcccgcggcgaggatggggacaagtatgcccagctcctagtggagacagacaccttcggtagtcaagtccggatcaagggcaaggagacggaattctacctgtgcatgaaccgcaaaggcaagctcgtggggaagcccgatggcaccagcaaggagtgtgtgttcatcgagaaggttctggagaacaactacacggccctgatgtcggctaagtactccggctggtacgtgggcttcaccaagaaggggcggccgcggaagggccccaagacccgggagaaccagcaggacgtgcatttcatgaagcgctaccccaaggggcagccggagcttcagaagcccttcaagtacacgacggtgaccaagaggtcccgtcggatccggcccacacaccctgcctaggccaccccgccgcggcccctcaggtcgccctggccacactcacactcccagaaaactgcatcagaggaatatttttacatgaaaaataaggaagaagctctatttttgtacattgtgtttaaaagaagacaaaaactgaaccaaaactcttggggggaggggtgataaggattttattgttgacttgaaacccccgatgacaaaagactcacgcaaagggactgtagtcaacccacaggtgcttgtctctctctaggaacagacaactctaaactcgtccccagaggaggacttgaatgaggaaaccaacactttgagaaaccaaagtcctttttcccaaaggttctgaaaggaaaaaaaaaaaaaaacaaaaaaaaaaaaaaaa

SEQ ID NO: 961 - DNA, 2937 bp, Homo sapiens
  ref <308>: DATABASE ACCESSION NUMBER: NM_003866
  ref <309>: DATABASE ENTRY DATE: 2001-06-18
caatttcagagtgggatatcagatctttagtgtgaagatacatctacattaaaccaggaatcactagaactgacatttggacaagaaaatttggaaaattttaaaactgtgaaggttgatcatggaaattaaagaggaaggggcatcagaagaagggcagcactttcttcctacagcccaggccaatgatcccggggactgtcagttcacaagtatccagaagactccaaatgaaccgcagttggaattcatccttgcatgcaaggatctcgtggctcctgtccgtgatcgtaaactgaatacactggtgcagatctccgtaatccaccccgtggagcagagtctgacaagatactccagcaccgaaattgtggagggaacaagggacccactgtttttgactggtgtcacattcccatctgagtatcccatctatgaggagaccaaaataaaactaacagtctatgatgtcaaggataagtctcatgacaccgttcgaaccagtgtcctaccagaacataaggatcccccgccagaagttggccgaagtttcttgggctatgccagttttaaagtgggagagctgctgaagtcaaaggagcaattgctggtcctgagcctgagaacttcagatggtggcaaagtggttggcaccatagaagtcagtgtcgtgaagatgggggagattgaggatggggaagccgaccacatcaccacagatgtacagggacaaaagtgtgccctggtatgtgaatgtacagccccggaaagtgtgagcggaaaagataacttaccttttttgaattcagtgttaaagaacccagtatgtaaattatatagatttcccacatctgacaataagtggatgcgaattcgagagcagatgtcagagagcattctttcctttcatattcctaaggaattgatttcccttcacattaaagaagatttgtgcagaaaccaggagataaaagaacttggtgagctttctccacattgggacaatctgcgaaaaaatgtccttacgcactgtgatcaaatggtgaatatgttccaagacattctgacagaacttgccaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaacagaaagaagaaataccggataccagtttatttactattcacctgaaaacacagccaaagcaaaggaagttctcagcaacatcaatcaactacaacctcttatagcaacccatgcagacctactgcttaattctgcaagccagcattctccagacagcttgaagaattctttaaagatgctttcagaaaaaacagagctttttgtacatgccttcaaggatcaacttgtcaggagtgctcttttagcactctacactgcaaggccaggaggcattcttaagaagccaccctctcctaagagcagcacagaggagagcagtccccaagaccaacccccagtgatgagagggcaggactccataccacatcattcagactatgatgaggaagagtgggacagggtgtgggccaatgtggggaagagcctgaactgcattattgctatggtggacaaactgattgaaagagatggtggcagtgaaggcagtggtggcaacaatgatggagaaaaggaaccttcattaacagatgccattccctctcacccaagagaggactggtatgaacagttgtatcccctcatccttaccctgaaggactgcatgggagaagtggtgaaccgagccaagcagtccctgacatttgtgctccttcaggaacttgcgtacagcttgccccagtgtctgatgctgacgctaagaagagacatcgtcttcagccaagcacttgctggattggtttgtggttttatcatcaaattacagacaagtctgtatgacccaggcttcctacagcagcttcacacagtggggttgatagtacaatatgaaggattgttaagtacatacagcgatgaaattggaatgttagaggacatgcccgttggcatttccgatttaaagaaagttgcatttaaaataattgaagccaaatccaatgatgtattgccagttataacaggaagacgagaacattacgtggtagaggtcaagcttccagccagaatgtttgagtcactacctctacagattaaagaaggacagttgcttcatgtgtatccagtactttttaatgttggaatcaatgaacagcaaactctggctgaaaggtttggagatgtctctttgcaagaaagtattaatcaggaaaacttcgaacttctacaagaatattacaagatatttatggaaaagatgcctcctgattatatttcacattttcaggaacaaaatgatttaaaagcattgctagaaaatctccttcaaaatatccaatccaaaaaaagaaagaatgtagaaattatgtggctggctgcaacgatttgccgcaaactgaatggtattcgtttcacctgttgtaaaagtgccaaagacaggacatcgatgtcagtgacacttgaacaatgctcaatcttgagagatgagcaccagttacacaaggacttctttatccgagcgctggattgcatgagaagagaaggatgccgcatagagaatgtactgaagaatatcaaatgcagaaagtatgctttcaacatgctacagctgatggctttccccaagtactacagacctccagaggggacttatggaaaagctgacacctaagtttaccaacatgttaataaacaggaacacaaatacatttc

SEQ ID NO: 962 - DNA, 2212 bp, Homo sapiens
  ref <308>: DATABASE ACCESSION NUMBER: NM_003875
  ref <309>: DATABASE ENTRY DATE: 2001-06-18
tgccggctgctcctcgaccaggcctccttctcaacctcagcccgcggcgccgacccttccggcaccctcccgccccgtctcgtactgtcgccgtcaccgccgcggctccggccctggccccgatggctctgtgcaacggagactccaagctggagaatgctggaggagaccttaaggatggccaccaccactatgaaggagctgttgtcattctggatgctggtgctcagtacgggaaagtcatagaccgaagagtgagggaactgttcgtgcagtctgaaattttccccttggaaacaccagcatttgctataaaggaacaaggattccgtgctattatcatctctggaggacctaattctgtgtatgctgaagatgctccctggtttgatccagcaatattcactattggcaagcctgttcttggaatttgctatggtatgcagatgatgaataaggtatttggaggtactgtgcacaaaaaaagtgtcagagaagatggagttttcaacattagtgtggataatacatgttcattattcaggggccttcagaaggaagaagttgttttgcttacacatggagatagtgtagacaaagtagctgatggattcaaggttgtggcacgttctggaaacatagtagcaggcatagcaaatgaatctaaaaagttatatggagcacagttccaccctgaagttggccttacagaaaatggaaaagtaatactgaagaatttcctttatgatatagctggatgcagtggaaccttcaccgtgcagaacagagaacttgagtgtattcgagagatcaaagagagagtaggcacgtcaaaagttttggttttactcagtggtggagtagactcaacagtttgtacagctttgctaaatcgtgctttgaaccaagaacaagtcattgctgtgcacattgataatggctttatgagaaaacgagaaagccagtctgttgaagaggccctcaaaaagcttggaattcaggtcaaagtgataaatgctgctcattctttctacaatggaacaacaaccctaccaatatcagatgaagatagaaccccacggaaaagaattagcaaaacgttaaatatgaccacaagtcctgaagagaaaagaaaaatcattggggatacttttgttaagattgccaatgaagtaattggagaaatgaacttgaaaccagaggaggttttccttgcccaaggtactttacggcctgatctaattgaaagtgcatcccttgttgcaagtggcaaagctgaactcatcaaaacccatcacaatgacacagagctcatcagaaagttgagagaggagggaaaagtaatagaacctctgaaagattttcataaagatgaagtgagaattttgggcagagaacttggacttccagaagagttagtttccaggcatccatttccaggtcctggcctggcaatcagagtaatatgtgctgaagaaccttatatttgtaaggactttcctgaaaccaacaatattttgaaaatagtagctgatttttctgcaagtgttaaaaagccacataccctattacagagagtcaaagcctgcacaacagaagaggatcaggagaagctgatgcaaattaccagtctgcattcactgaatgccttcttgctgccaattaaaactgtaggtgtgcagggtgactgtcgttcctacagttacgtgtgtggaatctccagtaaagatgaacctgactgggaatcacttatttttctggctaggcttatacctcgcatgtgtcacaacgttaacagagttgtttatatatttggcccaccagttaaagaacctcctacagatgttactcccactttcttgacaacaggggtgctcagtactttacgccaagctgattttgaggcccataacattctcagggagtctgggtatgctgggaaaatcagccagatgccggtgattttgacaccattacattttgatcgggacccacttcaaaagcagccttcatgccagagatctgtggttattcgaacctttattactagtgacttcatgactggtatacctgcaacacctggcaatgagatccctgtagaggtggtattaaagatggtcactgagattaagaagattcctggtatttctcgaattatgtatgacttaacatcaaagcccccaggaactactgagtgggagtaataaacttc

SEQ ID NO: 963 - DNA, 1280 bp, Homo sapiens
  ref <308>: DATABASE ACCESSION NUMBER: NM_003878
  ref <309>: DATABASE ENTRY DATE: 2001-06-18
tgccgcagcccccgcccgcccgcagagcttttgaaaggcggcgggaggcggcgagcgccatggccagtccgggctgcctgctgtgcgtgctgggcctgctactctgcggggcggcgagcctcgagctgtctagaccccacggcgacaccgccaagaagcccatcatcggaatattaatgcaaaaatgccgtaataaagtcatgaaaaactatggaagatactatattgctgcgtcctatgtaaagtacttggagtctgcaggtgcgagagttgtaccagtaaggctggatcttacagagaaagactatgaaatacttttcaaatctattaatggaatccttttccctggaggaagtgttgacctcagacgctcagattatgctaaagtggccaaaatattttataacttgtccatacagagttttgatgatggagactattttcctgtgtggggcacatgccttggatttgaagagctttcactgctgattagtggagagtgcttattaactgccacagatactgttgacgtggcaatgccgctgaacttcactggaggtcaattgcacagcagaatgttccagaattttcctactgagttgttgctgtcattagcagtagaacctctgactgccaatttccataagtggagcctctccgtgaagaattttacaatgaatgaaaagttaaagaagtttttcaatgtcttaactacaaatacagatggcaagattgagtttatttcaacaatggaaggatataagtatccagtatatggtgtccagtggcatccagagaaagcaccttatgagtggaagaatttggatggcatttcccatgcacctaatgctgtgaaaaccgcattttatttagcagagttttttgttaatgaagctcggaaaaacaaccatcattttaaatctgaatctgaagaggagaaagcattgatttatcagttcagtccaatttatactggaaatatttcttcatttcagcaatgttacatatttgattgaaagtcttcaatttgttaacagagcaaatttgaataattccatgattaaactgttagaataacttgctactcatggcaagattaggaagtcacagattcttttctataatgtgcctggctctgattcttcattatgtatgtgactatttatataacattagataattaaatagtgagacataaatagagtgctttttcatggaaaagccttcttatatctgaagattgaaaaataaatttactgaaatacaaaaaaaaaaaaaaa

SEQ ID NO: 964 - DNA, 2830 bp, Homo sapiens
  ref <308>: DATABASE ACCESSION NUMBER: NM_003882
  ref <309>: DATABASE ENTRY DATE: 2001-06-18
cccacgcgtccgctgggcccagctcccccgagaggtggtcggatcctctgggctgctcggtcgatgcctgtgccactgacgtccaggcatgaggtggttcctgccctggacgctggcagcagtgacagcagcagccgccagcaccgtcctggccacggccctctctccagcccctacgaccatggactttactccagctccactggaggacacctcctcacgcccccaattctgcaagtggccatgtgagtgcccgccatccccaccccgctgcccgctgggggtcagcctcatcacagatggctgtgagtgctgtaagatgtgcgctcagcagcttggggacaactgcacggaggctgccatctgtgacccccaccggggcctctactgtgactacagcggggaccgcccgaggtacgcaataggagtgtgtgcacaggtggtcggtgtgggctgcgtcctggatggggtgcgctacaacaacggccagtccttccagcctaactgcaagtacaactgcacgtgcatcgacggcgcggtgggctgcacaccactgtgcctccgagtgcgccccccgcgtctctggtgcccccacccgcggcgcgtgagcatacctggccactgctgtgagcagtgggtatgtgaggacgacgccaagaggccacgcaagaccgcaccccgtgacacaggagccttcgatgctgtgggtgaggtggaggcatggcacaggaactgcatagcctacacaagcccctggagcccttgctccaccagctgcggcctgggggtctccactcggatctccaatgttaacgcccagtgctggcctgagcaagagagccgcctctgcaacttgcggccatgcgatgtggacatccatacactcattaaggcagggaagaagtgtctggctgtgtaccagccagaggcatccatgaacttcacacttgcgggctgcatcagcacacgctcctatcaacccaagtactgtggagtttgcatggacaataggtgctgcatcccctacaagtctaagactatcgacgtgtccttccagtgtcctgatgggcttggcttctcccgccaggtcctatggattaatgcctgcttctgtaacctgagctgtaggaatcccaatgacatctttgctgacttggaatcctaccctgacttctcagaaattgccaactaggcaggcacaaatcttgggtcttggggactaacccaatgcctgtgaagcagtcagcccttatggccaataacttttcaccaatgagccttagttaccctgatctggacccttggcctccatttctgtctctaaccattcaaatgacgcctgatggtgctgctcaggcccatgctatgagttttctccttgatatcattcagcatctactctaaagaaaaatgcctgtctctagctgttctggactacacccaagcctgatccagcctttccaagtcactagaagtcctgctggatcttgcctaaatcccaagaaatggaatcaggtagacttttaatatcactaatttcttctttagatgccaaaccacaagactctttgggtccattcagatgaatagatggaatttggaacaatagaataatctattatttggagcctgccaagaggtactgtaatgggtaattctgacgtcagcgcaccaaaactatcctgattccaaatatgtatgcacctcaaggtcatcaaacatttgccaagtgagttgaatagttgcttaattttgatttttaatggaaagttgtatccattaacctgggcattgttgaggttaagtttctcttcacccctacactgtgaagggtacagattaggtttgtcccagtcagaaataaaatttgataaacattcctgttgatgggaaaagcccccagttaatactccagagacagggaaaggtcagcccatttcagaaggaccaattgactctcacactgaatcagctgctgactggcagggctttgggcagttggccaggctcttccttgaatcttctcccttgtcctgcttgggttcataggaattggtaaggcctctggactggcctgtctggcccctgagagtggtgccctggaacactcctctactcttacagagccttgagagacccagctgcagaccatgccagacccactgaaatgaccaagacaggttcaggtaggggtgtgggtcaaaccaagaagtgggtgcccttggtagcagcctggggtgacctctagagctggaggctgtgggactccaggggcccccgtgttcaggacacatctattgcagagactcatttcacagcctttcgttctgctgaccaaatggccagttttctggtaggaagatggaggtttaccagttgtttagaaacagaaatagacttaataaaggtttaaagctgaagaggttgaagctaaaaggaaaaggttgttgttaatgaatatcaggctattatttattgtattaggaaaatataatatttactgttagaattcttttatttagggccttttctgtgccagacattgctctcagtgctttgcatgtattagctcactgaatcttcacgacaatgttgagaagttcccattattatttctgttcttacaaatgtgaaacggaagctcatagaggtgagaaaactcaaccagagtcacccagttggtgactgggaaagttaggattcagatcgaaattggactgtctttataacccatattttccccctgtttttagagcttccaaatgtgtcagaataggaaaacattgcaataaatggcttgattttttaaaaaaaaaaaaaaaaaaaaaaa

SEQ ID NO: 965 - DNA, 1337 bp, Homo sapiens
  ref <308>: DATABASE ACCESSION NUMBER: NM_003894
  ref <309>: DATABASE ENTRY DATE: 2001-06-18
gtggtcgagccgcgcgcagggtgcgctcgtttgaactgcggtgacaccgagggttggggactcgaacccccgcttcgcagctcaggagcctgaggtccgaaagcttcgttccagagcccagcatgaatggatacgcggaatttccgcccagccccagtaaccccaccaaggagcccgtggagccccagcccagccaggtcccactgcaggaagatgtggacatgagcagtggctccagtggacatgagaccaacgaaaactgctccacggggcgggactcgcagggcagtgactgtgacgacagtgggaaggagctggggatgctggtggagccaccggatgcccgccagagtccagatacctttagcctgatgatggcaaaatctgaacacaacccatctacaagtggctgcagtagcgaccagtcttcgaaagtggacacacacaaagaactgataaaaacactaaaggagctgaaggtccacctccctgcagacaagaaggccaagggcaaggccagtacgctggccaccttgaagtacgccctcaggagcgtgaagcaggtgaaagccaatgaagagtattaccagctgctgatgtccagcgagggtcacccctgtggagcagacgtgccctcctacaccgtggaggagatggagagcgttacctctgagcacattgtgaagaatgccgatatgtttgcggtggccgtgtccctggtgtctgggaagatcctgtacatctctgaccaggttgcatccatatttcactgtaaaagagatgccttcagcgatgccaagtttgtggagttcctggcgcctcacgatgtgggcgtgttccacagtttcacctccccgtacaagcttcccttgtggagcatgtgcagtggagcagattcttttactcaagaatgcatggaggagaaatctttcttttgccgtgtcagtgtccggaaaagccacgagaatgaaatccgctaccaccccttccgcatgacgccctacctggtcaaggtgcgggaccaacaaggtgctgagagtcagctttgctgccttctgctggcagagagagtgcactctggttatgaagcccctagaattcctcctgaaaagagaatttttacaaccacccatacaccaaattgtttgttccaggatgtggatgaaagtcctgcagtcaggcgggcagcctttcgactattctcccattcggtttcgcgcccggaacggagagtacatcacgttggacaccagctggtccagcttcatcaacccatggagcaggaaaatctccttcatcattgggaggcacaaagtcagggtgggccctttgaatga

SEQ ID NO: 966 - DNA, 1230 bp, Homo sapiens
  ref <308>: DATABASE ACCESSION NUMBER: NM_003897
  ref <309>: DATABASE ENTRY DATE: 2001-06-18
ctcggctcaccatgtgtcactctcgcagctgccacccgaccatgaccatcctgcaggccccgaccccggccccctccaccatcccgggaccccggcggggctccggtcctgagatcttcaccttcgaccctctcccggagcccgcagcggcccctgccgggcgccccagcgcctctcgcgggcaccgaaagcgcagccgcagggttctctaccctcgagtggtccggcgccagctgccagtcgaggaaccgaacccagccaaaaggcttctctttctgctgctcaccatcgtcttctgccagatcctgatggctgaagagggtgtgccggcgcccctgcctccagaggacgcccctaacgccgcatccctggcgcccacccctgtgtcccccgtcctcgagccctttaatctgacttcggagccctcggactacgctctggacctcagcactttcctccagcaacacccggccgccttctaactgtgactccccgcactccccaaaaagaatccgaaaaaccacaaagaaacaccaggcgtacctggtgcgcgagagcgtatccccaactgggacttccgaggcaacttgaactcagaacactacagcggagacgccacccggtgcttgaggcgggaccgaggcgcacagagaccgaggcgcatagagaccgaggcacagcccagctggggctaggcccggtgggaaggagagcgtcgttaatttatttcttattgctcctaattaatatttatatgtatttatgtacgtcctcctaggtgatggagatgtgtacgtaatatttattttaacttatgcaagggtgtgagatgttccccctgctgtaaatgcaggtctcttggtatttattgagctttgtgggactggtggaagcaggacacctggaactgcggcaaagtaggagaagaaatggggaggactcgggtgggggaggacgtcccggctgggatgaagtctggtggtgggtcgtaagtttaggaggtgactgcatcctccagcatctcaactccgtctgtctactgtgtgagacttcggcggaccattaggaatgagatccgtgagatccttccatcttcttgaagtcgcctttagggtggctacgaggtagaggggtgggggttggtgggctgtcacggagcgactgtcgagatcgcctagtatgttctgtgaacacaaataaaattgatttactgtctgctaaaaaaaaaaa

SEQ ID NO: 967 - DNA, 1817 bp, Homo sapiens
  ref <308>: DATABASE ACCESSION NUMBER: NM_003904
  ref <309>: DATABASE ENTRY DATE: 2001-06-18
ggcacgagctgaattgcgcgtggtggccatggcggccagcggggctgtggaaccagggcccccgggggctgccgtcgccccgtcgcccgccccggccccgccgcctgcccctgatcacctgttccggcccatcagcgccgaggacgaggagcagcagcccaccgagatcgagtcgctatgcatgaactgttactgcaatggcatgacgcgcctcctgctcaccaagattcccttcttcagagaaataatagtgagctccttttcctgcgagcactgtggctggaacaacacggagatccagtcggcaggcaggatccaggaccagggagtgcgctacactttgtctgtcagggctctggaggacatgaacagagaagtggtgaagactgactctgctgccacaaggattcctgagctagattttgaaattcctgcctttagccagaaaggagctctgaccactgttgaaggattgatcacccgtgctatctctggcctggagcaggaccagcctgcacgaagggcaaacaaagatgctacagctgaaagaattgatgagttcattgtcaaactgaaggagctaaagcaagtagcctcccctttcactctgatcattgatgatccctcagggaacagttttgtggaaaacccacatgctcctcagaaagatgatgccctggtgatcacacactacaaccggacccgacagcaggaagagatgctggggcttcaagaagaagcaccagcagagaagccagaagaggaagatctcagaaatgaagtgctccagttcagcacaaactgcccagaatgcaatgcccccgctcagaccaacatgaagctagtacaaatccctcactttaaggaggttatcatcatggctaccaactgcgagaactgtgggcatcggaccaatgaggtgaaatctggaggagcagtagaacccttgggcaccaggatcaccctccacatcacagatgcctcagatatgaccagagacctcctcaagtctgagacttgcagtgtggaaatcccagagctagaatttgaactgggaatggcagtcctcgggggcaagttcaccacactggaagggctgctgaaagacatccgggaactggtgaccaaaaatcctttcacactgggcgacagttccaatcctggacagacggagagactacaggagtttagccagaagatggaccagatcatcgaaggtaacatgaaggcccactttattatggatgatccagcaggaaacagttacttgcagaatgtgtatgcgcctgaagatgatcctgagatgaaggtggagcgttacaagcgcacctttgaccaaaatgaggagctagggctcaatgacatgaagacagagggctatgaggcaggcctggctccgcaacggtagcagtgggtggctcaagggccagcctccagcgctgctctttctgtaggttatttattagtattggatgaaggcgaaggctgggagtgtctttcccaccagcccttgcccatggtggggaggacatctggtttgagtcagagatctgtgcacactttttaaacagcttgtgatgcaagtgtgagcctattgtgttacttgaccttattttggaagttttgaattggcctaggaggaaacccagaaatgaaccaggggtatgtcatcacttttttcatatcaagtcctcaccctccttccacataatgctttatcctttaaggttggaactttgaagttggagaaggtggaataaagttacacctggaaaaaaaaaaaaaaaaaaaaaaaaaaaaaaaaaaaaaaaaaaaaa

SEQ ID NO: 968 - DNA, 2443 bp, Homo sapiens
  ref <308>: DATABASE ACCESSION NUMBER: NM_003929
  ref <309>: DATABASE ENTRY DATE: 2001-06-18
ccacacttcccgcctccctaaaacgcacaccccgctagccatgggcagccgcgaccacctgttcaaagtgctggtggtgggggacgccgcagtgggcaagacgtcgctggtgcagcgatattcccaggacagcttcagcaaacactacaagtccacggtgggagtggattttgctctgaaggttctccagtggtctgactacgagatagtgcggcttcagctgtgggatattgcagggcaggagcgcttcacctctatgacacgattgtattatcgggatgcctctgcctgtgttattatgtttgacgttaccaatgccactaccttcagcaacagccagaggtggaaacaggacctagacagcaagctcacactacccaatggagagccggtgccctgcctgctcttggccaacaagtgtgatctgtccccttgggcagtgagccgggaccagattgaccggttcagtaaagagaacggtttcacaggttggacagaaacatcagtcaaggagaacaaaaatattaatgaggctatgagagtcctcattgaaaagatgatgagaaattccacagaagatatcatgtctttgtccacccaaggggactacatcaatctacaaaccaagtcctccagctggtcctgctgctagtagtgtttggcttattttccatcccagttctgggaggtcttttaagtctcttccctttggttgcccacctgaccattttattaagtacatttgaattgtctcctgactactgtccagtaaggaggcccattgtcacttagaaaagacacctggaacccatgtgcatttctgcatctcctggattagcctttcacatgttgctgactcacattagtgccagttagtgccttcggtgtaagatcttctcatcagccctcaatttgtgatccggaattttgtgagaaggattagaaatcagcacctgcgttttagagatcataattctcacctacttctgagcttatttttccatttgatattcattgatatcatgacttccaattgagaggaaaatgagatcaaatgtcatttcccaaatttcttgtaggccgttgtttcagattctttctgtcttggaatgtaaacatctgattctggaatgcagaaggaggggtctgggcatctgtggatttttggctactagaagtgtcccagaagtcactgtatttttgaaacttctaacgtcataattaagtttctcttgtcttggcatcaagaatagtcaagttttttggccgggcatggtggctcatgcctgtaatcccagcacttggggaggccaaggcaggcggatcacatgaggccaggaattcgagaccaacctggtcagcatggcaaaaccccgtctctactaaaagtacaaaaattagccaggcgtgatggcacgtgtctgtaatcccagctactctggagactgaggtgggagaatcgcttgagactgggaggcagaggttgcagtgaaccgagatcatgccaccgcacttcagcctgggtgacagagaaggactccgtctcaaaaaaaaaagaaaaaagaatagtcatttttaaactacctatctcatgcaatgaaagcattttcttccacaaagagcttaatcctcatgataggattgcctagtgtctcccatttgcaggtttctgggttgatgtcttaatgcataatactgcaagtgacatcagctggctgtgatgcttcgaaataggtctgctcctcacagctttgggaatctgaatggaagaagaaaagagagaagttaacaacctccactggggcaactttgtgaacatgtaggcacttagtcataggaaacatattatgtgcaggtcctagcctggggtaggaaagtagatagacagaaaatcattaggtaatttaagtactaaattgggcagggctttttagtatcaaatcactactagaccgtttaatttgttaaattatctctaggatggtgatttataacctacccaaagttatcgatattcttactaaactctgaggcctgaagttctgtgatagaccttaaataagtgtcctaagtcagtggttcccaaatctggctggtcgggaatacctgggaagtttgttaaaattttttaaaaatgttttaagatttttgggtcctgagccaggcgtggtggctcacacctgtaatcccagcactttgggaggctgaggcaggtggatcgcctgaggtcaggagttcaagatcaacctggccaacatactgaaaccccgtctctactaaaaataagaaaaattagctgggcgtggtggcgggcacctgtaatcccagctacttgggaggctgaggcaggagaatcacttgaacctgggagttagaggttgcagtgagctgagatcacaccattgcgcttcagcctgggcaacaagagtgaaactccatctcc

SEQ ID NO: 969 - DNA, 4668 bp, Homo sapiens
  ref <308>: DATABASE ACCESSION NUMBER: NM_003933
  ref <309>: DATABASE ENTRY DATE: 2001-06-18
gccaccggcagcgcttgttagaatgcagattcccggggttcgactggaatgagaccccggggagcagcgtttgcagcgggcccgccaggtgacctgcacctgggcaccgccatcggcttcgcaggggccatctggaggagtcggtcacccgccatgtcgaccttgctggacattaagagcagcgtgctcaggcaggtgcaggtgtgcccgtccttccgccgcaggactgagcaggacccagggagtgccagcgccgacccgcaggagcctgccacgggggcctggaaacccggggatggcgtggagttctttgcccacatgcgcctcatgctgaagaagggggaaggcagacagggcttgccgtgcctcgaggtccccctgcgcagtggctcgccagcacccccggagcctgtggatcccagcctcggcctgagagccctggccccagaggaggtggagatgctctacgaggaggccctgtacacggtgctttaccgcgcgggtaccatgggccctgaccaggtggacgacgaggaggccctgctcagctatctccagcaggtgtttggcaccagccttgaggagcacactgaggccatcgagcgagtgaggaaggccaaggcccccacgtatgccctgaaagtctctgtcatgcgtgccaagaaccttctggccaaggaccccaacggcttcagcgacccatactgcatgctgggcatcctgcctgcctcggacgccacgcgggagccccgtgcacagaaggagcagcgcttcggcttccgcaagggcagcaagcgcggtggacccctgcctgccaagtgcatccaggtcaccgaggtgaagagcagcaccctgaaccccgtctggaaggagcacttcctcttcgagattgaggatgtgagcacggaccagctgcacctggacatctgggatcatgacgacgatgtatccctggtagaagcgtgcaggaagctgaatgaagtcatcggcctgaagggcatgggcaggtacttcaaacagatcgtcaagtcagcccgcgcaaacgggacagcaggacccaccgaggaccacaccgatgacttcctggggtgcctcaacatacctgtccgggaggtgcctgtggctggcgtcgaccgctggttcaagctggagccacgctccagtgcctcgcgtgtgcagggacactgccacctggttctcaagctgatcactacgcagagggatacggccatgagccagcgcgggcgatccggcttcctgtcccacctgctgctgctcagccatctgctgcggttggagcactcagcagaggagcccaactccagcagctggcgaggagagctcagcacaccagccgccaccatcctctgcctgcacggagcccagagcaacctgtcacccttgcagctggccgtgctgcactggcaggtcagcagccgccaccatcaaacctgcacgctggactacagctacctgctggggctgctggaggacatgcaggcacactgggaagaggctccttcactgccccaggagcaggaggagagcctggctgatagcctttccgccttctctgagttcgggctgcagctgctgcgccagctccgagactacttccctgccaccaacagcaccgctgtccaccgcctggagctgctgctgaagtgtctgggcaagctgcagctcttccaaccctcctttgagatctgccccttcgagtcggagctgaacatggacattgctgcggccctgaagagaggcaaccgtgagtggtacgacaggatcctgaatgccaagagtccccgagagcagccaggaccacagcgcctgcctgggctggttgtgctggctgacgccgtctatgatgaccttcagttctgctacagtgtgtacgccagcctcttccacagcatcctcaatgtggacgtcttcaccctgaccttccggcagctggagcgtctggtggctgaggaggcgtgggtgctgacggaggagctgagccccaagatgaccctggaggtggcctcggggctctttgagctctacctgaccctggctgacctccagcgcttctgggatagcatccctggccgggacagccgctctctggccctggctggcatccacgcccccttcctgcctgctgtgaagctctggttccaagtgctgagggaccaggccaagtggaggcttcagggagccgtggacatggacacgctggagcccgtggacgcctcctccaggcacagcagctccgcagccactgctggtctctgcctcagccacatccaggagttgtgggtgcgcctggcgtggcctgaccctgcccaggctcaggggctgggcacccagcttggccaggacgtgtgtgaggccaccctcttctatacggagctgcttcggaagaaggtggacactcagccaggggcggccggtgaagcagtgagcgaggcgctctgcgtggtcctcaacaatgtggagctcgtgcgcaaggctgctgggcaggccttgaagggcctggcatggccagagggggccacggggcccgagggggtgctcccccgccctctgctcagctgcacacaggccctggacgatgatctgcaacgggaggcccacacggtgacagcgcacctgacctctaagatggtgggcgacatccgcaagtatgtacagcacatcagtctctcgcctgactccatccagaacgatgaggccgtggccccgctcatgaagtacctggatgagaagctggccctgctgaacgcctcgctggtgaaggggaacctgagcagggtgctggaggccctgtgggagctactcctccaggccattctgcaggcgctgggtgcaaaccgtgacgtctctgctgatttctacagccgcttccatttcacgctggaggccctggtcagttttttccacgcagagggtcagggtttgcccctggagagcctgagggatggaagctacaagaggctgaaggaggagctgcggctgcacaaatgttccacccgcgagtgcatcgagcagttctacctggacaagctcaaacagaggaccctggagcagaaccggtttggacgcctgagcgtccgttgccattacgaggcggctgagcagcggctggccgtggaggtgctgcacgccgcggacctgctccccctggatgccaacggcttaagtgacccctttgtgatcgtggagctgggcccaccgcatctctttccactggtccgcagccagaggacccaggtgaagacccggacgctgcaccctgtatacgacgaactcttctacttttccgtgcctgccgaggcgtgccgccgccgcgcggcctgtgtgttgttcaccgtcatggaccacgactggctgtccaccaacgacttcgctggggaggcggccctcggcctaggtggcgtcactggtgtcgcccggccccaggtgggcgggggtgcaagggctgggcagcctgtcaccctgcacctgtgccggcccagagcccaggtgagatctgcgctgaggaggctggaaggccgcaccagcaaggaggcgcaggagttcgtgaagaaactcaaggagctggagaagtgcatggaggcggacccctgagtccatcagctgccagccccggccctggcccccaccccaagttccctgaagcatcctccagctcactgtggccagctttgtgcaaccagggcccacggcgcccctcctgtgctgtgacgtgtgtgtcgtggctggccccgcggcgcctaccgccctggccgtgtctgtctggtgtgtgctgtgaacccctgcacccaaccccacatctgggtggccaacttggcaggacttggccagcagctgcccaggacacagtgcaggccagagcgggcttgaccacctggtgggcctccctgcccgcttccttgggctccccggccctgggtgggcggtgcgcagctggtctccagggactcagtgagtggctgtgctctctgcacaacgggcaatgtgcagacgcatttttggtaatcacagctggggagtgaaaagggtgccactggcaccactgggtggatggtccagagcctccacccacagaggggatgcaaagggcaggtgagtcaagaaccgcataggtctccagtccccacggggctcccaggccggggaaaggttcccctgaggtcactctgaggccagggacgtcacccaaggctggtggtcagtgtgaagggctccgtgccaactggtcagctgtccttcacgcacatatccgtggccacctgagacctgctccacgacccttccaggcagagccgagagttcgccccaacccttccccaggcccagtgtgaaaaacagactcacaaggggcttcttggcctgcagcttcatttgcgagagcgccgaggcaggacacagagcacagctgtgctggaagtgtggggagaacccggacagctcagtcctgccagcagccgcaaagagccgaggctgccaggcccatttatgtccctcatgtctctagattttctcgtcacccagcctcaaaaatatatgtgtcgctccaggtagcggacaaaattttccttcccctcacaggcgtcggttgtgagtgtcagcaccaacttgccagtggatggtattttctcagggtcctgcacggagcctccc

SEQ ID NO: 970 - DNA, 1637 bp, Homo sapiens
  ref <308>: DATABASE ACCESSION NUMBER: NM_003937
  ref <309>: DATABASE ENTRY DATE: 2001-06-18
aagaactggcctgtacattttcaaggaattcttgagaggttcttggagagattctgggagccaaacactccattgggatcctagctgttttagagaacaacttgtaatggagccttcatctcttgagctgccggctgacacagtgcagcgcattgcggctgaactcaaatgccacccaacggatgagagggtggctctccacctagatgaggaagataagctgaggcacttcagggagtgcttttatattcccaaaatacaggatctgcctccagttgatttatcattagtgaataaagatgaaaatgccatctatttcttgggaaattctcttggccttcaaccaaaaatggttaaaacatatcttgaagaagaactagataagtgggccaaaatagcagcctatggtcatgaagtggggaagcgtccttggattacaggagatgagagtattgtaggccttatgaaggacattgtaggagccaatgagaaagaaatagccctaatgaatgctttgactgtaaatttacatcttctaatgttatcattttttaagcctacgccaaaacgatataaaattcttctagaagccaaagccttcccttctgatcattatgctattgagtcacaactacaacttcacggacttaacattgaagaaagtatgcggatgataaagccaagagagggggaagaaaccttaagaatagaggatatccttgaagtaattgagaaggaaggagactcaattgcagtgatcctgttcagtggggtgcatttttacactggacagcactttaatattcctgccatcacaaaagctggacaagcgaagggttgttatgttggctttgatctagcacatgcagttggaaatgttgaactctacttacatgactggggagttgattttgcctgctggtgttcctacaagtatttaaatgcaggagcaggaggaattgctggtgccttcattcatgaaaagcatgcccatacgattaaacctgcattagtgggatggtttggccatgaactcagcaccagatttaagatggataacaaactgcagttaatccctggggtctgtggattccgaatttcaaatcctcccattttgttggtctgttccttgcatgctagtttagagatctttaagcaagcgacaatgaaggcattgcggaaaaaatctgttttgctaactggctatctggaatacctgatcaagcataactatggcaaagataaagcagcaaccaagaaaccagttgtgaacataattactccgtctcatgtagaggagcgggggtgccagctaacaataacattttctgttccaaacaaagatgttttccaagaactagaaaaaagaggagtggtttgtgacaagcggaatccaaatggcattcgagtggctccagttcctctctataattctttccatgatgtttataaatttaccaatctgctcacttctatacttgactctgcagaaacaaaaaattagcagtgttttctagaacaacttaagcaaattatactgaaagctgctgtggttatttcagtattattcgatttttaattattgaaagtatgtcaccattgaccacatgtaactaacaataaataatataccttac

SEQ ID NO: 971 - DNA, 2738 bp, Homo sapiens
  ref <308>: DATABASE ACCESSION NUMBER: NM_003940
  ref <309>: DATABASE ENTRY DATE: 2001-06-18
cgcggaattccgcggaattccgcgccgccgccgccggcagaccccgcgctccggctccggctcggctcgctcggctccggtgcgcgccgaggccatgcagcgccggggcgccctgttcggcatgccgggcggcagcggaggcaggaagatggctgcaggagacatcggcgagctgctagtgccccacatgcccacgatccgcgtgcccaggtccggcgacagggtctacaagaacgagtgcgccttctcctacgactctcccaattctgaaggtggactctatgtatgcatgaatacatttttggcctttggaagggaacatgttgaaagacattttcgaaaaactggacagagtgtatacatgcacctgaaaagacatgcgcgagagaaggtaagaggggcgtctggtggagcgttaccaaaaaggaggaattccaagatttttttagatctagatactgatgacgatttaaatagcgacgattatgaatatgaagatgaagccaaacttgttatattcccagatcactatgaaatagcactaccaaatattgaggagttaccagccctggtaacaattgcttgtgatgcagttctcagctcaaaatctccatacagaaagcaggacccagacacgtgggaaaatgaattgccagtatctaaatatgccaacaacctcacccagctggacaatggagtcaggattcctccaagtggttggaagtgtgccagatgcgacctgcgagaaaacctctggttgaatctgactgacggctctgtcctgtgtggaaagtggttctttgacagctctgggggcaacgggcatgcgctggagcattacagagacatgggctacccactagccgtgaaactgggaaccatcactcctgacggggcagatgtttattcttttcaagaagaagaacctgttttggatcctcatttggccaagcacttagcgcattttggaattgatatgcttcatatgcatgggacagagaatgggctccaggacaatgacatcaagctgagggtcagtgagtgggaagtgatccaggagtcgggcacgaaactgaagccaatgtatggtcctggctacacgggtctgaagaacctgggcaacagctgctatctcagctctgtcatgcaggccatcttcagcatcccagaattccagagagcgtatgtaggaaaccttcccagaatatttgactactcgcctttagatccaacacaagatttcaacacacagatgactaagttaggacatggccttctctcaggccagtattcaaagcctccggtgaaatctgaactcattgaacaggtgatgaaggaggagcacaagccacagcagaacgggatctctccgcgcatgtttaaggcctttgtaagcaagagccacccggaattctcctctaacaggcagcaagatgcccaggaattcttcttgcacctggtgaatctagtagagaggaaccgcatcggctcagaaaacccaagcgatgtttttcgttttttggtggaagaacgcattcagtgctgtcagacccggaaagtccgctacacggagagggtggattacctgatgcagttacctgtggccatggaggcggcaaccaacaaggatgaactgatcgcttatgaactaacgagaagggaagcagaagcaaacagaagaccccttcctgagttggtacgtgccaagataccatttagtgcctgccttcaggccttctctgaaccagaaaatgttgatgatttctggagcagtgccctacaagcaaagtctgcgggtgtgaaaacatctcgctttgcttcattccctgaatacttggtagtgcagataaagaagttcacttttggtcttgactgggttcccaaaaaatttgatgtttctattgatatgccagacctacttgatatcaaccatctccgagccagggggttacagccaggagaggaagaacttccagacatcagcccccccatagtcattcctgatgactcaaaagatcgcctgatgaaccaattgatagacccatcagacatcgatgagtcatcagtgatgcagctggccgagatgggtttcccgctggaagcatgtcgcaaggctgtgtacttcactggaaatatgggcgccgaggtggccttcaactggatcattgttcacatggaagagccagattttgctgagccgctgaccatgcctggttatggaggggcagcttctgctggagcctctgtttttggtgcttctggactggataaccaacctccagaggaaatcgtagctatcatcacctccatgggatttcagcgaaatcaggctattcaggcactacgagcaacgaataataacctggaaagagcactggattggatctttagccaccctgagtttgaagaagacagtgattttgtgattgagatggagaataatgccaatgcaaacattatttctgaggccaagcccgaaggacctagagtcaaggatggatctggaacatatgagctatttgcattcatcagtcacatgggaacatccacaatgagtggtcattacatttgccatatcaaaaaggaaggaagatgggtgatttacaatgaccacaaagtttgtgcctcagaaaggccccctaaagacctgggctacatgtacttttaccgcaggataccaagctaaacctcaaatataaaaattggcgaaaagaagccatacgcctttttaatttgcc

SEQ ID NO: 972 - DNA, 3131 bp, Homo sapiens
  ref <308>: DATABASE ACCESSION NUMBER: NM_003942
  ref <309>: DATABASE ENTRY DATE: 2001-06-18
ggagccgccatgtaaccggcgccgcccggagcccgagccgcgcgggccccagcgacccgcccgccatgggggacgaggacgacgatgagagctgcgccgtggagctgcggatcacagaagccaacctgaccgggcacgaggagaaggtgagcgtggagaacttcgagctgctcaaggtgctgggcacgggagcctacggcaaggtgttcctggtgcggaaggcgggcgggcacgacgcggggaagctgtacgccatgaaggtgctgcgcaaggcggcgctggtgcagcgcgccaagacgcaggagcacacgcgcaccgagcgctcggtgctggagctggtgcgccaggcgcccttcctggtcacgctgcactacgctttccagacggatgccaagctgcacctcatcctggactatgtgagcggcggggagatgttcacccacctctaccagcgccagtacttcaaggaggctgaggtgcgcgtgtatgggggtgagatcgtgctggccctggaacacctgcacaagctcggcatcatttaccgagacctgaaactggagaatgtgctgctggactccgagggccacattgtcctcacggacttcgggctgagcaaggagttcctgacggaggagaaagagcggaccttctccttctgtggcaccatcgagtacatggcccccgaaatcatccgtagcaagacggggcatggcaaggctgtggactggtggagcctgggcatcttgctcttcgagctgctgacgggggcctcgcccttcaccctggagggcgagaggaacacgcaggctgaggtgtctcgacggatcctgaagtgctcccctcccttcccccctcggatcgggcccgtggcgcaggacctgctgcagcggctgctttgtaaggatcctaagaagcgattgggcgcggggccccagggggcacaagaagtccggaaccatcccttcttccagggcctcgattgggtggctctggctgccaggaagattccagccccattccggccccaaatccgctcagagctggatgtgggcaactttgcggaggaattcactcggctggagcctgtctactcaccccctggcagccccccacctggggacccccgaatctttcagggatactcctttgtggcaccctccattctctttgaccacaacaacgcggtgatgaccgatgggctggaagcgcctggtgctggagaccggccaggtcgggcagcggtggccaggagcgctatgatgcaggactcgcccttcttccagcagtacgagctggacctgcgggagcctgcgctgggccagggcagcttttctgtgtgtcgccgctgccgccagcgccagagcggccaggagttcgcagtcaagatcctcagtcgcaggctggaggcgaacacgcagcgcgaagtggctgccctgcgcctgtgccagtcacaccccaacgtggtgaatctgcacgaggtgcatcacgaccagctgcacacgtacctggtcctggagctgctgcggggcggggagctgctggagcacatccgcaagaagcggcacttcagcgagtcggaagcaagccagatcctgcgcagcctcgtgtcggccgtgagcttcatgcacgaggaggcgggcgtggtgcaccgcgacctcaagccggagaacatcctgtacgccgacgacacgcccggggccccggtgaaaatcatcgacttcgggttcgcgcggttgcggccgcagagtcccggggtgcccatgcagacgccctgcttcacgctgcagtacgctgcccccgagctgctggcgcagcagggctacgacgagtcctgcgacctctggagcctgggcgtcattctgtacatgatgctgtcggggcaggtccccttccagggggcctctggccagggcgggcagagccaggcggccgagatcatgtgcaaaatccgcgaggggcgcttctcccttgacggggaggcctggcagggtgtatccgaggaagccaaggagctggtccgagggctcctgaccgtggaccccgccaagcggctgaagctcgagggactgcggggcagctcgtggctgcaggacggcagcgcgcgctcctcgcccccgctccggacgcccgacgtgctcgagtcctctgggcccgcagtgcgctcgggtctcaacgccaccttcatggcattcaaccggggcaagcgggagggcttcttcctgaagagcgtggagaatgcacccctggccaagcggcggaagcagaagctgcggagcgccaccgcctcccgccggggctcccctgcaccagccaacccgggccgagcccccgtcgcctccaaaggggccccccgccgagccaacggccccctgcccccctcctaatccccaccactgtgacccccttccctcataggggctgtgacctgggagcccggctcactcccggaggcctctgcctgcggctgacctgatccccaagggactgtcctttcctctcctaccccaccccactcccagacagagcagaagtatttttataagcagagaattttttatgtcttaccagatagagttgcagggaagggggggcctgctggggagtggggtttggggggccctctcccaggacactgcctcttctgggcagaaggcccctccagggggactgctccaacaggaaagagcccctcccccacttctaagcactgagttaggagtgctaactcctaaactgggaccccctaccctgttctcccctgaggccccgttcctgggaggggcacccctcaactgtcactttatggactgtctgtgcaattacgtccaccaaagacccgtgttgggggtactgaaggagaggccctgggggaccctctgaagcatttctgcctcactttatgtcatctgcttctcccctgttggggctaaggaaggagataggtggctcctaaaagaggaggccatcttctcacccaccccttcctctttggcacagctactcctggctgggggtggggccttgggggtctgggctgggcatccatggtcactgcctcagcccagccaggctgtgcctttgactttaaaataaaagtccacccagtgctgtgtgtggcaaaaaaaaaaaaa

SEQ ID NO: 973 - DNA, 1429 bp, Homo sapiens
  ref <308>: DATABASE ACCESSION NUMBER: NM_003944
  ref <309>: DATABASE ENTRY DATE: 2001-06-18
cagcatggctacgaaatgtgggaattgtggacccggctactccacccctctggaggccatgaaaggacccagggaagagatcgtctacctgccctgcatttaccgaaacacaggcactgaggccccagattatctggccactgtggatgttgaccccaagtctccccagtattgccaggtcatccaccggctgcccatgcccaacctgaaggacgagctgcatcactcaggatggaacacctacagcagctgcttcggtgatagcaccaagtcgcgcaacaagctggtcttgcccagtctcatctcctctcgcatctatgtggtggacgtgggctctgagcccgggccccaaaagctgcacaaggtcattgagcccaaggacatccatgccaagtgcgaactggcctgtctccacaccagccactgcctggccagcggggaagtgatgatcagctccctgggggacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggctttaaccccgctgatgtggaggctggactgtacgggagccacttatatgtatgggactggcagcgccatgagattgtgcagaccctgtctctaaaagatgggctgatacccttggagatccgcttcctgcacaacccaagtgccacccagggttttgtaggctgtgcctcagctccaaacatccagcgcttctacaaaacgagggaaggtacatggtcagtggagaaggtgatccaggtgccccccaagaaagtgaagggctggctgctgccaggggtgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatggcaagcgcctctacatcaccacgtcgctgtacagtgcctgggaaaagcagttttaccctgatctcatcagggaaggctctgtaatgctgcaggttgatgtagacacagtaaaaggagggctgaagttgaaccccaactgcctggtggacttcgggaaggagccccttggcccagccctggctcacgagcttcgctaccctgggggcgattgtagctctgacatctggatttgaaggctc

SEQ ID NO: 974 - DNA, 1151 bp, Homo sapiens
  ref <308>: DATABASE ACCESSION NUMBER: NM_003953
  ref <309>: DATABASE ENTRY DATE: 2001-06-18
gcgcgggttggaggtgccacccggcgcgggtggcggagagatcagaagcctcttccccaagccgagccaacctcagcggggacccgggctcagggacgcggcggcggcggcggcgactgcagtggctggacgatggcagcgtccgccggagccggggcggtgattgcagccccagacagccggcgctggctgtggtcggtgctggcggcggcgcttgggctcttgacagctggagtatcagccttggaagtatatacgccaaaagaaatcttcgtggcaaatggtacacaagggaagctgacctgcaagttcaagtctactagtacgactggcgggttgacctcagtctcctggagcttccagccagagggggccgacactactgtgtcgtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaagagaatttgcctgtgtttccagtttgggtagtggtgggcatagttactgctgtggtcctaggtctcactctgctcatcagcatgattctggctgtcctctatagaaggaaaaactctaaacgggattacactggctgcagtacatcagagagtttgtcaccagttaagcaggctcctcggaagtccccctccgacactgagggtcttgtaaagagtctgccttctggatctcaccagggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatccttaaaaaaaaaaaaaaaaaaaaaaaaaaa

SEQ ID NO: 975 - DNA, 4596 bp, Homo sapiens
  ref <308>: DATABASE ACCESSION NUMBER: NM_003954
  ref <309>: DATABASE ENTRY DATE: 2001-06-18
aagcgggggactgtgccgtgtggaacgtgtagctgttgagaggtggactctgttaccattgaggatgtttggaggatgagtatgtgtggcagaggcacacataaacaggcagagaccctttgcccctgcctttctcccccaacccaaggctgacctgtgttctcccaggtctgggattctaagtgacctgctctgtgtttggtctctctcaggatgagcacaagcctgggagatggcagtgatggaaatggcctgcccaggtgcccctggctcagcagtggggcagcagaaggaactccccaagccaaaggagaagacgccgccactggggaagaaacagagctccgtctacaagcttgaggccgtggagaagagccctgtgttctgcggaaagtgggagatcctgaatgacgtgattaccaagggcacagccaaggaaggctccgaggcagggccagctgccatctctatcatcgcccaggctgagtgtgagaatagccaagagttcagccccaccttttcagaacgcattttcatcgctgggtccaaacagtacagccagtccgagagtcttgatcagatccccaacaatgtggcccatgctacagagggcaaaatggcccgtgtgtgttggaagggaaagcgtcgcagcaaagcccggaagaaacggaagaagaagagctcaaagtccctggctcatgcaggagtggccttggccaaacccctccccaggacccctgagcaggagagctgcaccatcccagtgcaggaggatgagtctccactcggcgccccatatgttagaaacaccccgcagttcaccaagcctctgaaggaaccaggccttgggcaactctgttttaagcagcttggcgagggcctacggccggctctgcctcgatcagaactccacaaactgatcagccccttgcaatgtctgaaccacgtgtggaaactgcaccacccccaggacggaggccccctgcccctgcccacgcaccccttcccctatagcagactgcctcatcccttcccattccaccctctccagccctggaaacctcaccctctggagtccttcctgggcaaactggcctgtgtagacagccagaaacccttgcctgacccacacctgagcaaactggcctgtgtagacagtccaaagcccctgcctggcccacacctggagcccagctgcctgtctcgtggtgcccatgagaagttttctgtggaggaatacctagtgcatgctctgcaaggcagcgtgagctcaagccaggcccacagcctgaccagcctggccaagacctgggcagcacggggctccagatcccgggagcccagccccaaaactgaggacaacgagggtgtcctgctcactgagaaactcaagccagtggattatgagtaccgagaagaagtccactgggccacgcaccagctccgcctgggcagaggctccttcggagaggtgcacaggatggaggacaagcagactggcttccagtgcgctgtcaaaaaggtgcggctggaagtatttcgggcagaggagctgatggcatgtgcaggattgacctcacccagaattgtccctttgtatggagctgtgagagaagggccttgggtcaacatcttcatggagctgctggaaggtggctccctgggccagctggtcaaggagcagggctgtctcccagaggaccgggccctgtactacctgggccaggccctggagggtctggaatacctccactcacgaaggattctgcatggggacgtcaaagctgacaacgtgctcctgtccagcgatgggagccacgcagccctctgtgactttggccatgctgtgtgtcttcaacctgatggcctgggaaagtccttgctcacaggggactacatccctggcacagagacccacatggctccggaggtggtgctgggcaggagctgcgacgccaaggtggatgtctggagcagctgctgtatgatgctgcacatgctcaacggctgccacccctggactcagttcttccgagggccgctctgcctcaagattgccagcgagcctccgcctgtgagggagatcccaccctcctgcgcccctctcacagcccaggccatccaagaggggctgaggaaagagcccatccaccgcgtgtctgcagcggagctgggagggaaggtgaaccgggcactacagcaagtgggaggtctgaagagcccttggaggggagaatataaagaaccaagacatccaccgccaaatcaagccaattaccaccagaccctccatgcccagccgagagagctttcgccaagggccccagggccccggccagctgaggagacaacaggcagagcccctaagctccagcctcctctcccaccagagcccccagagccaaacaagtctcctcccttgactttgagcaaggaggagtctgggatgtgggaacccttacctctgtcctccctggagccagcccctgccagaaaccccagctcaccagagcggaaagcaaccgtcccggagcaggaactgcagcagctggaaatagaattattcctcaacagcctgtcccagccattttctctggaggagcaggagcaaattctctcgtgcctcagcatcgacagcctctccctgtcggatgacagtgagaagaacccatcaaaggcctctcaaagctcgcgggacaccctgagctcaggcgtacactcctggagcagccaggccgaggctcgaagctccagctggaacatggtgctggcccgggggcggcccaccgacaccccaagctatttcaatggtgtgaaagtccaaatacagtctcttaatggtgaacacctgcacatccgggagttccaccgggtcaaagtgggagacatcgccactggcatcagcagccagatcccagctgcagccttcagcttggtcaccaaagacgggcagcctgttcgctacgacatggaggtgccagactcgggcatcgacctgcagtgcacactggcccctgatggcagcttcgcctggagctggagggtcaagcatggccagctggagaacaggccctaaccctgccctccaccgccggctccacactgccggaaagcagccttcctgctcggtgcacgatgctgccctgaaaacacaggctcagccgttcccaggggattgccagccccccggctcacagtgggaaccagggcctcgcagcagcaaggtgggggcaagcagaatgcctcccaggatttcacacctgagccctgccccaccctgctgaaaaaacatccgccacgtgaagagacagaaggaggatggcaggagttacctggggaaacaaaacagggatctttttctgcccctgctccagtcgagttggcctgacccgcttggatcagtgaccatttgttggcagacaggggagagcagcttccagcctgggtcagaaggggtgggcgagcccttcggcccctcaccctccaggctgctgtgagagtgtcaagtgtgtaagggcccaaactcaggttcagtgcagaaccaggtcagcaggtatgcccgcccgtaggttaagggggccctctaaaccccttgcctggcctcacctggccagctcaccccttttgggtgtaggggaaaagaatgcctgaccctgggaaggctccctggtagaatacaccacacttttcaggttgttgcaacacaggtcctgagttgacctctggttcagccaaggaccaaagaaggtgtgtaagtgaagtggttctcagtccccagacatgtgcccctttgctgctggctaccactcttccccagagcagcaggccccgagccccttcaggcccagcactgccccagactcgctggcactcagttccctcatctgtaaaggtgaagggtgatgcaggatatgcctgacaggaacagtctgtggatggacatgatcagtgctaaggaaagcagcagagagagacgtccggcgccccagccccactatcagtgtccagcgtgctggttccccagagcacagctcagcatcacactgacactcaccctgccctgcccctggccagagggtactgccgacggcactttgcactctgatgacctcaaagcactttcatggctgccctctggcagggcagggcagggcagtgacactgtaggagcatagcaagccaggagatggggtgaagggacacagtcttgagctgtccacatgcatgtgactcctcaaacctcttccagatttctctaagaatagcacccccttccccattgccccagcttagcctcttctcccaggggagctactcaggactcacgtagcattaaatcagctgtgaatcgtcagggggtgtctgctagcctcaacctcctggggcaggggacgccgagactccgtgggagaagctcattcccacatcttgccaagacagcctttgtccagctgtccacattgagtcagactgctcccggggagagagccccggcccccagcacataaagaactgcagccttggtactgcagagtctgggttgtagagaactctttgtaagcaataaagtttggggtgatgacaaatgttaaaaaa

SEQ ID NO: 976 - DNA, 1592 bp, Homo sapiens
  ref <308>: DATABASE ACCESSION NUMBER: NM_003975
  ref <309>: DATABASE ENTRY DATE: 2001-06-18
ggagagatgatgagttgctgagtgtgcacacctttccggaacacatacacacaccctgctctgggatcccttgtgaggctgccctcatggagttccccctggcccagatatgtccccaagggagtcacgaagcccccatcccaaccttcagcaccttccagatcacagacatgacccgcaggagctgccagaacctgggctacactgcggcatctccccaggccccggaggctgcctccagcacagggaatgctgagagggcagaggaggtgcctggagaaggaagcctgttcctgcaggccgagacccgggcttggttccagaagacccaggcccactggctcctgcagcacggggcagcccctgcctggttccatggcttcatcacccggagggaggcagagaggctgctggagcccaagcctcaggggtgctacttggtgcggttcagcgagagcgcggtgaccttcgtgctgacttacaggagccggacttgctgccgccacttcctgctggcccagctcagggacgggcgccacgtggtgctgggcgaggacagcgcccacgcgcggctgcaggacctgctgctgcactacaccgcgcacccgctcagcccctacggggagacgctcaccgagcccctcgcccgacagactcctgagcctgcaggactttccctgaggaccgaagaatcaaactttggaagcaaaagccaggacccaaacccccagtacagcccaatcatcaaacaggggcaagccccagtcccgatgcagaaagagggggccggggagaaggagccctcccagctgctcaggcccaagcctcccatccccgccaaacctcagctgcccccagaagtctacacaatccctgttccacgacaccgcccggccccacgccccaagccctccaatcctatctacaatgagcctgatgaacccatagctttctatgccatgggccggggcagccctggggaagcccccagcaacatctatgtggaagtggaagatgagggcctacccgccacccttgggcaccctgtcctacggaagagctggtccaggcctgtcccaggaggccagaatacaggtggctcccagctgcattctgagaactctgtgattgggcaaggccctcccctgccccaccagcccccacccgcctggagacacaccctcccccacaatctttctagacaggtgcttcaggacagaggacaggcatggcttccccttgggcctcctcagtaggcggtctggcctgacccccaacaaagaagcctggaggtcagagaagcaaatgcggagcctgctccctcctaagaagatcccaagaatccaatggctcagtccttggtgatctaagacagcaaagaagtgtgcaaggagggccctgttagctcccactgtcctggtttctcctcctggagtctaatttccttggccctctgagccttttgagtctgggccctggtccaatgctgctgttgtctgaggaatggtttggtgagaacagatgttagaacttgtttgttgattcttgtctggctaataaatcatcaccaactgccttctcctacagggaaa

SEQ ID NO: 977 - DNA, 3044 bp, Homo sapiens
  ref <308>: DATABASE ACCESSION NUMBER: NM_003981
  ref <309>: DATABASE ENTRY DATE: 2001-06-18
gtttgcgggtggttgttgctctcggggccgtgtggagtaggtctggacctggactcacggctgcttggagcgtccgccatgaggagaagtgaggtgctggcggaggagtccatagtatgtctgcagaaagccctaaatcaccttcgggaaatatgggagctaattgggattccagaggaccagcggttacaaagaactgaggtggtaaagaagcatatcaaggaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagaattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtggtgggtaccctggctcggcccccctccagcgcaacttcagcattaattctgttgccagcacctattctgagtttgcgaaggatccgtccctctctgacagttccactgttgggcttcagcgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggagtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaaatgattgactatgcccatccctgggggtaattttggcatgtatacctgtaactagtaattaacatcttttttgtttaggcatgttcaattaatgctgtagctatcatagctttgctcttacctgaagccttgtccccaccacacaggacagccttcctcctgaagagaatgtctttgtgtgtccgaagttgagatggcctgccctactggcaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccagattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttacctcatacagtacgtgtcctgtttttaaaatatacaattattcttaaaaataaattaaaatcgtatacttacatttcaaaaaaaaaaaaaaaaa

SEQ ID NO: 978 - DNA, 2245 bp, Homo sapiens
  ref <308>: DATABASE ACCESSION NUMBER: NM_003982
  ref <309>: DATABASE ENTRY DATE: 2001-06-18
agctgttgcagcatgagcgatacgcttggttctcctaactagcaccttcccctctcccctgactcagctggtagcccctcctccccgcacctgcccaaaggtcactggacaggcatttgtctggccttcccttttactgctggctgggaaggaggagcatcagaccacagatcctggaaggcacttctctccctgactgccgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcaggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatctgtctcttaaccttcattaactgtgcctatgtcaaatggggaaccctggtacaagatattttcacctatgctaaagtattggcactgatcgcggtcatcgttgcaggcattgttagacttggccagggagcctctactcattttgagaattcctttgagggttcatcatttgcagtgggtgacattgccctggcactgtactcagctctgttctcctactcaggctgggacaccctcaactatgtcactgaagagatcaagaatcctgagaggaacctgcccctctccattggcatctccatgcccattgtcaccatcatctatatcttgaccaatgtggcctattatactgtgctagacatgagagacatcttggccagtgatgctgttgctgtgacttttgcagatcagatatttggaatatttaactggataattccactgtcagttgcattatcctgttttggtggcctcaatgcctccattgtggctgcttcaaggcttttctttgtgggctcaagagaaggccatctccctgatgccatctgcatgatccatgttgagcggttcacaccagtgccttctctgctcttcaatggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtggggtctgccacaaggtacctccaggtcctgtgtatgtcagttgctgcagaaatggatttggaagatggaggagagatgcccaagcaacgggatcccaagtctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttcctgtctcctttagagagacatgaaactatcacaggtgctggatgacaataaaagtttatgttcctaaaaaaaaaaaaaaaaaaaaaaaaaaaaaaaaaaaaaa

SEQ ID NO: 979 - DNA, 1599 bp, Homo sapiens
  ref <308>: DATABASE ACCESSION NUMBER: NM_003986
  ref <309>: DATABASE ENTRY DATE: 2001-06-18
ggaccaaagctgacagtttctttacttgcaggtagctgacagcatctactcctgaagaccggaaacatggcttgtaccatccaaaaggcagaagcacttgacggggctcatttgatgcagatcctctggtatgatgaggaagagtctctctacccagctgtatggttgagagacaactgtccgtgctctgattgctacctggattctgcaaaagcacggaaacttctagtggaagctcttgatgtgaacattggaattaaaggcttgatatttgacagaaaaaaggtgtacatcacatggcccgatgagcattacagtgaattccaggctgattggctgaagaaaagatgcttttccaagcaggccagagcaaagctccaaagagaattgttttttccagaatgccaatactggggctcagagctccagctacccactttggattttgaagatgttttaagatatgatgaacatgcatacaagtggctctccaccctcaagaaagtaggcatagtaagactcaccggagcatctgacaaaccaggagaagtttcaaaacttgggaaaaggatgggtttcctctatctcacattttatggacatacttggcaagtgcaagacaaaatcgatgcaaacaatgtggcttacacaactgggaagctaagctttcacactgattatccagccctccatcatccacctggggttcagcttcttcactgcataaagcaaacagtcacagggggtgattcagaaattgtagatgggtttaatgtgtgccaaaaactaaagaaaaataatcctcaggcattccagattttgtcctctacctttgtggactttacagacattggagtggattactgtgatttttctgtacaatcaaaacataaaattatagagttagatgataaaggccaagtggttcgcatcaacttcaataacgcaactagggacacaatatttgatgtacctgttgaaagagttcagcctttttatgctgctctgaaggagtttgttgacctcatgaacagcaaagaatccaagtttaccttcaagatgaatccaggtgatgtgattacttttgataactggcgcttacttcatggccgacgtagctatgaagcaggaactgagatatcccgccatctagaaggagcttatgctgactgggatgtggtcatgtcaaggcttcgtatcttaaggcagagggtggagaatggaaactgaagtcacctgtagataattttaataagattccaatgaccatattttgtgagatatggcacattattcacagaccatgatctttgtgatttacatataatttccttaacaatgaacatgtaacttctctcacaagagtactctttactttgtaatcatatacaatgtcaactttttagatgtttcaccactcttttgcaaataaagcatcctttctgctctgttgcatgcctgctctaatttcttttgcccatatatgagtatctccagaatgtctacaaatagtttttgtagcaaatgaaaatttcttcaaataagccttttgtttcaaataaaacttgtctcaaaacatgcttcaaaaaaaaaaaaaaa

SEQ ID NO: 980 - DNA, 2699 bp, Homo sapiens
  Modified_base 1 ... 2699: n = a,c,g, or t
  ref <308>: DATABASE ACCESSION NUMBER: NM_004003
  ref <309>: DATABASE ENTRY DATE: 2001-06-18
tggaagagatcacagggagtccagaaacgcctgtcatcccaagcttatgctgtttttctaaaagctctttatgggggcttgatattgggttggtggtctttgtccagaaatatgaagggacaaaggcgggccataaccctcccttctagagtccaggagcttcccctgccactgccacaacccccgatgccaccacagccatcgccactgccacctgcctcccgctgaatcttggctcttgtcttctctttccagcccaggtgaagcctctgggcttcctgaagcccttctccttgatgaaggcttccagccgcttcaaggcacaccaggatgccctgccacggctgcccgtgccccctctccagcagtccctggaccactacctgaaggcgctgcagcccatcgtgagtgaggaggagtgggcccacaccaagcagctggtggatgagtttcaggcctcaggaggtgtaggggagcgcctgcagaaggggctggggcgtcgggccaggaagacggagaactggctgtctgagtggtggctcaagaccgcctacctccagtaccgccagcctgtggtcatctactcgagcccaggcgtgatgctacccaagcaggacttcgtggacctgcagggtcagctccgatttgctgccaaactcattgagggtgtgttggatttcaaggtcatgattgacaacgagaccctgcccgtggagtacctggnggggaagccactgtgcatgaaccagtactatcagatcttgtcctcctgccgagtgccgggccccaagcaggacacagtcagcaacttcagcaagaccaagaagcctcccacgcacatcaccgtggtacacaactaccagttttttgagctggatgtgtaccacagtgacgggacacccctcactgcggatcagatctttgtgcagctggagaagatctggaactcatccctacagaccaacaaggagcctgtgggcatcctcacctccaaccaccgcaactcctgggccaaggcatacaacaccctcatcaaagacaaggtgaaccgggattccgtgcgctccatccagaagagcatcttcaccgtgtgcctagatgcaaccatgcccagggtctcagaagacgtgtaccgcagccacgtggcaggccagatgctgcatgggggcggcagcaggctcaacagcggcaaccgctggtttgacaagacgctgcagttcatcgtggcagaagatggctcctgtgggcttgtgtacgagcatgctgcagcngagggtttccctattgtcacccttctggactatgtcatcgagtacacgaagaaacccgagcttgtgcngtctcccatggtgcccctgcccatgcccaagaagctgcggttcaacatcacccccgagatcaagagcgacatcgagaaggccaagcagaacctcagcatcatgatccannacctggatatcaccgtgatggtgttccaccattttggaaaagacttccccaagtcggagaagctaagcccagatgccttcatccagatggctttgcagctggcctactacaggatctacggacaggcatgtgccacctatgaaagtncntccctgcgcatgtttcacctgggccgcaccgacaccatccgctcggcttccatggactcactcacctttgtcaaggccatggatgactccagcgtcacggagcaccagaaggtggagctgctgcggaaggccgtgcaggcccaccggggctacaccgaccgggccatccgcggggaggcctttggtcgacacctgctgggcctgaagctgcaggccatcgaggacctggtgagcacgcccgacatcttcatggacacctcctacgccatcgccatgcacttccacctctccaccagccaggtccctgccaagacagactgtgtcatgttcttcgggcccgtggtccccgacggctacggtgtctgctataaccccatggaggcccacatcaacttctccctgtcggcctacaacagctgcgcggagaccaacgccgcccgcctggcgcattacctggagaaggcgctcctggacatgcgtgccctgctgcagagccacccccgggccaagctctgagcccctaggactcaggcctgccaatgccacagccaagcccaccctgggatgggccacccaccagggctcagctccttggttccctcttccttggttccctcttccctggtcccccnnaaatgtactgagccacggaccgcatcctccagggacctgcaggccccagccaagtgccttccgtgggtcatcccagcacctgccagggcccgacctggggctgagtgcagaggctgagcaggacgttaggcccgggcccctggcacgtcctccaccggtgcctcctctgggaaagggaaccaccctccagagcaggagactggcaagagctctttgtctcaccagctcagccccggccactccctgccaactccatgaccaggccaccatctgtaccctgcttcccaaactcccaggcctggagacaggattgtctggggncgaggggccagggtgtgaggtttcacctccgttgcggctgtgctcctgtggataacattgctagcgagccgcctctggttccactcagcttggttcctgcccccgccctgctgtatgatattaatgtggaaggtcatcaataaaggg

SEQ ID NO: 981 - DNA, 14082 bp, Homo sapiens
  ref <308>: DATABASE ACCESSION NUMBER: NM_004010
  ref <309>: DATABASE ENTRY DATE: 2001-06-18
atgctgtctgtgaagctgaatctgtgagaacacctcactattcacggcaaccggagtggaagaaacaggtgcaaaaagattgtgtgtttgtctgcttttgtgaggctggtcagagattctgtgcctgctttatctgtgcttggctatgactctacctccaggtttaccataccccatagaatgtgtaagagaaaagtaccaacagggaaatcagcaaaaagctttcctatgaaggtgtgtagccagcctccgcagaatttgaaatgtctgaggtttcttctggtgagtaaaagctgcagataatcaacagccattcagaagaatgataaatgccacaagcatttggaaacaggcttccctaaagatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccgagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 982 - DNA, 2056 bp, Homo sapiens
  ref <308>: DATABASE ACCESSION NUMBER: NM_004024
  ref <309>: DATABASE ENTRY DATE: 2001-06-18
gcagccaggcgcgcactgcacagctctcttctctcgccgccgcccgagcgcacccttcagcccgcgcgccggccgtgagtcctcggtgctcgcccgccggccagacaaacagcccgcccgaccccgtcccgaccctggccgccccgagcggagcctggagcaaaatgatgcttcaacacccaggccaggtctctgcctcggaagtgagtgcttctgccatcgtcccctgcctgtcccctcctgggtcactggtgtttgaggattttgctaacctgacgccctttgtcaaggaagagctgaggtttgccatccagaacaagcacctctgccaccggatgtcctctgcgctggaatcagtcactgtcagcgacagacccctcggggtgtccatcacaaaagccgaggtagcccctgaagaagatgaaaggaaaaagaggcgacgagaaagaaataagattgcagctgcaaagtgccgaaacaagaagaaggagaagacggagtgcctgcagcttcagtattagcagagccacaggccgcctctgtggcatcaccagggtttctctgaagaagagggtctgcattttcctaaacccagtgctgctctcccatctcccatcttcctctcgcagcttgatgagccccggtgtgtcccaggagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttagattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggaacagaattctcccagcgttaacacaaaatccatgggcagcatgatggcaggtcctctgttgcaaactcagttccaaagtcacaggaagaaagcagaaagttcaacttccaaagggttaggactctccactcaatgtcttaggtcaggagttgtgtctaggctggaagagccaaagaaatattccattttcctttccttgtggttgaaaccacagtcagtggagagatgtttggaacacagtcagtggagctggtggtaccaggtttagcattattggatgtcaaaagcattttttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcagaataataaatattgtggtaaaa

SEQ ID NO: 983 - DNA, 1536 bp, Homo sapiens
  Modified_base 1 ... 1536: n = a,c,g, or t
  ref <308>: DATABASE ACCESSION NUMBER: NM_004038
  ref <309>: DATABASE ENTRY DATE: 2001-06-18
atgaagctcttttggttgcttttcaccattgggttctgctgggctcagtattcctcaaatacacaacaaggacgaacatctattgttcatctgtttgaatggcgatgggttgatattgctcttgaatgtgagcgatatttagctcccaagggatttggaggggttcaggtctctccaccaaatgaaaatgttgccattcacaaccctttcagaccttggtgggaaagataccaaccagttagctataaattatgcacaagatctggaaatgaagatgaatttagaaacatggtgactagatgcaacaatgttggggttcgtatttatgtggatgctgtaattaatcatatgtgtggtaatgctgtgagtgcaggaacaagcagtacctgtggaagttacttcaaccctggaagtagggactttccagcagtcccatattctggatgggattttaatgatggtaaatgtaaaactggaagtggagatatcgagaactataatgatgctactcaggtcagagattgtcgtctgtctggtcttctcgatcttgcactggggaaggattatgtgcgttctaagattgccgaatatatgaaccatctcattgacattggtgttgcagggttcagaattgatgcttccaagcacatgtggcctggagacataaaggcaattttggacaaactgcataatctaaacagtaactggttcccggaaggtagtaaacctttcatttaccaggaggtaattgatctgggtggtgagccaattaaaagcagtgactactttggtaatggccgggtgacagaattcaagtatggtgcaaaactcggcacagttattcgcaagtggaatggagagaagatgtcttacttaaagaactggggagaaggttggggtttcatgccttctgacagagcgcttgtctttgtggataaccatgacaatcaacgaggacatggcgctggaggagcctctatacttaccttctgggatgctaggctgtacaaaatggcagttggatttatgcttgctcatccttatggatttacacgagtaatgtcaagctaccgttggccaagatattttgaaaatggaaangatgttaatgattgggttgggccaccaaatgataatggagtaactaaagaagttactattaatccagacactacttgtggcaatgactgggtctgtgaacatcgatggcgccaaataaggaacatggttaatttccgcaatgtagtggatggccagccttttacaaactggtatgataatgggagcaaccaagtggcttttgggagaggaaacagaggattcattgttttcaacaatgatgactggacattttctttaactttgcaaactggtcttcctgctggcacatactgtgatgtcatttctggagataaaattaatggcaactgcacaggcattaaaatctacgtttctgatgatggcaaagctcatttttctattagtaactctgctgaagatccatttattgcaattcatgctgaatctaaattgtaa

SEQ ID NO: 984 - DNA, 780 bp, Homo sapiens
  ref <308>: DATABASE ACCESSION NUMBER: NM_004049
  ref <309>: DATABASE ENTRY DATE: 2001-06-18
gagtgagcattctcagcacattgcctcaacagcttcaaggtgagccagctcaagactttgctctccaccaggcagaagatgacagactgtgaatttggatatatttacaggctggctcaggactatctgcagtgcgtcctacagataccacaacctggatcaggtccaagcaaaacgtccagagtgctacaaaatgttgcgttctcagtccaaaaagaagtggaaaagaatctgaagtcatgcttggacaatgttaatgttgtgtccgtagacactgccagaacactattcaaccaagtgatggaaaaggagtttgaagacggcatcattaactggggaagaattgtaaccatatttgcatttgaaggtattctcatcaagaaacttctacgacagcaaattgccccggatgtggatacctataaggagatttcatattttgttgcggagttcataatgaataacacaggagaatggataaggcaaaacggaggctgggaaaatggctttgtaaagaagtttgaacctaaatctggctggatgacttttctagaagttacaggaaagatctgtgaaatgctatctctcctgaagcaatactgttgaccagaaaggacactccatattgtgaaaccggcctaatttttctgactgatatggaaacgattgccaacacatacttctacttttaaataaacaactttgatgatgtaacttgaccttccagagttatggaaattttgtccccatgtaatgaataaattgtatgtatttttctct

SEQ ID NO: 985 - DNA, 1535 bp, Homo sapiens
  ref <308>: DATABASE ACCESSION NUMBER: NM_004052
  ref <309>: DATABASE ENTRY DATE: 2001-06-18
cctccgctcagtccgggagcgcacgtgggccgcggcgctccgacctccgctttcccaccgcccgcagctgaagcacatcccgcagcccggcgcggactccgatcgccgcagttgccctctggcgccatgtcgcagaacggagcgcccgggatgcaggaggagagcctgcagggctcctgggtagaactgcacttcagcaataatgggaacgggggcagcgttccagcctcggtttctatttataatggagacatggaaaaaatactgctggacgcacagcatgagtctggacggagtagctccaagagctctcactgtgacagcccacctcgctcgcagacaccacaagataccaacagggcttctgaaacagatacccatagcattggagagaaaaacagctcacagtctgaggaagatgatattgaaagaaggaaagaagttgaaagcatcttgaagaaaaactcagattggatatgggattggtcaagtcggccggaaaatattccccccaaggagttcctctttaaacacccgaagcgcacggccaccctcagcatgaggaacacgagcgtcatgaagaaagggggcatattctctgcagaatttctgaaagttttccttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaaaataaaagaatagacactaaaatcatgttgatctataattacacctatgggatcaataagcatgtcagactgattaatgtctactgtgaaaatttggtagtaaattttcatttgatattagatataaatatctgaatataaataattttaatatactagtcatgatgtgtgttgtattttaaaaattatctgcaaccttaattcagctgaagtactttatatttcaaaagaatgaataacattgataataaaatcgctactttaaggggtttgtccaaaataaatattgtggccttatatatcacactattgtagaaagtattatttaatttaaatggatgcaggttgtctactaaagaaagattatatataactatgctaattgttcataatcaacagaaaccaagatagagctacaaactcagctgtacagttcgtacactaaactcttcttgcttttgcattataaggaattaagtctccgattattaggtgatcaccctggatgatcagttttctgctgaaggcacctactcagtatcttttcctctttatcactctgcattggtgaatttaatcctctcctttgtgttcaacttttgtgtgcttttaaaatcagctttattctaagcaaatctgtgtctactttaaaaaactggaaatggaaaaaaaaataaatctt

SEQ ID NO: 986 - DNA, 1262 bp, Homo sapiens
  ref <308>: DATABASE ACCESSION NUMBER: NM_004053
  ref <309>: DATABASE ENTRY DATE: 2001-06-18
gcgtgccatagagatgttcatgaacaagaaccctcctgccaggcgcaccctggctgacatcatcatggagaagctgactgagaagcagacagaggttgagacagtcatgtcagaggtgtcgggcttccctatgccccagctggacccccgggtcctagaagtgtacaggggggtccgggaggtattatctaagtaccgcagtggaaaactgcccaaggcatttaagatcatccctgcactctccaactgggagcaaatcctctacgtcacagagccggaggcctggactgcagctgccatgtaccaggccaccaggatttttgcctctaacctgaaggaacgcatggcccagcgcttctacaaccttgtcctgctccctcgagtacgagatgacgttggtgaatacaaacgactcaacttccatctctacatggctctcaagaaggcccttttcaaacctggagcctggttcaaagggatcctgattccactgtgcgagtctggcacttgtaccctccgggaagccatcattgtgggtagcatcatcaccaagtgctccatccctgtgttgcactccagtgcggccatgctgaaaattgctgagatggaatacagcggtgccaacagcatcttcctgcgactgctgctggataagaagtatgcactgccttaccgggtgctggatgccctagtcttccacttcctggggttccggacagagaagcgtgaactgcctgtgctgtggcaccagtgcctcctgactttggtccagcgctacaaggccgacttggccacagaccagaaagaggccctcttagaactgctccggctgcagccccatccacagctatcgcccgaaatcaggcgtgagcttcagagtgcagcccccgcatgtggaagatgttcccatcaccgtggagtgaggaaaacagtcagcttgtcctggccaaaggggtttggaaggacaccaagaccccgttggtgactgaagatgacactgagctttaatggctgaagacccagatcagggcagtgaccagatcacagggacatctgtggctcccagtccaggacaggaaggactgagggtctggctggttccctcttccattctaggcccttatccctgtttagttctgagagccaacttgagataccatatgctagcattcccagtccccagctggggcttggtgtgagtactttttctatggctattgtgtcaggtcactgtggataaaggcaaagacagatatttattg

SEQ ID NO: 987 - DNA, 1255 bp, Homo sapiens
  ref <308>: DATABASE ACCESSION NUMBER: NM_004079
  ref <309>: DATABASE ENTRY DATE: 2001-06-18
ctaaagatgaaacggctggtttgtgtgctcttggtgtgctcctctgcagtggcacagttgcataaagatcctaccctggatcaccactggcatctctggaagaaaacctatggcaaacaatacaaggaaaagaatgaagaagcagtacgacgtctcatctgggaaaagaatctaaagtttgtgatgcttcacaacctggagcattcaatgggaatgcactcatacgatctgggcatgaaccacctgggagacatgaccagtgaagaagtgatgtctttgacgagttccctgagagttcccagccagtggcagagaaatatcacatataagtcaaaccctaatcggatattgcctgattctgtggactggagagagaaagggtgtgttactgaagtgaaatatcaaggttcttgtggtgcttgctgggctttcagtgctgtgggggccctggaagcacagctgaagctgaaaacaggaaagctggtgactctcagtgcccagaacctggtggattgctcaactgaaaaatatggaaacaaaggctgcaatggtggcttcatgacaacggctttccagtacatcattgataacaagggcatcgactcagacgcttcctatccctacaaagccatggatcagaaatgtcaatatgactcaaaatatcgtgctgccacatgttcaaagtacactgaacttccttatgggagagaagatgtcctgaaagaagctgtggccaataaaggcccagtgtctgttggtgtagatgcgcgtcatccttctttcttcctctacagaagtggtgtctactatgaaccatcctgtactcagaatgtgaatcatggtgtacttgtggttggctatggtgatcttaatgggaaagaatactggcttgtgaaaaacagctggggccacaactttggtgaagaaggatatattcggatggcaagaaataaaggaaatcattgtgggattgctagctttccctcttacccagaaatctagaggatctctcctttttataacaaatcaagaaatatgaagcactttctcttaacttaatttttcctgctgtatccagaagaaataattgtgtcatgattaatgtgtatttactgtactaatagaaaatatagtttgaggccgggcactgtctggctcacgcctgtaatcccagtacttgggaggccaaggaggcatatcaacttgaggccaggagttaaagagcagcctggctaactgtgaaaccctctctact

SEQ ID NO: 988 - DNA, 7515 bp, Homo sapiens
  ref <308>: DATABASE ACCESSION NUMBER: NM_004104
  ref <309>: DATABASE ENTRY DATE: 2001-06-18
atggaggaggtggtgattgccggcatgttcgggaagctgccagagtcggagaacttgcaggagttctgggacaacctcatcggcggtgtggacatggtcacggacgatgaccgtcgctggaaggctgggctctacggcctgccccggcggtccggcaagctgaaggacctgtctaggtttgatgcctccttcttcggagtccaccccaagcaggcacacacgatggaccctcagctgcggctgctgctggaagctacctatgaagccatcgtggacggaggcatcaacccagattcactccgaggaacacacactggcgtctgggtgggcgtgagcggctctgagacctcggaggccctgagccgagaccccgagacactcgtgggctacagcatggtgggctgccagcgagcgatgatggccaaccggctctccttcttcttcgacttcagagggcccagcatcgcactggacacagcctgctcctccagcctgatggccctgcagaacgcctaccaggccatccacagcgggcagtgccctgccgccatcgtggggggcatcaacgtcctgctgaagcccaacacctccgtgcagttcttgaggctggggatgctcagccccgagggcacctgcaaggccttcgacacagcggggaatgggtactgccgctcggagggtgtggtggctgtcctgctgaccaagaagtccctggcccggaaggtctacaccaccatcctgaacaaaggcaccaatacagatggcttcaaggagcaaggcgtgaccttccctcaggatatccaggagcagcctatccgctcgttgtaccagtcggccggagtggcccctgagtcatttgaatacatcgaagcccacggaccaggcaccaaggtgggcgacccccaggagcgtaatggcatcacccgagccctgtgcgccacccgccaggagccgctgctcatcggctccaccaagtccaacatggggcacccggagccagcctcggggctcgacgccctggccaaggtgctgctgtccctggagcacgggctctgggcccccaacctgcacttccatagccccaaccctgagatcccagcgctgttggatgggcggctgcaggtggtggaccagcccctgcccgtccgtggcggcaacgtgggcatcaactcctttggcttcgggggctccaacatgcacatcatcctgaggcccaacacgcagtccgcccccgcacccgccccacatgccaccctgccccgtctgctgcgggccagcggacgcacccctgaggccgtgcagaagctgctggagcagggcctccggcacagccagggcctggctttcctgagcatgctgaacgacatcgcggctgtccccgccaccgccatgcccttccgtggctacgctgtgctgggtggtgagacgcggtggcccagagtgcagcaggtgcccgctggcgagcgcccgctctggttcatctgctctgggatgggcacacagtggcgtggaatggggctgagccttatgcgcctggaccgcttccgagattccatcctacgctccgatgaggctgtgaaccgattcggcctgaaggtgtcacagctgctgctgagcacagacgagagcacctttgatgacatcgtccattcgtttgtgagcctgactgccatccagataggcctcatagacctgctgagctgcatgggacctgaggcagatggcatcgtcggccactccctgggggagtggctgtcggtacgcgacggctgcctgtcccaggaggaggccgtcctcgctgcctactggaggggacagtgcatcaaagaagccccacttcccgccggcgccatggcagccgtgggcttgtcctgggaggagtgtaaacagcgctgcccccctgcggtggtgcccgcctgccacaactccaaggacacagtcaccatctcgggacctcaggccccggtgtttgagttcgtggagcagctgaggaaggagggtgtgtttgccaaggaggtgcggaccggcggtatggccttccactcctacttcatggaggccatcgcacccccactgctgcaggagctcaagaaggtgatccgggagccgaagccacgttcagcccgctggctcagcacctctatccccgaggcccagtggcacagcagcctggcacgcacgtcttccgccgagtacaatgtcaacaacctggtgagccctgtgctgttccaggaggccctgtggcacgtgcctgagcacgcggtggtgctggagatcgccccgaccccgtgccctcaggctgtcctgaagcgggtccgtaagccgagctgcaccatcatcccccgtatgaagaaggatcacagggacaacctggagttcttcctggccggcatcggcaggctgcacctctcaggcatcgacgccaaccccaatgccttgttcccacctgtggagtccccagctccccgaggaactcccctcatctccccactcatcaagtgggaccacagcctggcctgggacgcgccggccgccgaggacttccccaacggttcaggttccccctcagccaccatctacacatgcacaccaagctccgagtctcctgaccgctacctggtggaccacaccatcgacggtcgcgtcctcttccccgccactggctacctgagcatagtgtggaagacgctggcccgcgcctgggctgggctcgagcagctgcctgtggtgtttgaggatgtggtgcagcaccaggccaccatcctgcccaagactgggacagtgtccttggaggtacggctcctggaggccaccggtgccttcgaggtgtcagagaacggcaacctggtagtgagtgggaaggtgtaccagtgggatgaccctgaccccaggctcttcgaccacccggaaagtccccaccccaattccccacggagtcccctcttcctggcccaggcagaagtttacaaggagctgcgtctgcgtggctacgactacggccctcatttccagggcatcctggaggccagcctggaaggtgactcggggaggctgctgtggaaggataactgggtgagcttcatggacaccatgctgcagatgtccatcctgggctcggccaagcacggcctgtacctacccacccgtgtcaccgccatccacatcgaccctgccacccacaggcagaagctgtacacactgcaggacaaggcccaagtggctgacgtggtggtgagcaggtggccgagggtcacagtggcgggaggcgtccacatctccgggctccacactgagtcggccccgcggcggcacgaggagcagcaggtgcccatcctggagaagttttgcttcactccccacacggaggaggggtgcctgtctgagcacgctgccctcgaggaggagctgcaactgtgcaaggggctggtcgaggcactcgagaccaaggtgacccagcaggggctgaagatggtggtgccggactggacggggcccagatccccccgggacccctcacagcaggaactgccccggctgttgtcggctgcctgcaggcttcagctcaacgggaacctgcagctggagctggcgcaggtgctggcccaggagaggcccaagctgccagaggaccctctgctcagcggcctcctggactccccggcactcaaggcctgcctggacactgccgtggagaacatgcccagcctgaagatgaaggtggtggaggtgctggccggccacggtcacctgtattcccgcatcccaggcctgctcagcccccatcccctgctgcagctgagctacacggccaccgaccgccacccccaggccctggaggctgcccaggccgagctgcagcagcacgacgttgcccagggccagtgggatcccgcagaccctgcccccagcgccctgggcagcgcggacctcctggtgtgcaactgtgctgtggctgccctcggggacccggcctcagctctcagcaacatggtggctgccctgagagaagggggctttctgctcctgcacacactgctccgggggcaccctcgggacatcgtggccttcctcacctccactgagccgcagtatggccagggcatcctgagccaggacgcgtgggagagcctcttctccagggtgtcgctgcgcctggtgggcctgaagaagtccttctacggcgccacgctcttcctgtgccgccggcccaccccgcaggacagccccatcttcctgccggtggacgataccagcttccgctgggtggagtctctgaagggcatcctggctgacgaagactcttcccggcctgtgtggctgaaggccatcaactgtgccacctcgggcgtggtgggcttggtgaactgtctccgccgagagcccggcggaaccgtccggtgtgtgctgctctccaacctcagcagcacctcccacgtcccggaggtggacccgggctccgcagaactgcagaaggtgttgcagggagacctggtgatgaacgtctaccgcgacggggcctggggggttttccgccacttcctgctggaggacaagcctgaggagccgacggcacatgcctttgtgagcaccctcacccggggggacctgtcctccatccgctgggtctgctcctcgctgcgccatgcccagcccacctgccctggcgcccagctctgcacggtctactacgcctccctcaacttccgcgacatcatgctggccactggcaagctgtcccctgatgccatcccagggaagtggacctcccaggacagcctgctaggtatggagttctcgggccgagacgccagcggcaagcgtgtgatgggactggtgcctgccaagggcctggccacctctgtcctgctgtcaccggacttcctctgggatgtgccttccaactggacgctggaggaggcggcctcggtgcctgtcgtctacagcacggcctactacgcgctggtggtgcgtgggcgggtgcgccccggggagacgctgctcatccactcgggctcgggcggcgtgggccaggccgccatcgccatcgccctcagtctgggctgccgcgtcttcaccaccgtggggtcggctgagaagcgggcgtacctccaggccaggttcccccagctcgacagcaccagcttcgccaactcccgggacacatccttcgagcagcatgtgctgtggcacacgggcgggaagggcgttgacctggtcttgaactccttggcggaagagaagctgcaggccagcgtgaggtgcttcggtacgcacggtcgcttcctggaaattggcaaattcgacctttctcagaaccacccgctcggcatggctatcttcctgaagaacgtgacattccacggggtcctactggatgcgttcttcaacgagagcagtgctgactggcgggaggtgtgggcgcttgtcgaggccgccatccgggatggggtggtacggcccctcaagtgcacggtgttccatggggcccaggtggaggacgccttccgctacatggcccaagggaagcacattggcaaagtcgtcgtgcaggtgcttgcggaggagccggcagtgctgaagggggccaaacccaagctgatgtcggccatctccaagaccttctgcccggcccacaagagctacatcatcgctggtggtctgggtggcttcggcctggagttggcgcagtggctgatacagcgtggggtgcagaagctcgtgttgacttctcgctccgggatccggacaggctaccaggccaagcaggtccgccggtggaggcgccaggggctacaggtgcaggtgtccaccagcaacatcagctcactggagggggcccggggcctcattgccgaggcggcgcagcttgggcccgtggggggcgtcttcaacctggccgtggtcttgagagatggcttgctggagaaccagaccccagagttcttccaggacgtctgcaagcccaagtacagcggcaccctgaacctggacagggtgacccgagaggcgtgccctgagctggactactttgtggtcttctcctctgtgagctgcgggcgtggcaatgcgggacagagcaactacggctttgccaattccgccatggagcgtatctgtgagaaacgccggcacgaaggcctcccaggcctggccgtgcagtggggcgccatcggcaccgtgggcattttggtggagacgatgagcaccaacgacacgatcgtcagtggcacgctgcccacgcgcattggcgtccttggcctggaggtgctggacctcttcctgaaccagccccacatggtcctgagcagctttgtgctggctgagaaggctgcggcctatagggacagggacagccagcgggacctggtggaggccgtggcacacatcctgggcatccgcgacttggctgctgtcaacctgggcggctcactggcggacctgggcctggactcgctcatgagcgcgccggtgcgccagacgctggagcgtgagctcaacctggtgctgtccgtgcgcgaggtgcggcaactcacgctccggaaactgcaggagctgtcctcaaaggcggatgaagccagcgagctggcatgccccacgcccaaggaggatggtctggcccagcagcagactcagctgaacctgcgctccctgctggtgaaaccggagggccccaccctgatgcggctcaactccgtgcagagctcggagcggcccctgttcctggtgcacccaatcgaggctaccaccgtgttccacagcctcggtcccggtctcagcatccccacctatggcctgcagtgcaccccggctgcgccccttgacagcatccacagcctggctgcctactacatcgactgcatcaggcaggtgcagcccgagggcccctaccgcgtggccggctactcctacggggcctgcgtggcctttgaaatgtgctcccagctgcaggcccagcagagcccagcccccacccacaacagcctcttcctgttcgacggctcgcccacctacgtactggcctacacccagagctaccgggcaaagctgaccccaggctgtaaggctgaggctgagacggaggccatatgcttcttcgtgcagcagttcacggacatggagcacaacagggtgctggaggcgctgctgccgctgaagggcctagaggagcgtgtggcagccgccgtggacctgatcatcaagagccaccagggcctggaccgccaggagctgagctttgcggcccggtccttctactacaggctgcgtgccgctgaccagtatacacccaaggccaagtacagtggcaacgtgatgctactgcgggccaagacgggtggccgctacggcgaggacctgggcgcggactacaacctctcccaggtatgcgacgggaaagtatccgtccatatcatcgagggtgaccaccgcacgctgctggagggcagcggcctggagtccatcatcagcatcatccacagctccctggctgagccacgtgtgagtcgggagggctag

SEQ ID NO: 989 - DNA, 1468 bp, Homo sapiens
  ref <308>: DATABASE ACCESSION NUMBER: NM_004109
  ref <309>: DATABASE ENTRY DATE: 2001-06-18
gccactccagccccgcgcccctcgccgcggccctcgggcgtctgcgccgcagctgccgcccccgcctctttggagtctctcgcggcctcaaagcgcggcctgcgtcgcttccggcagttccagaccgcgggcgatggctgccgctgggggcgcccggctgctgcgcgccgcttctgctgtcctcggcggcccggccggccggtggctgcaccacgctgggtcccgcgctggatccagcggcctgctgaggaaccgggggccgggcgggagcgcggaggcgagccggtcgctgagcgtgtcggcgcgggcccggagcagctcagaagataaaataacagtccactttataaaccgtgatggtgaaacattaacaaccaaaggaaaagttggtgattctctgctagatgttgtggttgaaaataatctagatattgatggctttggtgcatgtgagggaaccctggcttgttcaacctgtcacctcatctttgaagatcacatatatgagaagttagatgcaatcactgatgaggagaatgacatgctcgatctggcatatggactaacagacagatcacggttgggctgccaaatctgtttgacaaaatctatggacaatatgactgttcgagtgcctgaaacagtggctgatgccagacaatccattgatgtgggcaagacctcctgaactagaacaaataggaatattttcatggaattttacctatttttataattattatttcttaaagtgattaaatgagaacatggatgagtggacttcatattatgactagctttactattttaattcaccttgcataactactgaattttgtcattcttgaaagtatgcaatttttattttggttatattacaaaaatgtcaatcaaatattaaaaaatagttaatgtgatagaaaaaccttacatatttttttcttatgtttgtttagcgactttagcaaaatgttttcatataatctcatctgtttacctagaagataggttaaggaaatatattattattcctgtttgatgtgggtgaaggcagagatctaacctggcttgtttagggccataccactaattagaaaatctgtgctagaacctgtgtcttattcctataagctatgtgttcagactgaaactggagaaattatgactattttatttatagtagtagttaaatctgaatgtgtatggactaaaaatatttaattgctgagtaaactgcttaacttcaaagatagttattgaccttataaataaatatttcaaaattttgattcggaagactaagtctggagctagacattataatgctatcaaagaagttgatctctgttttgactaaactagaggaaaaatgattggatgagtttattcttttctaagcagaatggtttaactttgtactcaaagaaaaataatgctgatttataaatctctgcctataatagaatgg

SEQ ID NO: 990 - DNA, 1838 bp, Homo sapiens
  ref <308>: DATABASE ACCESSION NUMBER: NM_004110
  ref <309>: DATABASE ENTRY DATE: 2001-06-18
atccacttgcaggttgctgctcccagccatggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcaggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggaggccctccttttgtgccagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagcccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggtcaccaggttgggaacatgctggaaataaaacagctgcaccc

(The sequence listing continues in the following parts.)

What is claimed is:

1. A method for classifying an individual afflicted with breast cancer as having a good prognosis or a poor prognosis, wherein said individual is a human, wherein said good prognosis indicates that said individual is expected to have no distant metastases within five years of initial diagnosis of breast cancer, and wherein said poor prognosis indicates that said individual is expected to have distant metastases within five years of initial diagnosis of breast cancer, comprising:

(i) calculating a measure of similarity between a first expression profile and a good prognosis template, or calculating a first measure of similarity between said first expression profile and said good prognosis template and a second measure of similarity between said first expression profile and a poor prognosis template; said first expression profile comprising the expression levels of a first plurality of genes in a cell sample taken from the individual; said good prognosis template comprising, for each gene in said first plurality of genes, the average expression level of said gene in a plurality of patients having no distant metastases within five years of initial diagnosis of breast cancer; and said poor prognosis template comprising, for each gene in said first plurality of genes, the average expression level of said gene in a plurality of patients having distant metastases within five years of initial diagnosis of breast cancer; said first plurality of genes consisting of at least 5 of the genes for which markers are listed in Table 5;

(ii) classifying said individual as having said good prognosis if said first expression profile has a high similarity to said good prognosis template or has a higher similarity to said good prognosis template than to said poor prognosis template, or classifying said individual as having said poor prognosis if said first expression profile has a low similarity to said good prognosis template or has a higher similarity to said poor prognosis template than to said good prognosis template; wherein said first expression profile has a high similarity to said good prognosis template if the similarity to said good prognosis template is above a predetermined threshold, or has a low similarity to said good prognosis template if the similarity to said good prognosis template is below said predetermined threshold; and (iii) displaying; or outputting to a user interface device, a computer readable storage medium, or a local or remote computer system; the classification produced by said classifying step (ii).

2. The method of claim 1, wherein said first plurality consists of at least 20 of the genes for which markers are listed in Table 5.

3. The method of claim 1, wherein said first plurality consists of at least 100 of the genes for which markers are listed in Table 5.

4. The method of claim 1, wherein said first plurality consists of at least 150 of the genes for which markers are listed in Table 5.

5. The method of claim 1, wherein said first plurality consists of each of the genes for which markers are listed in Table 5.

6. The method of claim 1, wherein said first plurality consists of the 70 genes for which markers are listed in Table 6.

7. The method of claim 1, which further comprises the steps of:

(a) generating said good prognosis template by hybridization of nucleic acids derived from said plurality of patients having no distant metastases within five years of initial diagnosis of breast cancer against nucleic acids derived from a pool of tumors from a plurality of patients having breast cancer;

(b) generating said poor prognosis template by hybridization of nucleic acids derived from said plurality of patients having distant metastases within five years of initial diagnosis of breast cancer against nucleic acids derived from said pool of tumors from said plurality of patients;

(c) generating said first expression profile by hybridizing nucleic acids derived from said cell sample taken from said individual against nucleic acids derived from said pool of tumors from said plurality of patients; and (d) calculating (d1) said first measure of similarity between said first expression profile and the good prognosis template and (d2) said second measure of similarity between said first expression profile and the poor prognosis template, wherein if said first expression profile is more similar to the good prognosis template than to the poor prognosis template, the individual is classified as having a good prognosis, and if said first expression profile is more similar to the poor prognosis template than to the good prognosis template, the individual is classified as having a poor prognosis.

8. The method of claim 1, further comprising (iv) classifying said individual as ER(+) (estrogen receptor positive) or ER(−) (estrogen receptor negative) based on a second expression profile comprising the expression levels of a second plurality of genes in a cell sample taken from the individual, said second plurality of genes consisting of at least 5 of the genes for which markers are listed in Table 1, wherein said classifying said individual as ER(+) or ER(−) is carried out by a method comprising: (a) calculating a third measure of similarity between said second expression profile and an ER(+) template and a fourth measure of similarity between said second expression profile and an ER(−) template; said ER(+) template comprising, for each gene in said second plurality of genes, the average expression level of said gene in a plurality of ER(+) patients; said ER(−) template comprising, for each gene in said second plurality of genes, the average expression level of said gene in a plurality of ER(−) patients; and (b) classifying said individual as ER(+) if said second expression profile has a higher similarity to said ER(+) template than to said ER(−) template, or as ER(−) if said second expression profile has a lower similarity to said ER(+) template than to said ER(−) template; and (v) displaying; or outputting to a user interface device, a computer readable storage medium, or a local or remote computer system; the classification produced by said classifying step (iv).

9. The method of claim 1, further comprising (iv) classifying said individual as BRCA1 or sporadic based on a third expression profile comprising the expression levels of a third plurality of genes in a cell sample taken from the individual, said third plurality of genes consisting of at least 5 of the genes for which markers are listed in Table 3, wherein said classifying said individual as BRCA1 or sporadic is carried out by a method comprising: (a) calculating a third measure of similarity between said third expression profile and a BRCA1 template and a fourth measure of similarity between said third expression profile and a non-BRCA1 template; said BRCA1 template comprising, for each gene in said third plurality of genes, the average expression level of said gene in a plurality of BRCA1 patients; said non-BRCA1 template comprising, for each gene in said third plurality of genes, the average expression level of said gene in a plurality of non-BRCA1 patients; and (b) classifying said individual as BRCA1 if said third expression profile has a higher similarity to said BRCA1 template than to said non-BRCA1 template, or as sporadic if said third expression profile has a lower similarity to said BRCA1 template than to said non-BRCA1 template; and (v) displaying; or outputting to a user interface device, a computer readable storage medium, or a local or remote computer system; the classification produced by said classifying step (iv).

10. The method of claim 1, wherein said expression level of each gene in said first expression profile is a relative expression level of said gene in said cell sample versus expression level of said gene in a reference pool.

11. The method of claim 10, wherein said reference pool is derived from a normal breast cell line.

12. The method of claim 10, wherein said reference pool is derived from a breast cancer cell line.

13. The method of claim 10, wherein said relative expression level is represented as a log ratio.

14. The method of claim 1, wherein said step (i) comprises calculating said measure of similarity between said first expression profile and said good prognosis template; and said step (ii) comprises classifying said individual as having said good prognosis if similarity of said first expression profile to said good prognosis template is above a predetermined threshold.

15. The method of claim 14, wherein said average is an error-weighted average.

16. The method of claim 14, wherein said expression level of each gene in said first expression profile is a relative expression level of said gene in said cell sample versus expression level of said gene in a reference pool, represented as a log ratio; and wherein the average expression level of each gene in said first plurality of genes in said good prognosis template is an average of relative expression levels, each relative expression level being the expression level of said gene in one of said plurality of patients having no distant metastases within five years of initial diagnosis of breast cancer versus the expression level of said gene in a reference pool, represented as a log ratio.

17. The method of claim 16, wherein said average is an error-weighted log ratio average.

18. The method of claim 14, wherein said measure of similarity is a correlation coefficient between said first expression profile and said good prognosis template.

19. The method of claim 1, further comprising determining said first expression profile by measuring the expression levels of said first plurality of genes in said cell sample from said individual.

20. The method of claim 8, wherein said expression level of each gene in said second expression profile is a relative expression level of said gene in said cell sample versus expression level of said gene in a reference pool.

21. The method of claim 20, wherein said reference pool is derived from a normal breast cell line.

22. The method of claim 20, wherein said reference pool is derived from a breast cancer cell line.

23. The method of claim 20, wherein said relative expression level is represented as a log ratio.

24. The method of claim 8, wherein each said average is an error-weighted average.

25. The method of claim 8, wherein said expression level of each gene in said second expression profile is a relative expression level of said gene in said cell sample versus expression level of said gene in a reference pool, represented as a log ratio; wherein the average expression level of each gene in said second plurality of genes in said ER(+) template is an average of relative expression levels, each relative expression level being the expression level of said gene in one of said plurality of ER(+) patients versus the expression level of said gene in a reference pool, represented as a log ratio; and wherein the average expression level of each gene in said second plurality of genes in said ER(−) template is an average of relative expression levels, each relative expression level being the expression level of said gene in one of said plurality of ER(−) patients versus the expression level of said gene in a reference pool, represented as a log ratio.

26. The method of claim 25, wherein each said average is an error-weighted log ratio average.

27. The method of claim 8, wherein said third measure of similarity between said second expression profile and said ER(+) template is a correlation coefficient between said second expression profile and said ER(+) template, wherein said fourth measure of similarity between said second expression profile and said ER(−) template is a correlation coefficient between said second expression profile and said ER(−) template, and wherein said second expression profile is said to have a higher similarity to said ER(+) template than to said ER(−) template if said correlation coefficient between said second expression profile and said ER(+) template is greater than said correlation coefficient between said second expression profile and said ER(−) template, or is said to have a lower similarity to said ER(+) template than to said ER(−) template if said correlation coefficient between said second expression profile and said ER(+) template is less than said correlation coefficient between said second expression profile and said ER(−) template.

28. The method of claim 8, further comprising determining said second expression profile by measuring the expression levels of said second plurality of genes in said cell sample from said individual.

29. The method of claim 9, wherein said expression level of each gene in said third expression profile is a relative expression level of said gene in said cell sample versus expression level of said gene in a reference pool.

30. The method of claim 29, wherein said reference pool is derived from a normal breast cell line.

31. The method of claim 29, wherein said reference pool is derived from a breast cancer cell line.

32. The method of claim 29, wherein said relative expression level is represented as a log ratio.

33. The method of claim 9, wherein each said average is an error-weighted average.

34. The method of claim 9, wherein said expression level of each gene in said third expression profile is a relative expression level of said gene in said cell sample versus expression level of said gene in a reference pool, represented as a log ratio; wherein the average expression level of each gene in said third plurality of genes in said BRCA1 template is an average of relative expression levels, each relative expression level being the expression level of said gene in one of said plurality of BRCA1 patients versus the expression level of said gene in a reference pool, represented as a log ratio; and wherein the average expression level of each gene in said third plurality of genes in said non-BRCA1 template is an average of relative expression levels, each relative expression level being the expression level of said gene in one of said plurality of non-BRCA1 patients versus the expression level of said gene in a reference pool, represented as a log ratio.

35. The method of claim 34, wherein each said average is an error-weighted log ratio average.

36. The method of claim 35, wherein said third measure of similarity between said third expression profile and said BRCA1 template is a correlation coefficient between said third expression profile and said BRCA1 template, wherein said fourth measure of similarity between said third expression profile and said non-BRCA1 template is a correlation coefficient between said third expression profile and said non-BRCA1 template, and wherein said third expression profile is said to have a higher similarity to said BRCA1 template than to said non-BRCA1 template if said correlation coefficient between said third expression profile and said BRCA1 template is greater than said correlation coefficient between said third expression profile and said non-BRCA1 template, or is said to have a lower similarity to said BRCA1 template than to said non-BRCA1 template if said correlation coefficient between said third expression profile and said BRCA1 template is less than said correlation coefficient between said third expression profile and said non-BRCA1 template.

37. The method of claim 9, further comprising determining said third expression profile by measuring the expression levels of said third plurality of genes in said cell sample from said individual.

38. The method of any one of claims 10-14 and 15-16, wherein said first plurality consists of at least 20 of the genes for which markers are listed in Table 5.

39. The method of any one of claims 10-14 and 15-16, wherein said first plurality consists of at least 50 of the genes for which markers are listed in Table 5.

40. The method of any one of claims 10-14 and 15-16, wherein said first plurality consists of at least 75 of the genes for which markers are listed in Table 5.

41. The method of any one of claims 1-6, wherein said step (i) comprises calculating said first measure of similarity between said first expression profile and said good prognosis template and said second measure of similarity between said first expression profile and said poor prognosis template, and said step (ii) comprises classifying said individual as having said good prognosis if said first expression profile has a higher similarity to said good prognosis template than to said poor prognosis template, or classifying said individual as having said poor prognosis if said first expression profile has a lower similarity to said good prognosis template than to said poor prognosis template.

42. The method of claim 41, wherein said first measure of similarity is a correlation coefficient between said first expression profile and said good prognosis template, and wherein said second measure of similarity is a correlation coefficient between said first expression profile and said poor prognosis template.

43. The method of any one of claims 1-6, and 14, wherein said breast cancer is sporadic breast cancer.

44. The method of claim 41, wherein said breast cancer is sporadic breast cancer.

* * * * *